United States Patent 8,216,786 (GENETIC POLYMORPHISMS ASSOCIATED WITH CARDIOVASCULAR DISEASES, METHODS OF DETECTION AND USES THEREOF) - sequence listing, part 14

SEQ ID NO: 1321 - DNA, 199790 bp, Homo sapiens
agtgctccactccagctcctgcttccctttgcaccctccagccaatccagctcctcgcagctcccagggtgctctgcggcttcattagctctggcctttgtaggtgctgctccttttgtctgggaggcttcttgccttctcccctccccattactgtttgtcaggctatcctccacttgtccttccaggtttagcataagtgtttcttattttgggaaacttctgaccaccaccgtccccatcccaaccctcacttaagtgcctcaggtgggctgccctggcctccgtattcccccatcagagcacgatcacattgctgtgcgtagaacctcttcacatgttttttttcctccaccaaacagaactccaagctcctagatccttgagggcagggtctggggatgcattcgtttcatcccacagatacggagttcctcctgcggcaccattgtgctgcaccccactgctcagctgacggggtccaggcctgctctctgtgtagtgggcagtagcagtatctaaataaattcctgatagagcatcaggcagtaatatgcaccctggagagacctacagcagggtcaggactgcgaaagcggagtaggggtactgcctgctctgggaccaaccaggccccacacaggcctgagtgtgggcttgctaaatggagtcgctgagcctttgaacattctcagcaggtccgttcttgaactggttctccagcagctctcagtgctgtttccacctgaaatgcctgctgggtctgtgccctttgctttggccccagacaccctcagttcacctgcatagtcacaccagccacctccgtgctctctgctcttagtcaggttttccctcctgactctgtgtcttcaggttctcttccctcagcctctcccttccaggatactgactcagggctgggcctgttgtggtttggagacagcttctcctcacctctgcagcctcatctcctgccgctccacccctcagcattcgccctgggctccagcccgatcttgcccttcctgccttcatttctacttcttctattgcatgtgctgggctttctgaagtctccttccttttctttttctttctgccccattctgctcacccttccatgtataaatgtcggcaagtcagtcatttcttcctgctttcttctttttcctacttctgcagtggggtctgtctcctttcattttcactatttgaacagctgacggtaagctccttgaggacaggaaccagagtcaagttactgctgtgtctgtttccagcacaggatataggcgcagcagaaagcaagcaggtgcccaataaatgtgtgtggaatgggtgagggatgattgtccctgggattagagagggcagcagcccatttcaaccatcattcctggtggtggaagtgagagggcctcgggagcagagcagcgtcaacagttgttttggctgaagggggctgggaatgcttcctgtcctcccaggctacagcccctcaatgccccttcttagtccgagagagagacgatgtcagaaaaagaaagttactgtccaggcactgaagatttacttcaatccaatctttgttttaattgctgccgttaaacctagtagcaggatcctaatgaaccgtgttctttccaggaacctgttggcccagttggtttcaagccagagacattcagaaagtttttagctctatatttgcatggtgctgcgtgagcggaggacccctctgaatcctgaaacccctcttgcctctcttccacggaagagggcctgggccccgtggagcctcagtgcccgtttggcctgctgctctcgctgacaataaagagcccttgcgttgcactgaagcctgtgtttggtatgagggtgccatcgggaagggcgcccacacaagtccaagccctggagcctgacctgccccagctgaagcccagctctgcccttgacccatgttgtgatcttagataaggatcttcatctgtctctttccatttcttcatctgaaacctggggctaatgtgacttacctggcgttgaagactctgggttatgtgtgtgtagtgtctgccacatggcagatacgctgatggtcactaggttcttatggcattatttaaattgtggacacattccacaatgactgcagaaaatctcgctagcatatttattgtagatttctccctcgtatcctggttaatggggcaagtacacccctggttcagctggtctctgtccaaataatgtcaagtcctgatctgtgccagacactgctgccatgccaagcacctgatacatagcatatttaatctgcacacaccccttacaaggtaaatgtcatttccatattcaagaaaaatattgcatgcctagcatgtgccatgcactgttctgggccctaagaagaaaacacggataatttaaggaatttgcccacggtcacccacctggtgctataggtcagcttcccgaggaaacacttagagacttttatttggggagaacctttaggacaggaacctgtggagagcgaaggcagcagcaggtgggggtggcgggcccaagctcagtgtggctgcctctgaggcctcacccagttcatgggcactctggagccagaggcaagggagttgagccttctacaaacacccctggcctggcaccagccattggatatgtgctgcttcctgacagcgggtgggaccttgggcgaggtggctttgttggtctgtaattcctgctgagggactgctgagagcagttagtgtgggaacttccagcagctggaggagctctcagctaggcagtggcaaagtggcgtccagcctgtgtctctgcctcccaggcttgggctctttccacttgaaagcttactttttaggcttgagggattagcaggaaaagcagcaaggcacagaggaccatggggacaggaagtgactggaagtggggaggccggaggcttggctggggctggagtggccagcttgggaggggcctgaacaccaagcacctcacctcctagggcagctgacctggggctccgggtactctgagccctgctgcccattttactttttattttacagacaggaaacaattatacataaatgataaaagttcagagttcagggaaagataagtcgacccacccaaggtgatccctagctagtccttttctctaaggttaacagagcttcaagtttcttccatgctgttggtgaaaatgtgtatgtatcataacaacacacatatatacatgactgaagagtcatcctatttacagcctgttctgcacttcctttttcacctgatgtctctggattgtaggctcttgccacatcaccacataggatctcttcgttcttttgagcagccacattagtatctgttgatggcagtccgggttgtttccagttgttattagaaataatgctgcagtgagcaccctcgttcatgtatcttagagtagttttgccagcagagccattgggtaagttcctagcagtggaattgctgagtcaaacgtttttttttttaaacaacactctgttgggagtacagaggaggagctggtgggatggcggtagggagtccagctggaggccactgcggggatcctggggcaagtggtggtgatggcttggcgtgatcctgagcaggctgaagcccctggagactgcttggagaggagggagggtgaggtgaacttgagccctgagcgagtgggacggaggctctgagtaagcggaccatcagcagatgaccttgtagcttgaggactgcctggaagggggccagggttgccgggcaggcctgggcagcctgtcctcccaacccaccctgaatgagggcagctcggatgctggccttagtgctaagttgtggagcctggaacccaactacacttttgtgtcaagggagctgcaaagtacagctgatctgcaaagtggggcaggcaggactggcggttttttttattgtccccatggagatgaggaaacaggcttagagaccacatgatgcagtgtgaagagctgggaagctcgtgtgtcatgacagctgccccctccacagacaggtccttgcttctccaaatcccaaatgtctaccagcttcgtcctcactccctcattcaacgcaggagaggaagtgatgcagcggaacttgagggcctcagccagcctcccgcccagtacaggctccccagccagtgagctggtgaaggagcaggagcacgctgcagggagagtgctgcgccgggtcatgctggatagcgaaaccccacgagaggaacttccagcagcagacttttggaaatgaaatggtgacattcccattgtgaacgtatttctcactgtctcatatatttaaattcctggttgttccattcaaaagttcttcagttcatttccagcaagcttcagtggcaagggaattctaatttggcctgggggaaagccacttttcccctcctgtattccagctgccctgtcagatcctccacttcctcgctggcaaaatggggatacagcacctcccttccaagtttccccacctttggatcaaataggctccattcgccaaggtttcaagtcgatgggtttggagttcttcttagaagccaggtggaaaggtggacttgctggaggggacctcactttaggctgctctctgttctctcccaaagctggctcaggctggacctggggcaagtgtttggcagaggctctgtgacaacccacaggagcaggacaggatcctctcgggctttagacagcatctccctggttcctcttttgctgtgggtgaaagtctcagaaagcatgcaggtgacccgattgtcttgactctctctttaacatggacactcagatgtccatgacccataaggcctacctgcttcactgctggaagacccccgatccagggaccctctcccctcagaatacatctcctcatatccaaaaactgcatccaggggggcgtgctgcccagggcaggacctccatcccttagaggccagcttgtcagagcaacatggcccctgccatgttcactctcacacacgtgcacaggcatacatgcgcgcacacatgcatacaggcacatcacactcccacacatgcagtcacactcccacccacacaccacacactcagacatgtgcacacacacacacgtgtacacgagacccatggatctcctcctccccagctaggccaatgatggaacccaagaataggtccagactggagattgagccctgaggtccctcaccgtagacctcctttgggggcagcccatttaataagcacctactgtgtaccaggtgttgtgctgggagcgagttacagaatgagggagacatggtccccgccctctgggagctcctggggtactgggtggacacggccagagtggtctcctttggattggcagtagcaggtacccacaaaggccacctccttccccacacctgggcgcctacccacccacaggtgacagcttgccatagggaggggtgccactgagcacattctggggctactcaacaacatccagttattccaagagcactcatcgagcacctactgggcaccaggacctgtgctggcaattctcaggacgaagagggctcttacatggtccctggcttagaggagctcccagcctgatgggggaagcatacactgaaccaggctgtggggacccagggagagagctaccccagcctggaaggcttccaggaggaggggccatctgagctaggttctgaagggcaagtgggaaggaggaggggccagcaggaacaaaggccctgggggggcagacatccacagagtactgcaaagttggaggtgaagtgctgaggggcaaggaaaagcaggagtgtccatggcccttccatgccctgcagctatctggaagctgtgaggagcgtggacttggtcccagagtcacggtgggcgtggccacctgggttccccactagcaagaagccctctcctctctgcaccccttttcttctcgtggtcaccagggcatctcactttcctggtcttctactcactgctctgtcgcctttgtgggtccctcctattccccagatctcagggcccagtccttcggcctcttctccattcattccctagatgatttcagccagtctggtggctttaaagaccctctaaatggcaacaactcccatggtatgtctgtagttcagacctgcctacttgatgtctttactggatatcaaatcagcatctcaaatttaactcgccagaacagagctcttcctgcagcttgcctcacctccacaaacggcatctctgtccttccgtgtctgttcactactgtacccctagtgccagaacaacccctggcataaaaggggtgctcagcaaacacgagtggatggatggaaagaaggaagtctatggaggctcaaagtgagatggtctttgtggcactggagggctgacatgggaggcaggaaaccaagggcatggctgaattccagaaaccagatgccaggttctgcggctccgcaggcaccctgggaatagagagaacacaacctctgcctttcagcacccaccctcgttggtctgatcttttacatccaacccccagccccaactccaagcccccagtgcttgtacccagtgagcccagggctgggcagagcaacgctcatccgcctgtaaccccaccctgcccagccactctgctcaagtccaggggagccccatggcctgaaccccaagaggcccagctcccctcagttcagggtcagagccctctgagggaccccaggtatgttctgggctcaatctcctggagtctgtggaatctgggaacacagcccaccacttcatgggacagccgagactggggcgggggattcctcaggtcaccagggagccagactgagcagccttcttacccccgctagagccctgctctggcctagcgcgttagtggctatgctgctgctggtgtcagcgacttgccttaagtttctttcctggctctggggcagggggcagtggggatgcccagcagggaggcaggtgtggggtcctgtctcaggcctggtcctacctctggccccccaggccggccgacccctagaatcaagtgcctgtggacagcgatgactccagcaggaaagctgtggtctggcccccgactccggcacctctcagtgatgggccgaagccctattttgtggaaggactggcatgatgctcccttttctcctcctcatttcagtatctttccactggctcatgtagagctctggcctggccccaggcagtgatgaaaatgcttagtgaacaagaaccagttctttgctcagagatctgcccctgaggaaggccaaactaacctgcaccagggccatttgtgttgtgaaggcaactgccaggctgccgaggggccccaggctgaggggtagcacagcacacagcaggcgctcttcccaggctgggccccgtgacctgccttcctccagctaggcaccctgatcccatggctctcgtctgtgcctgactcctgctccaaggagcacaggtatcggatggatatcccatccacccaacctcctttccccagccctgggtcagcaccattgatacaggttagtcgcagcctcagtctcttcatctctccaatggagatgcttttccaatagttcaaaggtgtctgtactcagcaaaagcctaggaaaccttgttccaaggtgaagagggaaggaccagatggaatctcctagatcctcccagctactccccaacacacccatttggactctccccacgagtaacatcacttgtagcgaacacatgctgctcttagtccgtgcacggcactgttctaagcacttcacggtgctaacctcctcacagcctatgaggcagccaacccgccatcccccattttgcagatgagagaactgagaacagaagtatcaactaatttgcccaaggccacacagcaagttgcagcaaacaagatttaaacctgggaatttgctatctggtcccctaagggctttataaacatgggctgagcctgccctttgcttggaccctctgtctcccacccacccaccacggcatccgctcctgctacaagcctagaatgaggtccccagagctccagggaagtacaaagttctttctagtcgtgcaagtcagcatccatagcagcttacctcaccctagccctcagcatttcttgcctaaatgtcgtctgggaatgcctctctccatatcttgccagccccacctgattcatctcccaggagaccaccagcatacactttccaaaatttaagtagactgcactactctcaaaacccttcaagggctcccagtacaccttggaggtttaggaaaaaaaaaaatcaacctccctgtgccaacagtcgccaacagcaggcacttgaggctgggggcctggggtgaagccagtcccacccgaggggagaaagcagggagtggctgtggccctcctggccgatagcgactccccatagaaaacagagggcaccaggaggaacctttttctacttccagaaaaataaaagacattccagcggaccaaaatgtgtttgcaagacaagaaatggaaaatggcttttagacggcccccaaatatttaaagtgagatggataccttccctcccaacccaccttccgccaaggccatcgcgactccacaagaacacagaatttgcaggcccaggaaaagaaggcagacgcctcaaacacaaaacatcttgttatgcaccaggaacaaaaactgtgcccaagaagtcaccttgcattttgtaatcagtgtaataaactccaacccacattccccaaacatgtcaggaagggctgcggaaaaaagatgtccctttaataaaacgttatcaacatatatcgtacacaaactacaatgtatcataattacttttttttcctctcttaattcagaaccagactacaaggtaagaaaaaacacagaaacagctacaatgttcccaataatccgcacaaagtcttttttcaggcagatgatatctcacataatatgatatacatggatcagaaagggagggagtaaaacaaagaccagctacaggggagggaggaaggagaagggcatgtcaatgtacaaagaattcgggtgtcttccagggcaagacacaaaggtttccgtggggtgatgaggtgagtggggccatgagcaccctcccgggaggggacaggctccactgtcgggcttgttggtttttgaaagtaaaaacaggactggagccagcacgtctgtttggttgtcggtgtccccccaccccccacagctgctccaaagtctttccatccagtcccaagcatatacagagcaattctgatcagtatcccatctttgagaaaggacgaataaagagaaaaaacaaagaaaaccggaactccagccccccaagccggtgcacacgatgacgctgatgcgaggatctcgggaccagaacgcggaggtcactgtttccatgtcccaggtcatagccatcctgtcagtggcagcctctcccactctgcgccaggccaccacccagctggcaggattctcactgggaagactggggtgggggcagaggaggggctggagaggcagggaggccaggacggaagggaggtccaggagaggaggagggtgtcctgggaacagtgcatgccaccgggtcacggtgacggtctgggctgtggtggaatcctgaaaggggtcagtggtccggcccctctggccacaggatgagggtgctgggttctggggtccaagcgtgccgctgctgttgccatggaaatcaagctagaacaaacgcgtccccactcctcccctgcctgttgcacaaaccaaaaccccaagtggaaaacggtgactgccttttcttctttccaaaaaaggccttttgaaagaaaccaacgattgtaaactgtccagtttattattattatttttgatggctacagacaatgtgggctctcacacctagactagcttttctggtggaagggcttgggcacagacagacagcagggcttctggttttccttttttttttttcctttttcctttttttttttttttaagaagaaagcatagaggttgattggggtggggggcttgctagaagcttccatttaaaaaaattttcccccaaaaaacccccctgaaaacaaataaaaaaatcccaacaatggtaaaaccccaaacaaaaaacaacaaaaaagtgtcatgtacagaaaaggtcctttggggaaagggcaaggggtgggatttttctggtcactgacttgaaatacatttttgagagttttgtccttcttgttttatggaataaaaagtttggcctttttattgcatgaaactaaaattgggaaaggtagggggcgtggatggggtgggagggggttgaggggagcagggagatgccctccccaccagctcctggataatgacacctcacttcttgcataatttctggcatcttcccgcctgcaatgcctgctctctcagcgtctcggagaaggggggatcacacactcatcgtcatgcttggagaatactggaaaggagaagcagagaaggggggggggtgaggattgtggggaggccgctgacacacccaggtgccaagagcctggggtgactgcacagaactgagcagggctcatttggggatgtggttgagctgaggggcacatggtggcatggagtgggcagggggccggtagggcaggataagggccaggaggcgggagctaagagccacttctcagtgccagcctgcccttctgttgggaactaaggcagctgacggcgcctcccctgctcctgcccctgtctgagtcatcctctcctctccaatggcagtcacagcccctgccccttgcccagtgcaggcctccagactgcagggaactgggctttgatgagccagagcacagccagggtgccctggggtggggccagtctgggattcttttctgtttttctttttgagacaaggtctcactctgtcactcaggctggagtgcagtggtgcgatcaaggcttacagcagcctcaacctcctgggctcaagcaatcctcccaccttagcctcccaagtagctgggactataggcatgcgacactacacccggctaatttttgtatttttatgtagagatgaggtttcaccatgttgcccaggctggcagtctggggttcttgaaagctgcttaatcataacactgtttcttcaaatgagaatgcacacagaagcccactatagaaaagcagacagccaacccgtgttgagagccctgaaaatcgttggctgcacgaacctttccccactggacagatggaaatggacccgtggggcaatactgccccaactctctcagcccagggctctcccggccgtatcagcttaatcagtgccagaggcatccagcctgcatggagctgcctccagaaggccccaccagcaggcagtctcagggcagcgtcaaggctgcacacttctgctaaaaaaataactgaggtggaaaaaccataacacggccaccagcttagctggcaggctgcagcccggctccgtagctcgcaacttgttaggaaagagtccccaggccgtggggacgagagcaacaggcagggggcgaggcttacattgtcgttctgaaaggagtggaggaagttccctcctagctcgccgtcatctcgaggggtgcctggaggattgctaatgccacttatgttgttaggagaattctgtggaaagaggagaggaggtgagcacctgtgtccccaacaacctgcccacacagatggggcgccgccagggagaccgagtgcacactcacttttggaagtccgtctatgtcgcctgaccctggaaagaaaaaataatccaattcagtttcttgcttgctcttccacggaggggtctcccctcgtcctgggctcctcgggcctctaagcccttccatcccagtcccacactgtgcggagggctttctgtgcggcatccctctcaggatcgtcctgtgtgcccagccaaggccggccagggctctgtaccaagcccagctgagccaggagctgaggcacagagctggctgcccaggcagggtggggcatggcgagggcaggggccactcacctaatgatccattcatgtggtgtggctccatgccacccatgccgcccatcggaccgtccgagccgggacccatcgggaactggggaagaagcacagggcatggcagctcagcgggccctggccctctgcacccctcacaggcagggggctgcagccacgcttgagtcctggccctggggaacccctgctccggcaggctctgctcacactcggacatgtcctgcctggcagctgggccagggtcctcacctcggccctctaagctgcagggcagaggtgctcattccaatgacccaggtgagggagagggactggcccactgccacccaactccacacagaggcacctctgaaactgagcctctcggatcccaccacagggccctctccatcccccgtgtggagagtgtggttccccagacagaggcacatgtggacagctctccgaccatgtcaggccagggaccaaaacatctgtgcttctcatccccacttcacaggtgaggaaacagaagcagtgagaggaaacgctttgcttgaggtcccagaggctggaggtggaggagctgggactggaacctggcagcaggcctggagctgtcatgctggccctctcccaagttaacaaaaggaagaaattagaaatgaagatgtttcctggggctgggcggtgagaagaggtggggtttgatgagtggtggggaagagagagctagggcactggccctggaggcactgcatggcaccctgggactgtggggtggtggcaggaggtcactgatgaggctcccatgcagaactgttggtgtggcagatgagggcttggagataagagtcgattctacccacccacaagcctatctggaactatcaaacccttctcggaaaggaagaccagaaaggtcacatcccacagccacgagtcacggggctggggaggggcggctgagcccagcctggagcgccaaggccctgtgatgcagactgcatctgcatcgagtgggaagggagtggaggtggtggaatggagggctgtttggcacctggccgggactgggtgccacagacgcagagctgagtcacacctgagccccagcccagaggagcagctcacggatacccaactaccccacaggaggacagagatgctgacttccaaagacagctgcaaagtacagctgcggcttcagagcaaggcagagaaatcagaaccggctgcctggaggaggaagagagcatcaacaaaattgaggggtaaaatctgggcaggcagagcccatcgcggaaatcactctaaggcaggggtcccacatgagcagaaggctaccaagtgggtggcagcatggcgtgccagagcacagaaaggggtgtaaggggtaaggctgtgaccaggctgcaggggcacagctagggtatgagctgcttccccgtgcccacccagactgggggaggggtggcgcatccttgcctctccagtgggccccccaccaaagcagctcacaggcttttgggcacattttgccatctagcaaccaatttcatgcttattaacctaagtgataggaggatgaaagtaaccagctttctagggagccaacccaggacacagccatgccagacccccaaaatccccaaacatgataatacagatttatgcacatgtatgtcattaccttaacatgaatatgtcgctactttaacatcaatgtattaagaaacaagtatttcttcaaaatgacatattattgtatactttctgtatattaagttttattgagatataattcacagagcatataactgacccatttaagtacaattcagtggttttcagtatatttacagggttgtgcaaccatcaccacaaccaattttgaacgtttccataacctcagaaagaaatcctgtacccgactgcagtcatttctgtcctcctccaacgcccccggccccaggcaaacactaatctactttctgtccatggatttgcctatcctggacatgtcatatacatagaatcacgtgagcttttgtggctggtttctttcacttagcatgttttcaaggttcatcagtgttgtcacatcaatcagtactttattccttcctatggtcaaaaagtagtccaccgtatggatataccacatttcatttatccattcatcagcagaaggaacgttcaggttattttcactgtctgactattatgactaatgacactgatgtaatgacactcatgtctgccgtgtggacatacgttttcatttctcttgggcagatacctaggaggagaactgctgggtcatagggtaacccaattaccatatcacagcagacatcactaggctgtctgatctttcgaggaaacgtcaaactgtttaacaaagcagctgtgccattttacattcccacgagcagtgtctgagagttccaatgcttccacaccctcgccaacaccagtcattatcttttttactacagccgtcctagtgggtgtgaagtgccatctcactgtggttttgatttgcatttcctaatgactaacgatgctgagcatcttctcatgtgcttactggctatttgtaatttttggagaaatgtccatttagatccttgtcccatttttaaattgggttattactgagtttttctaagagttctttatgtattttgaattcaagtcccttatcagacacatgatttattttctccattctgtggtttgtctttttacttccttgatggtgtcctttgaagcacaaatcttaatctccgatgaagtccagtttgtctacttttttcttttgctacttgtgcttttggtcttgcatctaagaaggctttgcttaactcaggtcatgaagatttactcctgtatttacttcaagtgttttgtagtttcagctctaacatttagatctatggtctactttgttttattttttattattttttaatttatttttgagacgggttctcactctgtcggccaggctggagtgcagtggcgtgatcttggctcactgcaacctccgcctcctgggttcaagcgattctcatgcgtcagcctcccaggtagctgggactacaggtgcgcgccaccacacctggctaattttgtatttttagtagagacagggtttcaccacattggccaagctggtctcaaactcctgacctcaaatgatccacctgtttcggcctcccaaagtgctaggattataggtgtgagccaccatgcccggccccctatgatctactttaacttttgtgtactgctgtaaggacacagttcaatctcatttgtccacatgtggatattcagttgtctcagcatcatttattctgtattatttacttttccattagattaatgctattatgtaaacaacaataggaactgttaacagcggcaattagtagcaattaggaggtggactagttaaatgattgatatgtatgaggaaaaatattaatatttttataacgtttctgtcctctgatacagaaataactttttgctcgaatacttaaatttgataggctatattacattaattattttttagagatgaggtcttgctctgtcacccaagctagagtgcactcaagtgatccacctgcctcagcctcctgaatagctgggactacaggctcgagccactgcacctggcttattatttatgtttttttaaaataaaacataggccaagcatggtggctcgcacctgtaatccctttgggaggctgaggcaggaggatcacctgagcccaggagtgcaaaaacaacctgggcaacatagtgagacctcatctctacatcaacaaataaattaggggccctctccctctccccacggtctccctctctttccacggtctccctctcatgcggagccgaagctggactgtactgctgccatctcagctcactgcaacctccctgcctgattctcctgcctcagcctgccgagtgcctgcgattgcaggcacgcgccgccacgcctgactggttttggtggagacggggtttcgctgtgttggccgggccgtctccagcccctaaccgcgagtgatccgccagccttggcctcccgaggtgccgggattgcagacggagtctcgttcactcagtgctcaacggtgcccaggctggagtgcagtggcgtgatctcggctcgctacaacctccacctcccagccgcctgccttggcctcccaaagtgccgagattgcagcctctgcccggccgccacccgtctgggaagtgaggagtgtctctgcctggccacccatcgtctgggatgtgaggagcccctctgcctggctgcccactctggaaagtgaggagcgtctccgcccggccgccatcccatctaggaagtgaggagcgcctcttcccggccgccatcacatctaggaagtgaggagcgtctctgcccggccacccatcgtctgagatgtggggagcgcctctgccccgctgccccatctgggatgtgaggagcgcctctgcccggccgcgaccccatctgggatgtgaggagcgcctctgcccggccgcgaccccgtctgggaggtgaggagcgtctctgcccggccgccccgtctgagaagtgaggagcccctctgcccggcagctgccccgtctgagaagtgaggagcctctccgcccggcagccaccccatctgggaagtgaggagcgtctccggctggcagccacaccgtctgggagggaggtggggggtcagccccccgcccggccagccgccccgtccgggagggaggtggggggggtaagccccccgcccggccagccgccccgtcggggagggaggtgggggggtcagccccctgcccggccagccgccccgtccgggaggtgaggggcgcctctgcccggccgcccctactgggaagtgaggagcccctctgcccggccagccgccccgtctgggagggaggtgggggggtcagccccccgcccagccagctgccccgtccgggagggaggtgggggggtcagccccctgcccggccagccgccctgtccgggaggtgaggggcgcctctgcccggccaccaccccgtctgggaggtgtgcccaacagctcactgagaacgggccaggatgacaatggcggctttgtggaatagaaaggcgggaaaggtggggaaaagattgagaaatcggatggttgccgtgtctgtgtagaaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcgtcaccactccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaataaataaaaataaaaaataaaaaataaattaggggcaacatagtgagacctcatctctacaacaacaaataaaattagccgggtgtggtggcacgtgcctgtagtcccagctactcaggaagctgtggtgggaggaatcccttcagccccagatgctgaagctgcagtgagccatgactgtgacactgccctctagactgggtgacagacaccctatctctaaacagacaaacaaacaaacataataggattaatgaaacaaacattactaatatttaaataaaaaataacaatgtttctttctgccctaggatacattagaacattctgctctgctttctttcccactggtctctgaattgcctgaagcctttatagcctttaggacatcctttttataaaagaaaaaaaaaaaaagagatggagtctggctctgtcatccaggctggagtgcagtggcatgatcatggctcactgcagccttaaattcctaagctcaaacaatcctcccgcttcagcctcccgagtagctgactacaggcatacaccactgtacccagcttagaacacctttcttttaaatgcactggtaaaacggaatatagtcaaacttaaaatccatttgacttgtcactctgtttattcaaagcccatgttacactgactcctagtgtcacctaacacggtaccaccaaactaaatatcctctccacacaacccttatacacaaagtacctccggttttacttataagcacaggttttgggacttgtaggaattcacgtccatctctccaaagatgtccatccatttttgtccaggggctggctttggaggaccagctgcttgtcaatcaggcctttgcatctgtaattcatcagatgggctatccctgtctaagatgtccagttttttttttttttttttttttttttgagacagagtctcactctgctgcccaggctggagtgcaatggcacgatctctgctcactgcaacctccacctcccaggttcaagcgattctcctgactcagcctcctgagtagctgggactataggcgtgtaccaccatgcccggctgatttttttttttttttttttttttttgagatggagtctcactctgtcacccaggctggagcgcagcgttgcaatctcagctcactgcaacctccgcctcccgggttcaagcaattctgcctcagcctcctgagtagctgggattacaggcaccagccaccacgcctggctaattttcgtatttttagtagagacggggtttcaccatgttggtcaggctggaactcctgacctcaagtgatcctctcacctcggcctcccaacgtgctcggattacaggcatgagccaccgtgcccggccagatgtccatcattttttaacactccaaagcacaatggatgttataaattaaaattgttataaaaaatgattttaaagcacagaggtaatctgaagttgcaaaatccaagttggattccaaatatgttatagttttaatgaagaaattgataaagtcctgtttaacttgactgccttttctggtgacattttttgagttctcaagcattaaatgggtcattattcctgctgtatgaggttttgtggccccctctccaatccaagtgtggctggctagccccatctaggctcctcggggctccttaaggagcatcagagagtactggcaaaacagtatatacatttctattttatttttaatgtgtttatgtattttttttttctttgaaacggagtctcattctgtcacccaggctggagtgcagtggtgtgatctcggctcactgcaacctccacctcccaggctcaagcgattctcctgcctcagcctcccgagtggctgggactacagacatgtaccaccacacctagctaatgtttgtattttttagtagatatggtgttttactatgtttgccaggctggtctttaactcccgacggaccccaagtgatctgatcacctcggcctcctaaagtgctgggattacaggtgtgagtcaccgcgcccagcctatgtattttttatttttatttttttgttgcagagatggtgaggatgtcttgctttgttacccaggttggtcttgaatttgtggctttaagtgatcctcccaccttggcctcccaaagtgctcgggttacaggcgtaagccaacgtgcctggcctgtattttattgtaattcctttttccattctcatctcaatgcatttccaaattagagaaggacatccttcttgtctcacactttaaaaaatagcagttttcatggcaagccaacattttaacatcttttctatggccagcaatgatagtcatcttgtggaaacgtgtctgaggcattctcctgtctataaagtcaaagatctcattaagtgctttggcatgttttgaggaaaccgaaaggtgacccaaaactttcattatgaaagctggtatcacaggtaagcaaattacacccctttgtgacagtgtcgggtacgaggtgtgaacatttagcaggtaagatgttttcattttcattggtaagaagcttatggactaaatgaaatttgctcaaattaactgtgtactgtctgccaaatatgtagataaatgagcaaagtctaggttgtatttggacaagagaacaacaatctcttacgtcttcagtggcttcactaaaatcttcacagaaatcgagaagacgatctgaaactccagttttcaaatcaacatacctaagagctagcggaaacctgtagccatgacttcaggcagcccttgacgcactcggaagcacgaatgctggaaggatcagacagggtcagcactactgtaaaggggcaatgcatctgttactgaaagtccctcgtcctttggttcacacacaggacttttagtttgtaacctccgaatcaggaaatgtaaccttcttggtttgcggtgcaatcaagggaacaagatgataatggcgtccattcaaggagtgcgcccaagctaattctgcgaccactgtttttgactgagaactgctgtctctttggaggtcaaaaaaaccttgatttagaaagatatgcctcagacttgagagactcaatgtccaatgtgcctccacctccccttctccatatgccatttctcacattcttttctgcacaccgcgcagtacattctgtttgggttctttcctccctaatccagttgtgtgtgtccttgcatctgtcattaaagtaacatggtcatttaaccttctttcccagtgatgcctgggtcacgctggtgctgtcattgtcaccgttctcattttcatcatctgaactcttaggaaatacagtcacaatattcatgatgtcaagactgaaaccagcaccgtctagacaaaaagcccaacactgaatctgcagcagactcctaggcaagtgctgctaacatgcatgactgcagcgtgcggagttgcagcctgagtgatgtgatccatggtgaatcacaagtcctgatgccagcatccacgtcaggcaacatggcgacagtgaccactcgaggcagatcatccacgccatttccatccgatgctacaaatggtgctgtcatccctctgtgtgggtttcatactttccacccaaccttctgcatcactgacaaaacccaggactttctgtgtcctgggattcctcaggatgtggggctttttagtgttaaaagccagatggttggtcacaccagtgaggaccctggcaacggaggcaggccagaaaccatccctcagagggctgctggatgtaggcaatatccagcacagggcagcccgcgctcggggtttaacacgtggggtgatccgggtgtcacctcaggaacggagccaacaaaaccagagtgccccaaaaggccctaccccctcaaccaggccaaagcctcgcactttagggccccaggcccactctctggctctacagtctgtagacctccttttcagaccctgagctcctggaggggcaaggctgaacaggttcacctgaggcctgcatggaggaggaagggaaggaactagaatggaagggttgcctgtggaggggaagcagatcaggccccgacctcgggcaacgccccctgggtgaggagacaggctgcagctgactaaccaagtcccatccagtgggtgcaggggacacaggaggaagtggggcaagcagtaatcagaaatggggaaatgtgagctgcaacatcacccaagggctgcaactctgagaggcaaagaagctgccaggtattgggagttccagagctcctggcagcagcacaggcaggcgggtcccccagcgagccctgtccccttgctgctggctccaccctcaactccatagccccagaaacagacccaggaggagagggattgcccgggccacagccagtttgctgggcagagaccaggccagaccccacctacagcatggcgcttcccccaccagcacggcaggaggtggcaagtcccagcagcacagcgggcaccctggctctaaccagagggtgggcatcgtcccaccccttcctctcccaccccctgccgcccatgaaatgggaactgagttgcccaagagttaatcacttttctgacggtttattttattcatctttggtaacaaatggctgaaatcaattaaacttgctttcccctcagctgatgaagttaattatgatttgttatggtgtctgatatgtaaattattagaaagcagacttacgttggaccggctgcctccaggcggcactggattaatcattgtgtagatgttgtcactggaatttgttgaatctgtagaacagtggaaacccacaagtcggggtgattaattcgtttcttaattaaaacaaactcatggcactggaactcattcttttgtattttataacctaaaatttcctctaagtaccaccattttctggctaatttgtatttaatgaagattcacaaagtttttaatcacagaaaattcaactgtgaaaaccactcaaccccagcagtgtggacacggcacagggggattacgggttcaaattcttgtctccccaccccacaccgaatctggtccccagacactgcctgggacaacatgggggcagcagaaccaccacctgtgctctcctcccaccacctgtgctctcccaccaccctacaaagtggttttaatcaaatcagggaaagggaaacgtggcaaattacccagaggccaccctgccaggctgatggggcaggagggagaggcagggatggggctggaaacgcattcacatatggagtgggtgcatgtggcccagtcggaatgtaggtcatgcagctcatcaaaatgcagcagcagaaagagagagccggagtgggagcccaggatcccggctgcggccagctccacccctgcagctgagcagcttccctgctatggggagccgaggagggggcgggggagagtcccctccatctccccagttagccaaaaaagtctccagctaaaacgtttctatcaggagcaggcgctgtaattcttgggcagaaatccagctacctctcactttttatttttggggtgggtaaggatcgtatgttgaattccttctagctggctggtatgctattcttagctgggaaagaaacataattgtgatggggtgtgtgtgtgtgtgtgtgtgtgtgtgtgtgtgtgtgtgtgcgcgcgcgcgcgtgtgcgtgcgcgcgcgcgcgcaacacatgcccacgtatgtgcacgcatgccctcttttgtttaaagaaacagggagggctgggtgtggtggctcatgcctgtaatcccagcactttgggaggctgaggcgggtggatcacctgaggtcaggagttcaaggccagcctgggtacatggtgaaaccccatctctactaaaaatacaaaaattagccgggcatggtggtgcgtgcctgtaatcccagctacttgggaggctgagacaggagaatcgcttgagcctgggaggtggagattgcagtgagctgagattacgccattgcactccagcctgggtgacagcaagattctacctcaaaaaagaaaaaaaaaagggggggggggcgggggggagaagggatctcctatatagaggaccagaagccaggagctacggaaactccaaaggtagcatgcctcagaatcctggtcccaggatggcagaaccccaaggcccctttttgagtcatttggggaaatgcccaccctgaacagggttcttcccaacaaaagggattcaaaggcaacgagaatccctgttcctggactgctctgctcagccctgtcctttatggagcagcatcagaggagtaggttagtgtcatcaagggaccccctgccctctaaatgcccagtggaagatgtgctgcccaggaaggagtggctggtaagctctggctctgcaacagtgcccctccaggtctctctggcaacatgccccaccctccaccaccagaccccccactttcccctcaagcgctcttacctgcgggactgggcataatgggtgttcctggaggaccgccaccaccagggggtccctaaagatgagacaaaactgacatcagacacccacggtggtaacgaacatggggaggggccggcatcctccctccctggtcagcagcaactgctcgccccaggcccagccgctattcatcttgctacacccccagcgctcactcaaagtactcaagcttgagaaggggacctggatgtcccctgtccctttcttcagaccaagcggcccctgtgggtgtgtgtgcctgcattatgtgctcacaggcatgcccactagagaggcctgcggtggacgccaagcagcccactggtcagctccccagaaggcaattccacccccaggtctggtttggggatttctgggccaccttgggtctgtacagatgactgaatattgacagcaagttctagcagtttggaacctctgctcagaagaatgtgtgaaagggaaagaaacggggaccccagaccagttctcttgcacactcagtcccacgtggctagacatgcaatgccccaaacccacacacttaccacataggtaccaggtgatgaggaggagtatggaatctaaaaacaagatgtcagggagccccacgtcagagtcactgagtgccctcagctgccaaacctccctgaggacacgacccactcttcacaggaaaggcatcgccacccagtgagctggccacccacttggttcccctgggagggctgggacgtggctgaagcccagttctctctgctacattgaactgaccctgagaccctggtctcttactccccagtcctgggagggagccacagacacagggaggacatagaaggccctccggtttgagagggcaggaaacagctttaccccacattcctctggccttcaccccactgtctgtgtggagcaccttacccgcaccttccagccctgctggggaggagatgggtagaggtctccactctgaacagtgctctctgagcccaggttctcagcttactccttagaggagtgggctggctgggcaggcagggcaggggtggagcccttgatgacccctgcacattactcccaggcctccacctccacacggccttctccctagaagcatcaggagagtcctgctgcatctcccacttcccgtgacacctacacccagggacagtagctcccctgcacccagaaccgctcccctgacaaacaccaccccacccgacccaggtactcactgagttagcactgttaggattgggccagggtctgccagctcccgggcccctgagagagggagaaagagatgtggacaatgaaaaaggcgctgtaaactccaagcggtggaggcagcaggggcagaaggaaagggctgaaatcacaacaggaagtccttcctacagccctgcggtttagagccttctggctcagggcagtaatgggtaacttcatgggtggaaatctatgaattgctttaaattataggtaaactttacaaagtatataaaattagataaaaaatatgtgaaattccctttgcatgtgcattttcctaggaagggagtccacattctcacaacagggttaaaaatcacaaatgcactagagaacagtggctacactgtccagaggttcaactcttgaccctgccactgaaagctgtgtgagcctgggcaagttacttcacctctctgtgccttggtgacctcatctgtaagggggttataataataaccgcgtcaggccgggcacggtggctcacacctgtaatcctagcactgtgggaggctgaggcgggcagatcatttgaggtcaggagttcgagaccaccctggccaacatggtgaaaccccgtctctactaaaaatacaaaaattggccaggcatgttggcgggagcctgtaacaccagctactcaggaggctgaggcaggagaatcgcttgaacccgggaggcggagattgcagtaagccaagattgtgccactgtactccagcctggacaacagaatgtgactctgtctcaaaaaaaataaaaataaaaataaaaatcatcgcgtcatagggtaatcatgaagatgaggtgagctgatgcacgcagcatgcctgaaccgtgcccggcacacagaggcactctatgaggctgagctctcatcaccaggatcatcaatatcctcacattaccgatgaggagactgaggtccagagaggtaccagcaatgaccccttatcatgagtctcccagggtgctggcagagggtgggggaagacctggactctgagccacgggccgggtcgtttttgccttacatgttaatcccgggcatggcggggccgagggagttgggtggtggtctcatgccgctgccgtaattctgcaacgataaccaagggtcagtctatgagaagaagggaaccggagacaggaggagggaggagaaacaaacagacaaaacatagtgagagggttagtctgtgaaaaggattgatgagaaaaaataatacattctttcaaaaacggtggggcgggtgggaaccaagtcacagggaccacaatgacaagccagcacagagggacagtcacaacattcagtgcattttcaggagctttcaagatgaagttctcaaaaacatgtggctatccagcaagccgctgccctctctgggctcccatgatgtcatcctgtaccttccccctgggctcaggcgggtaagaggggatggacttggtcttggaacccattgagaggctctgaggtgaggaggcagggaggcgaggggtgagtgtcaatgtggatgggagcaggcactcctgagaagcctgcccgaggctggtgcaggcccaggcctggcacatacagacacgccaacctgccccaggtccaggtggtagtcctaccccacccatgtgtcagcatcagaggccctccacagacatgatgctgggaagccggagaaaactccatttctgcactcagggatcatcactatgtgtgtgtgagtttttttttgttttgtttgttgagatagcgtcttgctctgttgcctaggctagagtgcagtagtgcaatcataactcactgcagccttgacctcctgggctcaagcaatcctcccacctgagcctctcatgtagttgggactacagtcatgcaccaccatgcccaactaattttcgatgatttttttttttttggagatgaagtctcactcttgttgcccaggcaggagagcagtggcatgatctcggttcactgcaacctccacctcccaggttcaagcgattctcattactcagcctcccaagtagctgggattataggcgcccacgaccatgtcgggctgatatttgtatttttagtagagacggggtttcaccatgttggccaggctggtctcgaactccttacctcaggatccacccaccttggcctcccaaagtgctgggattacaggtgtgagccaccgcacccagcctgcccagctaatttttaaatttttttgtagagatggggtctcccttcattgcccaggctggtctcgaactcctgggctcaagtgatcctcccacttcagcctccgaaagtatcaggattacaggcgtgagccactgtgcccagccaatgtttgagagaaaagtctacacagaactcacgaagtcccagcagtccagattcagctcaggacggcccactgaggcacagcggggtgggtcaaggcaccaggcctcgtatcacgcgcatctcttcctatataaccaggccagtgttgctcgtgaccctctctccaagtgtcattttccctgcagtcatacatgccttgcttccctgctccctgcttggcaggctcctactcagctccaagagcagctcctctaggaagccctcctgaccccaccccttcgggctgactgctccagccctgttactcccacaatgccttctaacctccctcccccgccaccatgctacactgggtctgatcatggccacgtgtctgtccatctcccatctctcctagtggactccaagtgccctttgaaggtggggctgtgtcttgatgatcatataccccccaccccatgcacccagtggcacagactggcactcactacgctggcactgaagcaatcaatgaaagaccgaagaagggaatgcatgaagaccaaagggagcctggctgcagcttaagctctgcccttgtaggagaacttgaagtaggttgctggaattttgatggcaaaggaacagccagcattcactgccctttactgagtgcatgacacactttatgtacagtctcttgtttgatctgtgtgaaaactccaggaggctgggattgttcccacttcagtctcccagaaaaggagactgaaggtctgagggagaaagttttgcctcaagttgcagtgagcaaatggacagctaggatttaagcctggatctgccggccccccagattctgtatgcttagccaagaaactggcgggaggcgggtgggaagggggacagaatgggaagatggagacctggagcctgacacacacagagccaatattgggctgatagtgggttctgcatccagggatcatcttccaaatctcaccaccctggggccacctgctccgcttgctcagccacagagaggcttggagtctggaaggatgtccagacaggatgcagatgatctcaggagcaacaccaggctggctgacaaagagccagacccggagccagagaaggcaggccccgcctcaccctgtggctgctcagggcatgggcttcaagcaaacagtggcagccttgtgggaatgtgctggggccaagcccactctaccacagggtgaagagcagaactcgagacctgaggtcagaacacaggaaggctggccttggcttggctgcctgctggtgactttgggcaaattaccaaatgacaatagtgcttattccatgcccacatgtaccacagactgtgtgtgcactgcctacaataaatcgtcacaatgacccctttcctccacccactttagagaccagaaaactgaggtagagaggaagaatgaccccactgtgcagttgtgcgtggctgagctggggtgaagccctgcagcatggctctggctttagacccacaatcccctctgctgtgctgccttgtctataaaatggggacaaagagccccatgtgtttccaaccttgcaggtctccagtggatcaaatgaaacaatggttctgaagtgccccgtaagccctaggaggtgtgcactgatttgggacgtcagcagcagaacaaacaccaaagcccttaatgctaccgcagcattgcagaagcttgggtctcaaagggccctttctaatcccctctacaaatctcagcctcatctccccacctgctgctccaggacaagcagcttgccacctccccaggcctattctccactgtgtgtacagcccagctgactagagaggtcttccagatggagttcttttccaggactgcagccgcctctcccatccaagagaaaggcctgcatctcagaacaagagcagaagcctggtatgtctcagcacggagtggggtgagaggagatgataagcaggtgctcactccatagagccctcttgacatgcagtacgcagcgctgagctgggaggctccaagtgcactatcctgccgctcctgaccctgcctggccttcaggagcctctccaagaaccggcatggcagcttcctagagggagcttctccaccagtcctgccgcctatagaggcacagaccctggagagccacttgcacctcatcatttcatagatgacaacttgaaggcccagaaagccagagacatgcccaaggccacacagatgtcaggagcgagtagcaggctgaaatctggtttgcagcgaagttttctcacatagggcaggaatgcccagaagttcagactcagtagaaacgggttccctctttggccagctcctgcctgcctgcctgcagcaccacgtggctggaggtgatgacggtgaagctgtacaagggtcggttaccaaccaggtatccctctgccactggcaccgctctgcaggggcagggacagctgggcagagagcaggagcctccagtgcagccgtggggctggccacattcacaggggccactgtctcagctttgcactccgccaggtccacagtgagaagggaccgagcagctgtctggggctgcagcctggaggcggtggctgctgctccctcctgccacatcctcagaagggctttctaggtgcccactgtttaaacctggatctgctggcccccagagtctgcattcttagccaagcatcttgcaggaggcaggtgggaagggaatacacacagtgctgtatttcccttaggggatagctctcctagtctttaggactcacctaccagagtggatttgaggctgtcccagccattttctgggcagcaggggcctggccatctcatgcaggaccaccagagaaagttcctcaaggggcccttttccttcctcaccagctcggggtgctcaggaccaggattaatgacccacccatctcttttgggggcctctgctcagtggcactgagcttggactggccctggatcagccccaggagatgggggtggcataggattgtcccaggggctgtggattctccttcatctgaactctcaaatgcagacaaaccaggataatgacctgattctactctgtcctggctccagccccagcctgaataccagaaacaacaacaagtcggtggctctcagaattggcaccccggggtctgggagccaccgcacttctggtgggggctggcattctctctactaagtccaaccaggagcccctcagttttagcttcgtcctattagaattcacttttgaaacactaggataagacgttactacctgatactgacatacataaaactttttagaaagaagagttctaagtggaagtactatctcctttctggcactggcactttacaaaaccagagtaaaatctgtctgaagcactgatgacaaaggacagggtgatacctgcgttgctggttcctgtgagacatttaggctgacatgtgacacagactcacaaaatgcaatgtcactcccttcggttttgaaataaagtagccctatgaccgaccacgctgtacctattctttgttcagaaagttctggagtggtcactggctaaaagcaatctaattcccggctgtgaatcacatgccgatggtctcccacctttgagcctggtctcagcacagcactgtgtgtgttgtggtgcttactttatgctgaaggggctggccgcccttcctgacagcccgggctgtggcagtaggcagggctccctcccacaagctcagggcctgcgggaaggggaagggatccacaggacaccatgtggggacttcaagtaacatttcacagctgctatttcgcccaccctccagtagccccatgaggccatcacttgctgcccgttttgcagatgacagactggaggcccagccaggctgagctgctgtcaggactgtgctttccagaactaagttctgggcttgtccctgtcctgtccacagggcatcatcctcaggggagagacagaaatggcctagggaacagggagagtctgccctctccctaccctccacctcagagtcccaaaccaccaggctctgccgggcccaagatgagcccgtaggtgaccacagaccctgtaatccatcctgcaccatcaaccttgtctgggcccagtgctacatcaatgccaggctttcctgaccccagtgatgggccagtgcagacaccctgggtttcttcaagggacgtttggctctgggatttaatactcaccctacccagaggagtataggaaacatgggtgaagcactttagggtctccacattgataaagtaaaataaagagcaggagatatgcttccagagttcctgaggttggcaagggtgtgtaacataaataaagacgggtgagcctctctccctcccgctggagacactcctagggtctaaggggagctctaccccttgtacactgcttgggtgaggccaggagagtctcactgcagggcctcagccgctgggaccctcacttctttaaagtgtgccaaagagtgtgctggactacgggtcaggggcagacatgatgagacatccaccacacccagaggaagtcctgaactgccagcacaccctgctgctctcaaatagcctgacatctgttcccagcctttagaatctcagtgttacgatggtcctaacaaactgttaatgactttgccagaaaaagagaaagaagaagaaattaaaagcaatcaccaaacccaagcaactagaggtcttaacattggttttcagtccctaaagttggaaaacacaaatagcctccttagcgggagcaccctgtggccagcatcacattgagaacttgacctggccaggcacggtggctcacgcctataatcccagcactttgggaggctgaggtcgggggatcacttgagcccaggagttcaagaccagtctgggcaacatggcaagaccctgtctctactaaaaatacaaaaattagccaggcgtggtggtgggagcctgtagtcccagctacttgggagactgaggatgtggtgagcagagatgatgccactgcactccagcctgggtgacagagtaaaccctcaaaaaaataaaataaagaataaaaaacaataaaactttttttattttttaaaaaatttaaaaaaacttttaataaaaaatattttaacttttaaaaaataaaaataaaatttgattcctgttaaaagaaaaaaaaaaagggaactggacactggaccctgccccttccaacagccctccaggtcaggcacagttcttattcccattttacagatgcagccgctgagcctctgaggatccatgggctgggcggtggcattcgattttccctcctcagattccatcctcctgagtcacacagatcccatgacatctgacaatccaaggccactgctgatttctacaccaataaaatgtgactgctgtgtggcttaggctgtggggagggagagctgtatctgactcaggagaggggaagctccgctcctactctgccccttgcccccttccctaggcaggcagccctgcagaggtcagctccaggcggctgccaggcaggaaggggccactctggcagcttaaaaggagctagcagaaacgcgaactttggaggatttgaggaaggaacacaaccagaatattggagctgcaactgctgtgggcttgcttccttttaggattatggggctggcagaagacaaggacctccctaaaatctttcaacaccacagatgttccaaccaccacagagaagaaagcggtggcttgggcttgctgtaaatacaattctgggatggagcagagggctgtggttctgtggggcggattctgggatggagcagagggctgtggttctgtggggcggattctgggatggagcagagggctgtggttctgtggggcagacgcctctccctacaaaagggagcacgtgtgggcgggaatgggggggggcactactccaccctcaggggacccagaaaccagtgcagggggcccagagcctgaacacctgcacgcaaccaagggagtgaccagtgcagcagactccaggcagaacagaaaagaagggaaagaacacctgagaacaagccccttgccttattcagacttccagcttcctttagttaggggctagagaattcccaaggtggaacatcgcgaacgctctgccacggctactataggaaacagaaccacgtgcaaacacccagagggctgggggtaagcagtgagatggttccacagcagaacacctgtcagcgccaacacctgttgcttggacacccctacctgggggagcagagctggccacgaggggcaacgactttgttgtgaccgtaagaggtatgtgagggcacctgaaatgctttcttccaatggcttataaactgccctttgtggcagcggagccctctggtcaaagaatcccggctgaagtgggtgctggggtcctgccagcgtggccccctcccaccagagaatcgcggacacagtcctcatttaacaggtggggaaactgaggcctgctggggcccacagaggtcaaagtgattcatccaaggacagacacatgctaagtcgcaggcagagctaggaaggccactcatctgcgccgcctctgggacacaaccgatggtggccctaagccatctcaagtctacctcacccaggggaggcagctctggggttcaggagctccctgcccttcttcagaccccatgataggctaccgcaccccaaaagggtctgccaactagaaggcctcagctgtcccctttttcctagctccctggtgggggccctcaactctgcctgccatctgcaaggggctgccctgggcagcgcgtgaagccagcctgccacaggaagcggacaggagcaggggatgcggccatgcccttcctctcacccctgcgaactgagagatgtgggagactgacagagcatggaaacaggagagaaggcgggtgcacacagatggccagggagacggacggacagacaggcggtggttacctgtgggccgggacccatgggccccatgcctcggggagggttcattctctgcattgatcctcccatgttggggtggcctgcgtgagagaggaggcgcgtcatgggatggcaggagtggagggaggaggagcccctcctggcatccccagccaccctaggcccaccctgccctctctaccttgttgtcgtgtgggatccatagaattgggcagcaatggctgtgtcccaggaactcctcccggaggctgaaagagatgcaagacacaagctgaggagctgctccggagctgctggccatggggacaggcatctacctgtcccacccagtgccccgtgtgatcacgtggagccactcatggcctccctgagacttctgctgcctgccagtgggagaaggttaccccgggcctaccagtcagctggaagtggtgttagctataactgtggcgttgttttgggggctctgtgggagggaaaccaccgcctcatcctgctgtcttggggtagggggtctgtgtacctatcagagctctgaagtgaggcaggagaccaagttctctaggtcttgctctggctgtagcaccaaccaccttcctctcagaggcagcagtgcccactccctccttctgcccaaaccccatcttgcctttgtctcacagacacatacctcattttagctctacttccaaattacggggactgagacacccactacctaaaatcctatcgctgtgggaagccccatttaaaggggaaaagaggatgaggaggcttttaggattgagatggggaaactgaggtcacaggcctgcgggctcccagtcacaggttgcagagccaagtgagcacccaggtcacatcccatcagcttctacaataggaaatgccacccagccccggggcgggacaggtggccactaggagagggacaggtggccactaggagaggggcaggggtactagacgagaacccggctccagagctggggccatcggcggtgctggtgtggttactaatgagaaggtaaacacgggggccacgggtttcctgggtgaacacttgccccacccgctgtgaaaccctatgaaaagcaatttacttgagactgaagttatttcagctgcaactggaaaaagagagtaggagttgctggggggaagtttgcttctaggacctcatcccttagggctttataaatatgagcttttgccttcgagaggaaaagccttttggctggtcatctttcctcatctgcaggtgtcagtgctgatcaaaggctgggcatctgtgacaggggtctgtcctcaagggcccccagcccaggctgtgctgctgtgggggaggctgagtggggagctctcctgccttgagctcaatagtgaacttcaaaccggttttggaacgaggtggtggaaagcgaagggacagactgttcactgatttccctagcttcagaatggaacaggggagcgggtatgtgtggttaaggtacgagaggattgtgtgagggcatagggagtatctgatgttcacgaagtagaattggtatttgtttttgttttttttttagtttttgtttttttttttttttaagacagggtcgcttgctctgttgcccaggttggaatgcagtagtgtgatcacagctcactgcagcctcgaactcccaggttcaagcaatcctcctgcctcagccatcccaagagctgggactacaggcacgcgctgtcacacccggctaatttttaaattttttgtattgatggggtctcactatgttgcctgggctcgtatcaaactcctaggctcaagtgatcctcctgcctcagcctcccaaaatgctgggattacaggtgtgagcctccgcacctggcctacaaagtggcatttagcacctgctgtttccgtctgcctgggggtgctcagcgtctgtctttccaatccctggatttttagttgttccggcctctcactttctcccagccctgcttcctggccccaggttccctagctctgaatcacttggctggtttgcgtctgcccactgggggtttgtggtttttatagagtcctggtgactcaggaaggcctgcctctaaggctgtctggactgggggatcccaggacatggaggtggatgggggaccttcagggtcatgagtcacccagtgcaggaccaccccatccaacccagacagtgcagccatggggcttggcagtcactctctccaggtagcccaatgctgaccaccaattcttggagaaagctcctccttggattcctctaaccctcctatgtgtcggaactccaggagcaaagctgggctgttcagaggctcagaggggacctggaggtcgcgtccctcactgaggtgaccctgagacagggacagacagtctgggcctcttctatcaggggaagaaggtgtgcaatgaccaaggaaaggggtctcaaactaagagggctgaagccctcaaacttaaggaggaaaaacaacggctcatatatgggaccataattacacgctgtgcacacacccctggggcctacaggggagcgagttgctctggggcttctggacggaggccagctcttctcctacagcactgcatgtggggcaaggcacaggaagcatctgcccaggaaacggacaaatccctgctgcatccgcatgctctctcacctgccccgccagcacagccagcctgccaggtgggacctctgccgagatgtgtgtgggagagctctctgacaaccctggattccagccactctctcctaaacccggctgaactccactgtcaccacccatccaatcacccgcacttgaaaaaacagcaactctctatgcacagcctctagccagggaggcagatgggaggcaggcctcgtaagaccctgaggccacatcactgaccctttgcttcttgtttccctaagggcccttttcactcccctcacccaaaaggcacattcataatggcctgtgagccccagcaagtcctctagtctcggctccctttacccgtcacaggagagaactgagctaactcgggtggcacagggcttctgttaactggcagacccaacgagggcactcttcaagaaagccccagggtcaatacctgtggaaggggcacatccctctttggaggatagaaatttcttgaggtcacaggaaactggaaaaccagtgtggatttctttttttatcttttttcttctttttttttgaggcggagtctcgctctgtcacccaagctggagtgcaatggcgcaatctcggctcactgcagcctccgactcctaggtcccagcgattctcctgcctcagcctcctgggtagctgggattacaggcacacgccagcatgcctggctaatttttggatttttagtagagacagggtttcaccatgttggccaggccagtctcgaactcctgatcaagtgatccacccgcctgagcctcccaaagtgctagcattataagcgtgagtcactgcgcccagccccagtgtagatttctattgcgggggggcgggggggggggtggttggcagggaggttgggaaaactggtgtgtaatacaaagtacagatgatggatttatcccccatttgctcttgagtggttgctcatgcttagttgctgagtagaaatatacacacccctctccatatcctttaattgccagaagaagggccaccacaattatgataaggaagtagctcctttcttcctggcagaggccagtttggaccaagaagagctcctgggtgggaaggctgctgctggcgcccctatgtgccacggcaaagcaggcccagcggtgatgggttaaaaacacagatgggggcaggaatcttacatctgtgaaaactgaggaaaggggtggagtagagtacaattagcactgggctggaaccaagatcaactccagcccagctcactttgggaagtcactcctccactctgaccttttgtttcctcatctgtgatgtatccagggatcccttcttttgctcaaaaagctgggtctctaattcctcttgtccaaatttgtccccttcatgtcagagaaaatagaaaatgaaggacttttggagagaaaaaaaaacaaaataaaaaggtgggaacccgataggcaatttagcattaaagctggagagctggccaggcacggtggctcacgcctgtaatcccaacactgtgggaggccaaggcaggcagatctcatgaagtcaggagtttgagaccagctggccaacatggtgaaagcctgtctctattataaatacaaaaattagccgggcatggtggcgcacacctgtaatcccagttacttgggtggctgaggcaggagaactgcttgaacccaggaggcggacggaggttgcagtgagcagagattgcaccactgcactccagcctgggagacagagcgagactccggttaaaaaaaaaaaaaagacaattggagacccctggtaatgagcatctctccatagtccctgcatcacctcactcaggagccttcttgcagagccctgagaatgaaaagcatcacactcagacaatgctaatttagctggtgactaaactcccagttcaaaggcaacaagggctggatgtgctggcgcttctgtcagatttttttgaagggcttttgcaaagtcaccgaaataattctgttttaaaaaattggggcataaaatttccctgatgtttctcgaaaagtttcttttaagtctgtctatcctcaaaagaggcatctattcatatttacctctgcaactcctctcctgccctgaaccagggagggtggcatggggtctgatttctccagaccacctagaattgccaaccctaatgggccagcgtaaggcatatgaccccaggcaaaaatccctccccgtaatcagaccccttttctaattacacgaacaaatcctttcttgttttgagttgggtctgggaagcaggcagacattgctgaaaaactcacaaatctcctgctctgctgcatccaggctcctgatctaagcattcctacgggccatttccccccctaatagcaggattatatttaccagccttggcaattctcaaaagcttccaggaaaaaatgcacattgtcaattagcttcattaaggaggaagaccctcttccaagaagggggtagaagggaggggcagggcattaccatcttctctagaatagccgaaaccctgcaatcccagatgcgccttagctccatctgctgccaccttctgaactctggaatgggctgtccaaagggccatctggagaggcaggtgaactgccgcaccatgggcacagcggggacatggggccctctctggggaacagctagtaagctaccagccacgttaaacctgcccctccacccctcaatcctttccctcaactttcattttgtgtcaaagtccacctagggccaaggatggctgagggaggggagagagaacatgaaaaggtacagtacctggtttcccattctgatcgggggcctggggccgcctgcgtatcgcggtgacataaaaggctgcaattataggtaattagttcaatgacagcctgccctactgcacagtgacaaacacaaatgctctccactccacaaagtccagttttgttataactagtgatcttttaagttctttctcctgctagcctcttccctttgacagcaaaacttcctttgggcagagggaacaatagatccacacaacaaatgtgtctcttgactccacatttgttcgtggagatctactctgggtgggaagggcagcggctgggactttgcataagaaacgaaaaacagttaaatcaacgcagggcggaggaggaaacctctgctctcggtaagggcaaatgaaagggtaagaaggactgatacgtaacatcttaagggcctgcagacaaagctggacacacgagcacgcacacaggcacacgcacacagaaaccaccagcagggacagagaggggagcaaggactgggggggaaacgccaaggagacagcgggctccctaacttaatgcaggggaatggcaggaaagctttctcagcagcacgagtgcacaaagaaaaggctcgggatgcagcttcggttacaaacaaatggtgaaccaaactcaaaaccaaaccaaaagtgagagaggaaaaaacaaaaacgcaaaggcagctgacaaggtcacagaaatatatattttttccttttggtttcgtatccaagctgggtgtgatatccgaggactgaagactatctttagaaaaaagaaatttctaaaaaaatttaatttgtcaataaagactcgcaggcagtggctagagcacattttgatttttgtttttcctctgcgggctctctgcttcctccgcgccccgcgtccccggcgggcgggagcgccacggtgcgtttacctgactgtggggtcccatcatgctgctaggattgtgaggtggaggctgtgcgtgcggcgagggctgtgaccccggaggaccctgtgaggccagacagtagaggcaggttatagatcacagcacatggagaagcgcagaagcagcttaaaagaacaaaaattaaaccaaaacgaagggtgggcggcgggcgtgcgggggggtgggctctggttggtgggaggtggtggagctgctgctttggtcgccggctcaacggtgtaaaacggcgagcgggagcgagagaagctgataaatacattcacagggggttgaaagaacaaaaaatgaagcacctctgtcaaagcacacgggagtacagtcctggacacagcctacccttggagcggagtttgccatgttaaatacgttggttgagacgggctcagagggagtacaatgatgcacagacacagggacccaggtgcaaagcacgtaggtgccgcttgcacgggaggtggggaaagatcgggaagggccctgccctcaaggagctcacagtctgggggacagtgacacggctatgggtgactcgaggcagtactgatcaagtgtcagggagaggcccaggcgacgggtttcctgggggcaggagggccgggggcaccgacagataaacaacagaggcaagaggagcaaggggcaccacagatgtaacacacagggagtgaggggacagtgagtgagggccacacggtgtgggcagcacagactcgcacaccgtgaattcacctgcacttcaaagcagccctgtgaggcggggtttctcattccaatttttactgatgaggaatctaagtctcgagggatgaaggaacttggccatggccataaaactggtcagtggcagagctgggatgagaagccccatgggtccaaggcccatctccagccctgaaacccaagagttccggtgcagagctggggacagggggaagtgcatgaagggtggggaccccggactgctgggcgactgggtgggctatccttttcatacctcagttccaagctgacccccacccccaccgcctcaaccctgggctatgctgacctcgacccccctaccccgccccagaagacatgggcagatgaattcacttcaaccttggggttacaaactatgggtagaaactcactcagcaattcagcaagctgcaataattatctcttaaaaatccgaggtaataaaaaaaaaagtcagagagctttgtgtattttaaggcaggtgtctttcatgaaccccggttttgtgtgtaaatattcatgtgtgtgtagactgggtcacaccaccaaaggactctcctaccatgggtcacagtcagtaagcgcggagggctgcctcggaagcacgttccagcccacccagcgtgggatgctgatgccagggatgaggagacaggcctccattcgctcttccccacccatgactgtgctgttttttagaggttggtttttagaaaaattcaaaatgtgcacagggggtgagtgtggctaaattaaaaagagagaggagctgcctaggtagggtttcccccttggccttctcctgcagagccaggctgccagccgcctgcccactggggaggaggggcgtgggcccacagagaagaggtgtgcagagaacatcgcagggggctgtacaagaacccgagggcgccgccgctgtgaggcctgggagtttcttggccaagcgaggagctgctcacttccggaaagctccgaggagcagatgttcccctacctgccacgctactaatttcaacaagtgtgtgtctttctagcggctgccagcaacggcatggtttgttaccatgagcaattttcttaattaacagacattaattagccatttagcaattttgcaagcatttgtttagcggctttcccaaacatgaataccactgtgataatggcactgattagagggtcccctaattaacagtacagggaaggaaaattgaaatcacataaattaaaaagggaggggagttaatgaaggcgggacatatttgcacctgcaagtcttttgtaccacgtaacttgggtgtaatgtaaacaaaacaagataatttgaagccaacccccaaaaaaagaaatatgaaaagaacagaggaggaaggttcaagggtaaggtccagttgccaagagggggcaaaaggccttctgttggttcctcggctcttggcaagaagggagtgcctcctccctcgcgtccttcccttcctggtaactgagtgcttcctcagggcgagcagtggggctctgggcaagcccctcacacctgtgtgcccagtggtcagggagggcaggaggctggctcactgacagattagagaaaacagaagtgaagcacccaagggcgtgtggcgcacacggtggggcctcaatctacggcagcctttacaaaggaccagtgctccaaccggggtctgctgagatccagacagcaaggctggcaggtgtgcctcctctgcgcctccctcagaagcgcccctgggggactctggagaccagtccctggataagcagaggtggcacaagcttgctcttggcgcagctgcctcaagaaaaaaagctgacaagcagtaaggatggagccaggctggtcagggaggccccagcccagccccacaacctctctggctcatggggaacaagctgttaaatctggggcgggaagagcagctagaagtcttccctctgacttggagctaggggttggaatgatgaggaccaggaatcttggcccaggcctgccagtcactcagggagaaaaatgataccacattcttgacagaggccaagctaaaagctcagtgcccacctcctcagggcacagagctcctctcccacctgcagtgaagcgctgacaggctctgcctgcccacctctcggcacagagccagacgcctgccatttcccaacgggccacccacgtccacatccacagagaactcctctgtgtctctgctacctccactcagcccggagctccgtcactacgttccctgtgtctaggctgtgtccctaagaccctgtggcatcacaggaggaaccccacatagcctagcagtctcacgggcagagatccgtgtttgtggaagcatttgcttctgcaaggaacatgacagatgagctgcccatctctatgaggagtcaggggctctgctgccctgtgttttattaggccacaaaaagtgctctcgtcttccttcccagcctgcattctcaacaagagatccacaggtaggtttgaagaagacggactttgtgctcttttggatttgttacccactcgggcaaaaggctacacaggaggcagacaacaatgaaaaaggatctagattgagggctctgacctttggtgggacgggggccgctctcttccccgaactctgaacagacccagcaggcaggcagagtggactgtggtggaaggtgagaggaggagggagtctcaaagctgatgatactgatgtgcttttccatgcaggacatctctggtgaggcttccacttgctggaagcttttgaggaacccaaaatgggtgcatctggagggctgcttggccagcaggcccagctccatttagaacatctccctccatgagagctggatgccttcggttccagaggctgcctaattaaccttccagggatgcggtggatcagggcagatggcaccctgaaggtgtgcaaaatatcaggctagactagggtggctgggggtccttactagatgcttagggagaacggcatctgcccaggggtcacctgttaggtggctttgacagattctatcatcccttcctccaacatttgcaggggaggagaaaagagaggcccatgacagaggtgtgacctctccaagaccacagaaaactagttggcatctgaaccacatctcctaactctaccccagggctctcctcaaaacatcacattcccatttgcatctcttttagatgaagaaatagggtttggaaggaactgggttcgaatcctggctctgcccctgactgcatttccattttcttgacagtggaatggggccgtgagagtaacaataacagggagcgtggcctctacctacataagctcatctaatcccggactcctcgcagtaagggatcaattgccccattttattgccaaggaactgaggcttggaaagataaaggcactccaggattgcatagctattacgtggtggagccaggcctcgatgtctgattctagagtctaacagggtcctgggtagcccatcattctacaagactgcgagcagcacctccgtgtcatctgtcagggcagaaagcaaagggcaaagtggaatgaacccaaggctgaaggacttgggagagcaccgagatgccgggtgctgacctcctatgtggccagccagccccatgctggggtctggaggcacatcagacttgtcctgaccctgaggagctgccaggctaaggacaaaaacgattacacagagagaaataagcttaagtgttggcttaacctgccaggggctccaagagagggtgatgcctacctccctctcactcccagacaggtaaactgaggcccagtgtggccacagcatgtaggcctggtacccccatgagccaaccggaactgggatgagaactggggtccactgacgggtcagagctctttccactgcactgcactgcctctgcagggtgatggcagcaggaccaagccctggggtagacctcaacatgggggaaaatccccactcctgaatctgggaaaaggaggcaggaaacacgcccacttcctgtccagccttccagctgccctggaccctgttaatggactcgctattccatctcagctggccccaagatctctgagtggagacaactaactcccgcagtttcttgttattctttctcctgtaatttcagcactgggtagtgttccatccagcagctcctgagagccacttaggcagggcccaggaggctctgttatgggtgtgatcgaggcaaacactgggccacttcacgaaaactccgaagtgtggacactgatggttagtgaaaaagcctttacccacactgacagcgtggggagcagagcattcccactgtaaaacggattcaaggactctgcggaaaagcatttcagaagcatcagcaggacccccagccctcccgcacgctccggctaagtccctgcacttcatctgaagccgtcctggagaggcgggttgtggtgtgacaggaagcgcccacattatgcgggcctgggatccaatcccagctcctccggttcattcggagtccagtttcccaacggctctgagcctcactgccctcataaaggaaatgaggactattccacaaacactgcagggctgtggcacagctggcagtgtgaggcacacggggtccccagtcctggtccccatcctcctgctcctgtggccactcgcctgccctttacaaggaaagcaggagcttgacgtctggcctcatctcaccaggtctgctgaaggccacatatcctttttcatgaaggctttcctgctccagcccttcaagtgctctctaaacacagaacctttccttactccatgtctgggggtgccatgtggacccctccaggccaggccactcacccccacaggtaccttggggcagggcccaaacagagcagcagggctgaggcagcaggcgaccacactgccatgggcaaggggcaagacccagcaagccccggggcaggcacatctaacaccttggggctcataggaaccaggaagaaaagttagtaccaaaagggtgaccaagttggtcttctgagctaaagattcttggagctggatggaagatagctccttaaaaccaaaaccaaaaccaaaacaaaaacaaaaacaaaagcaaaacgaacaggctgggcacatggcttacacctgtaatccagcattttgggaggccgaggcaggaggattgcttgagcccaggagtttgagaccagcctgggcagtatggcaaaactccgtctctacaaaaaaatacaaaagctagccaggtgtggtggtgtgcgcctgtggccccagttactcaggagacagaggtgggaggatcccttgagccagggaggtggaggctgcagtcagctgtgatcatgccactgcactctagcctgggtgacggtgagacctgcctaaaaaaacgaaacaaaacaaaaccaaaccaagaacaaaataaacctacaccgattttttaaaggagaaaataagctatgtgttaagtattccccaaactcactgcttcttccccaaatgccacccatattcctcaaatctgcctacacctgtctagaagtcatgggcttgctgagaaataaagctgagactcaagtcctggctctgtgggttcagaggcatgcctgggaggcgaagtgtgaggacaggctgtgacctgtgctgaaggcactggtcccaaaacccaaaaagcactagggctggagtcctggccttgtcgccctgggtcttggcagagcatccctcaagcgaggtggggagtataggctatgattctctcacgggtcacgaaagctgtgagagttctctgtaaactgctgacagctacccagacagacgccattaccacccagccaaatccgccttttgtcttcacagaaggctgctgaggaaaggggacttgaggttttaggttgttaagagataaaacactccacacatcctcgtccctcctgactcctaggacaccggccactgctctggagaggctgaaggagtgggttttctcgaccagcagtgggacgcagaggacctgcggtactggcggcctgtgtaatctgcctgttaggtgtgttgctttaattgagtgaatacaaaattacaataattatacacagcaaaaggcacttgatagacaatccaatttgctccttggtcccaaataccgacagaaaatggcgtaagctcagtctggggagaaggtcaaggtgtgctcaggtgccatggacatccggaatctgtcaccatggtctgcctcacccacagcccccaaggaaagggaagctgaccagatggggggaggaagggaaagcaagtcaattttacatgcagtctttggcggaaacgttatttcttcatttcaacccatgggaatgaacttggcatggcttggagaggggttgtgtgaagggtgtgggtgtgtgtgtgttatgtagggtgtgtatgtgtgtgtgtgtttacaggccagagctggggctgagacaccaacttgagggcagaaggtgactaagttgcccgcctgcacacccagcatgggcctggcacatgcacggtaggtgggtcctcagggggctgagctgggccacacagcagtggaataactgcccgggcttctgcgtggtccccgagagctcacagtcaggtggggctcctggctacccagcagaagagcccatgacaatcaatggccctttgtggggagaggacaaggagagggctgggtttagaggtctggcaatggtgtggaccatcttcctgggacggtggggaagttaccagttagagaaagcaggaatgtactgcatctccccttcatactcatctctgcataaataccagggatccttacagccaccaaggtccactccttgcaaaggtgagcaaatggttcattgatttccgtgtgagcaaaggccccagccgacctcccttcctcctagcagtctctccaaggagccagggcagcactgggcagacagcaagggttcagggtttgcaccattaggaatctggcttccctggacagccctgctgaggcgtgaacagggggcgctcagtgaaggctctgctcaccaggcatgaaactcacttgcctcctggcggaacagaatcagcaagtgatggtttcccaaacaaagggaggaaacatggcaaacgaaaagtataggcagcgtccaaaacctaacgcatagctcctccacacactgcttgccagcgcctctttctccagcgcctggactgcgactgccatgatacagatgggaagactgagcctcagagatgtgatctcattggttccaggtccaacctgcttcaaagtctaggctgggtccctcgcaccaagctgcataccagggcaaaggctggtcttggctgcagcacaaggaccccaagagcacagccaccaggctgagctacagtcaagtcagggtcaaactagcctgccacctgtttttataaattaagtttaattagaacacaatgtaaataaagttttattggaacacagtgcaaataaagttttgttggaacagagccacactcactcatgttctgtccacggctgcttacaaagacctgatggcccacaaagtctaagattatttcctagctgtcccttcacagaaaaagtctgcagacccctgagttagatgatggtcctcaagactgaagagggaaaaaagtggagtcttctgtaattctcaaggaaaaacaaaacagtgctacactttgattttaacctcacatttctcttgtaagacaaatgaagcaaaagttgaccccattttacaaagggggaaaactgaagtatagtgacattaaggcattaattatcagagccaagatgttatgcccctgaggacaaacagaatgagcactggccaggcatcagcacacctgaatttggctgtcacaccaacaccctccatgctcactaatcaatgagccctggtctcttggccactgctcccgaatacagtgatagtgcatcatcggaacacaaaacccagcgctcacgtccagctggctggtcacaaccctccttgctgatggtgtccccagtttcattcttgccacaatgctggggaagaagcccttccccttgtttgccagcacaaatattctgggagcttgaatcccagccttgagttcttttggcaggttcaaaccgtttggaccctttcctgtggtgtgaattcacaaagaattagatcctctggggtcatctcagccaggaaaaggctccacctcgaatggctgtggttgggaagggccaggatatgagacgtgactttgcctccagccactaaatgcttaaggagggctttcctgctggagattctccgtgtattccacatgtatccatacaacagggcactcttttcaagaacacagcccaatatccataacatatgtgcagagcccacctctatctggcagtcactctaactgggcactaggtcccagtaccctgagctaagtgccggagacacgtgaacaagcagtattctgcccttccctaaagagctccagactggccagtgagaccagggtgcaacactttaatagaggcagagataccagtgcactggggagtgagggagcagtgaccacagaacagtcacatttaggcaggacttgcagaatgaacaggtgtctcctggcagagaagaaaaggaaggggattctggaccgtgaggatggcatttatgcagcccaaaggcaggcctgggtgtggttctagaggacttcatgcacaagatggtggggatgggaccaccaggccaaggggaaggatactaacatttgggggcttgaccaaggaaatggcaatacgatctgtatcgtgggaatcacatatctattctgttcctttccaaagatgtttctataccctctctcaagttggagactaattattagattcccatctgtgagtggctccttccatcctacctgctgccccgctaagtcacatcccagccctgcacagccagctctctttattaaaaaaaaattaaagacagggtcttgctatgttgtccaggctggcctcaaactcctgagctcaagcaatcctcccacctcagcctcccaagcgggtgggactacaggcatgggccaccatgcccatctcccagccttctttaatgctggcacagaagctaggaatcctgtgccccacggggagagtccagacagcacccctctctctccctgacctctactggtgcaggagagacaagcctggagaggaagagatgggcccgggatccagacccactccagtcctctggaacatggggtgaacgtggccttgccaaactgatcctctccccccagaacagatttccttcagctctgaaaatggatagtgctgcaaagacacatcccacttctgcccgccggcctccgccaccgctcgccagcgctcaggctccactgttaatcatgacaacacagcgaaggtgatgtgcatattaagaaggcactgcctcatccacccagagaattcctgctccacttttaagctctccagacacacgggtgcacacagccttcctgccctgccccttcacccccgacagttataaaaagtaatgattcgtcatatccaactaggaaggggggctgcaaagccttggaaaccacaaatccagaatgcccctaattcaaccccaattgcccactgagcagaagagggctaagaacggaacagcaaagtctgccaagtttttccctttcagtcttgcagccccctggaaaactcggtagtttttcatgccttttcctccctgaggagcttggggaatggcccaagacctcttcctccttcctctgttaagatgaagcaacaggatggagcaggggaagaaccaggactctgggagacacagatgtgggaggtcgggcccacagtcacacgggcaggtgcaacaatacctggcaaacttgacggaaaatgagaagcagctctgtggtgctgctggaaaagccccagattcatggggcttggagctcggcctatagctccctctgaaactgacttatctcccttgtaaaatgtggtcaccctacctgcctcacagagaactgtctaactatcaggagtcaagtacttagttcagcccttaccaagggtagctcttaatacaccaagctgtggctcggaatctgccccgcctcgtggaatccttcaggaacctcctttctttggctcagccctccttattacctcacacagccttccttattagcccacggagctacccctcttgcctacaacacgtaagctgtcctaatctgagctgctcttggggttggaagcatgcccctcaacaagagaaactccacccaatgctgggtgctcttcagcaaactccaccagagtcatctggccctagaagtagtcccccatttcttttgcccccaaagcccttgacggcccagaagacaggggccaggtctcttctgctcaccactggactcttatatccacgctctctaacactgctgcatttacaggtggggacactatggtccaggaagggaaagctgcttcccaaaacagaccgaagttcctaagctcttggaccttttctacagctccagagtaagttccttgggattggctattacaattaatctagcgaatcggaacttagctagatacgcatgttggacataacttttttgaccttgggccaaggaaagggcaagactttgtcaaagtattcttgaataaaagtgacctgagagggaagaagcttcaagaaggggagaggagaaggctgcagcctatagaacaatccccagcagactgatggaggggcagaggccaggtctgagagccagcagctctggtgcttgccctgtggaacaacagctggtccaacagtggggtgagggtagcagggctagaccacaaagagctctgacttcattcttctaatgaaggggcaccactggtaggaagagcacctgacagaggagaatgagccacatgctcacctttggttagcctagcctaggtctgccctgtggacgatgattgtgtgggggccagaggctgccctacctcccaaccctgggagcacagcggggctgggcagaaagccgtggcttatgaatgtatgctgaaggaaggaatgaccagatgtcagcctctgggaaggagcacttgtcggatttcccatctgccattcattctgaccacacaccttatgctggtacaagtgttcatctcccagatgaaccagggagagctgcttctgctttacaggtggggaacgcaaactcaaatgatactcaggtgaaattcaccagtgacagaatgcaggcgcacaggtgaagacccagctccccaggtcagagctggtctccatcagactcatggtagcaagcccgggaggaaaagaatcagagggtcccagacacacaacacctgcctcccagcctcgacctcccccggcagctcctgtgcggtggagcagggcactaggagtcaaggtggcaggggctaagggaggtaaatcaggtggacaagatgaagggaagtaacgtgttaaagggccaaacagggcctggtgcttaggtgtgtcaaatatgttggtcaaactgaagggttaaacactaaaaagctagcggatctcaaaaatacccagaacctcttccacacatcaatgtcactaaggctgtgccatgcccctaagactccctcctggaaagaggagaaaccctgaggcagctcttgttcttgggtaaactgaaagacctgggcctctagaacagtacagtcccagacacgcctacaacaactctaaagtctcgagagccaacccagcacagacaccaggtggggcttcatacacatcatctcacggcattctcgcagccgacctaagatgtcaaggcctatcatcgcccccaattatcagatgaagcaactgaggttcagagaggtgaactgactttctcgaggaaacccatgtgcccacccaggctgtgtgacaccagaggccaccaggaagcatggatcaccttcacagaaggtgaaggagggatgggacccagcacctccctgtccaagacagaagggacagatgagctgactggcacgctgggagctccaggcttagctgctggtcaacacggatcctgaagcccagtcatctttccacagcagtaataataaaccattactgacatgaatgtagatttctgagtttcttctgagacagggtcttgctctgttgcccaggctggagtgcagtggtgtgatcgaggctcactgcagtatcaatctccagggctcaagccatcctcccacctcagcctccagagcagctgggactacaagcctatgcaacaaagtctcgctaattttttaatttttcttttgtagagacagggtctatgttgcccaggctggtttcaaactggctgcaagcgatcctcctgcctcggcctctcaaagtgctgggatttgcaggtatgagccaccacgtgtggcctgaatataggtttatatgtatagtcaatcctcaccacagctccaaaaaggacacggtaggatttgctgcgcgactgttcctacagcacagctgaggaaacagtgcctgaagaggctgggtcactgccaggatcacactgccagccaagtgcagggccatcgtgctccaaagaccctgttcacagccactctgcggcctccctgacggccgagctgggtgccctcccaaccccatgcctgtgctgcatacagacctggcacttcatgaagggtgtgcccctctaccccaccatgtccccagtctctttcccaccatttggtcttgagcaagaaacaagagacggggcttttctttcttttctttttctttttctttttttgagatagagtcttgctttgtcctctaggctggcatgcaatggtgtgatttcagctcactgcaacctctgcctcctgggttcaagcgattctcttgcctcagcctcccgaatagatgggattccagtcgcatgccaccatgcctggctaatttttctattttcaatacagacgaggtttcaccatgttggtcaggctggtctcgaactcccgacctcaggtgatctgcccaccttgacctccaaagtgctgggattataggcgtgagccaccatgcctagcctgagatggggcttttctgagagaaaagtttacaggatcacaggtgggcctggcctaggagcttcatggattctaaggccctctttgggagaggaagtgtttcagggagaggttgcctgggagttaacttaggcagaaacaggacatgaacctgaccccatactgtggttccctgcacttagaacagtgcctcacactgagctagatgctggaatggcctctgacccccagggcagtgcctgggcccagagcccagcccagactcccctgaaggggaggttcctcccactgtggcatgagcttactcagggggtctatcctgatccatgtcatgccgaggcgtgttattacaggattctgctggaattctcttcctcaaacctcttctgctacaagggctaaggaatttgaccttttttttaaaaaaaaaaaaagggagaaaaacctcagtacaatttgctgagaaggtaggtggggacaggagcaagagagtccacccctcagtcagctatgaagagacaaaacaaaaatactctccagccccgcaggggtctccactcccatccccctatgaaggacagaaggacctcgtgggggcagagggagcagccacggtacagtgctgggagaactgccgacctgcggcagagcagcttccaggcacagggaaaaatcactccattctaagaaaacgcaaagtaaaaactcaggtccaaaggagaaaggataaaccagcccaagctcttaataagcatgaggtgaacgcagctactgacacccatccttccagtatcagatccacagaagccagagattcgggagtcagtttacacccccagtgagggcttcgccaggagcagcagcaagaacagagcccaggcctcccaagtccaagaggccagagactccttcccccttccctccctcaaaaggttgaagagaggagtgagagtcccatcctgcacttgggaggccaggaggacgtggtgtgtagcccagctgggctctgtagcatggggctggctctgcgttagggggcagtcaaggcccaagcagctgttgggtgctttgttaccgagcaaatctcccaggcgctgcctgctgatgcatagctaactgggcggcagacattgatttatgttcaactttccatttcatcagtgagagttacggcgctacatgtggagttcacgtttttcagagggggagggagaggcggctcaagtgtgcagacacaaacatatccacatgcgtgcacacaggcatgcgtgcacacaggcacgcacacaagtcagggccacaactttttttcctatttaagagggagggcgactgagctgagccagccgccgccgaggcagcctggcacgtcaggagtaaccttttgtccactgttgctaggagccccagtgccggtcatctgccgctgggcagacgtcaggcaccaggctggctgccgggcagggaagggagcacagcctgacctttgcaggggaggtgttggcaagcaaaaaaaggctttcttccctctcctctgccccaggcctcttttcactggccaggagattgtggagggcaggaccagcccggacccatgtgcttccaagtggccagcaccccccactggacagaggagcaagctaaggccaagagagagaaggctggctccccgaggacacacaggaatttggcagcagggctggtatcccagagtgtcccactcccaggatagggggcttcatcacagtaactagaggaggggctgccgctcccagagccaagtcagtttggaacaggtggggcctaggggtggggaagagcagtggttccccacctccaactgtggcctggagcccagcagttggggcgccccacctcctctctaatccttctcagcaggggtgaccctgccttctgtcagtctggaggcggacagcagggcggaggagctggagggggtggtgcttctgtcccctggaggagtgaacacatccacccctgacacagcacctctgtcctcttccccagtaggaggctgcatctatcagacagactccccccacctgcagggaagcagagagggccaggcgagacccagaatggggagggggttttatttccccacagacaggcagttatcaagaagctgcggatcccaccgccccacccaggcctgtcttcctgagcaactggccaatttgagcctcagtttctcatctatacagtgggaatgctattggttcttaggactatctcatagaatcaaatgaaatcacagcagggaacagcttttctgacttggagagtgcttccaccagcaactattaacataagagggtgtcagacagttctactctcaggcctgagagcactggctggggtgggtggggagggctaggctgggcagccccaggtaaggcgtctgctaagacagcaggcaccagccttggcttctcaccgtcacacctgcctcctgcccccaacctatgtgggcagtaagctgggcctcctttaggctccaacatccactagaggccaccagtcacaggcaggaaagctgccctcagtctcacccagccgccactcctgctcgggccatggccacctccagaggggaccgcagctggactccacactggccagccggccaagggcccagcccctccaggccatggaacctcttcctgggatcgcgttgctccccttattaggaacctttcatggctctccccaactttaagtccttcctgtgtctattcctggctccatccccacaccccagcctgcagtccaggcccctgccaccccaaacttgccccatcacatcctggcacaggctccctctcgcctggcacactcccccacctcaattcactgccaattgcctcctcctcctcagcccaaatgtcaccccctcggagaggcttccccagacaagccatactggctgtgccctgtgcctggccccaacggtattcttcctgtcaacctctccagcgtggcactcagtcactgcctgccccctccaccagactatgagccccttgagggcagggtccgtggctgcctcttgggtggctgacaggtccctgcccttacacaccacgtctgaccgaggggctaagggacgaccaagcaagcccgtccgggtctcacatgacggggactcagctccttcccttgccctgccttcacttcaccatctgtcagatgggtggggaccccagcgccccgccaccaagcttccactagtaacaggcttcggaaaccaaaagcaaacaaggtggtttaattcttcccaagtctccccttgtcacaaacttgtcctcgtcagcaaagagaggcctttcctgctgcagcagctttctggcaggaggaatgtccgctccctctgctggctcctgcttcccgctggagagcagggcaggaaatggacagcatttggctcagcttttgggaactgccccagttgctgccaggggtatgttctcatttactgggctttgaccctccctgtgaacacatcacccaccccacagctcacagtgcccaaggctctccactgggcatcctgccactgcttagttaccaccactgtcaaacagctcaccacttcatcattaatttggcagatgacagaaatgtcttccatacaatgattcaaattggcttcccttttctctcaaggacttggaatgtggggctgagagctcacaggggcatgtctgagtacatggcaggttctccgtaacagaacttcagatacttcaagacagccatcagagccctcaggaggctgcccttctcccagagaaaccccagctacttctgcaggagatggggaaagattttgggtcatgcaagtttctctcccctcttattgtctgggtcatatctccggcttttgggctacacacattgtttgctctttctcgttctctccccataaccaatgggaagagttctctagggacctcaacatctttctaaggctggtgggcctggctggcaggaatgaggactcaacggaaaggggatgtgtcaaatactccctactatccttcaccaaggtggaaagtccctgctatccttcaccaagatggcaagtatctagatgttcaaagcaggatgagctaagcttttggcaacaggagctgggacccctcctccaggacttttccagagaaggcagtctttaaccctgtgacctctgctgggtctctgtcacgcagcatccatcatcaagatggtcagctacttcctggccgggcgtggtggctcaggcctgtaatcccagcctgaggaggctgaggtgggcggatcacttgaggtcaggaattcgagaccggcctggccagcatggtgaaaccccatctctactaaaaatacaaaaattagccgggcatggtggtgagcgcctgtaatcccagctactcaggaggctttggcaggagaatcacttgaacccgggaggcggaggttgcagtgagccgagatcgccactgccctccagcctgggtgacagagtgagactctgtctcaaaaaaaaaaaaaaaaaaaaaaaaaggtgtcagctactttctgagcattggccacagtgctcaagtccccgtctccacgaagccactggaacaactgcagagtaactgttgtggaacacagatctggccaagacattatccagcccagagtgctgccctggcttcccactgcccactggatcaagcccatactcaacaaggtccttcaacaattgcccggcaacctctccagcctcatctcccgctgagcacctgtcaaccacctcattctagacaccatctcagccagggctgcactgcctccaggaatgccctcctgatttctcagcttggcagacaggcctctcctgtgtcctgccacaggggatgggttacctgtcagtctctctgctaggctggctgctcctgtgggcagactatggttgattcagttcgagcctggaaccaagccccatgccttgcatatcagagacggtcaatgacagtcataaccacagtcctttctccttctgtgacttcatctccccatctataaatgagaagcttggactacatcagggatggcaaagaggatatgtaccaccaccgacacattcacgttcatggtagacattgccagtcactatctgttgagcctggacacacagcttcagaatcattctcacggtgttctcagcagccaccacacatcaagcagagctggcatttgaatggggacttctttgctacttctttagataagagttatggtttctctatctcctttcggtctctccctccttttatctaattctctactctccctgcttccgccatccaatcagatgtgcatccacatttggactttggagtgtttgtggaagagcaccccatgaggaaccaggaaagctgggtttagactctgattacagcccctggttaacttggggcaagtcattcacctttctgagtctcactttcccaatctgcatgccttctctgcagaaacactgtgatgaaaatgaaagtaagttgcatgtttaaaaacactatgtaactgaaaacaactattggaatttaaaaacaaaacaagaagaaaaacagcctgtacccaatgctcagttctctatgacccctgccctcttgtgagtcccgttttggacttagaaatccttactggacagtgccctccttaggaccaccttagggccaaggaacttagaaattcttactggacagtgtcccccttaagggggaactagggaacccacccagatcagtgaggctggccaaagccaagctgggtttgccagatgtgcagcccaaccgagctaagctgcgtggaaaaaaaaaatgccactgcttgattatgtaaaatccatctggatccaaagcagaaaatcaaagttggaagggccctcagagaccacctggtccagcctgctccatctactggtgagaaaactagggtccagagatggggagcaacttgcccaaggtcactcagcaagtatgcggccaagtcctctctgtccttccctgctgcaaaacaccagaacaccactcctgaactcccaagctggcttcctgttaggccctccctgatcagaatgttggatctagtgctttggggctgcctgggctcctgttctgtaatgtgagcaatacaaataaactcagttcaaacatttactaggtccttagtatatgccaggtgctggggatgccaatattagggctttttttttttttaaaggtgaggtgtggtcaggtcagtttccaagccatctccctgccagcccttaacttgctaccagagacatctcatgccacgggaccagacaggtactgcccgccttggaaacctggacgtggaagaagagaaagctgatggccaaccctcattgtgggtggccaaaacttctgaccccaggagctgaagcctggcagtcagaggcctgcagaagcaaggccctgtgttgcttaccgaggggctgggatggaggtgggcagctgctctctcccacccaaccctggaggcctggggcttctacatttaggaccaggctaggggtgaagtcctgacctgaaaactgggctggccaccctaggccagggtctggccatagctggctcagccatcccaagccgactccctggtgcaaagcctttctgcagcagagcttcctacccaggccttggccaagcaggggaaggagtgcaattgttggtaacagataaaatcctcgataccatctctatttcccttctaatatcagagtggccggctgcaatactagtgaagggcagggccagcaatcaatagctaatattcctgttgtaagcaggcctactccggaaatgggcagccagtacctccttccagagagataccctttccccttggcagtgtcccagcctgagcggttcagcatcatggccaggaaggatcaggccaggtacctggcctagcccatccccctgcatctgactgatggggaaatgatgccgggaagtgagagaaaggaatcacccaacgtcacccaggaagcagagaggccaagacattgctctctgctgtctactggatgaccacgtcagctcttgatggctcgccgtgcctgggaaaacagaggtgacctcaagtcaagaaggtccaaaagttacctctgtttgatggtggctagtaatggctaaataaggacaggaatcagtcttggctttctgaccacacaccccaaacgtcacaggggagggcccaagaagtatgtctggaattaggccttagccatggacgattataccaaagcaggaagttgggagctgcccacagatcaggcagacctgagccttgtcctagacccaggccaaaatagaagccaatggcctatttttaaaacatacaactaggtattgtctacctctttctaccacagtggtctaatctgcaccggacacccagatgccggcaagcagcctcaatcaggaggcacacagatgaagcatggtacctcggtgggtccaccagacacggaagccacatctgcactgtctcaagaacatccatggcatgtgagcctagaaagaattcccaactggacagaacgccagtgggaaaggcccgctgatgggtgcagggcgccatctgcagcagccaggaagatgcctgccttggtgaggatgaacctctcacacgctggcctcttggatttcctccctgggagaaggacagcagcccctctggctactgcctttcttgggtccatgagtttccagtattttaaggtctaactctcaacccatctttaatatgtctgcagccttgccccaagctgagaccctagcaatgcctggtccagtccaacctggagctcacacacctatttctggggctacactcatctccaccccttggacaaggctccagttttggcagtgttctgggaatgcatacagatccacatgtggccatccaatgccccggatggccatcctgcatccctctctctcctcccaccaccatcatgtgacctaccacttctgtttttggggaacacctgaatttcactgccgtccttcttagctggtgagcagcatgtcccagccctcttctctcaggagttaacaccaaccgaaatacaaaatcttgccaactagaatcatcttccagatcatctctcacctagagggaaacccctttaacatccctaggagacgtttgtcaggtctttgcttagacatctctagggccagagagccccctgccttgatgtggtgtgagcacaggtgctaaattctggcctataccaagcaaaagtgtccttggactttgcctcactggtcctagttctgaattctagggctgtacagaggaaatttctgcctccttttccacacaacagctctttccatgttcttatctgggagtgccaatctttcaaaaggtgtggagaactcgggcggattctcaaactcagctgccgacaggcttgaaagaacgagagatgttatgatcgagagtgtcatcataaaagttccttacagccctgcacgctgtacctctctaagatggcattccccagtctcaagttggcttaaatcacatgaaccgccgaggagaaggtagagacagaggaggcggcgcagagagggtggcagccgcgcccaacctggcaaaacagaaagcccaatttcacacaccccagaaaaagccaaacaaggtgtctcttggagaaggccagactctcgacccacgtgggatctgttcctgcctgtggcgggcagagcacgggcacagatgcttgtgggatgctgtctgtgatcacactcggaaaaaatcaagtggttaaccagagggaaaggattctgagacctgccaggatggtgggtttttgtgtttttttaagattacgcctaaggtttgtcatttggacaagtaaagtaaacaatgacaaaagcagcagcaacaaaacagaaacaaagaacaatttactgattttttttaaagccttttgttaaaagaaagctccacagtggcctggaagtagcccccaccacctccctggccaggggcagactgtgtcgcgcctacgaagctggcatgaagaaagcaaactccagcagaagtgcaggcaatgcaggaggtttctgctttcccatctttttctccctctcagcttttagaaggactgttgaaagggatgggaagggaaggatttgaaccagcataaagcaactgtatttagaccatggcaaactgagctacttacttctctcccgccctcccacctgcccagggcctcggcctggaatacaaggtggagcacaagacccacgggccccgcacgtacctgaaagaaacctggcgggatggggcctcccggcatcccatcgttggggggaatgttgccaagcacggggctcggggcagctgctgcactctgtggagacaacaaggcagagagttagtggccaaacccacaaccagagacacagagttctgacccctggacttggctctccctgtccgtccacattccccgtggaccttcctcacaggccactttctacttaaagccctcctagcgtcccagggaagtgtcatgttcccactgacaggacacaagtagggcttatacactcagacctggactcaattcccaggtccggcccccactgagcaagcaacgaattccgaggctctttttcctcatctctaaaatgggagggccggatgtggtggctcacaactaaaatcccagcactttgggaggttgaggctggagaatcgcttgagcccaggagttcgagaccggcgcgggcaacatagggagaccccgtccctacaaaaaataaaaaattagctgggtgcagtggcatacgcctgtagttccacttactcgggaggttgaggtcagaggatcgcttgagcccaaaaggttcagccctatctcaaataataataataataataataataataataaaaaaatggggggacaatgtccaccattcagggaggttgcaaggacagcctgagacaaagtgccaaaggtacttcctgcggtgcagagcaggggtgcatggccaatgtgctgctcctggcattatatggccctgggccgtgtctgcccagctactctgagaagctcttggcaggccagtgatttataaatttctgtgccctctgcaagtggctggcatgtcatatagagcaaaagatcaataaatatccatgactcaacgaataaatgaacagaccaactgggaaacactgctggagagggtgacggagggcagagcgtgttcttggccctgcagggtcctaggtgtctcatgagagagaggggcctcgcgaagtggggggaccgtcattccttttctctttaaacactgctgttctggcatttgcctggtatatctgcctcaacaaatgcctcccaggggtgagcagacattgctctccccagcctggcctccttccaaaggatctgtgtgcaacctattcaggtggtcggcgcgtctgtgcctggccccgtgctcacacaggcggggcggggcgaggctgagacatctgggccccagccctgaggaagccacaggtctgacagtcctacctggaaccgggccctgctccttcccactgattctaggccttcaggggctccttctacaggaagcccacctccaaccttggtggtccccaaaccccaccatgactgagaaagtgaaacttggtcatcaatcatctcccagggttctgattctctgaaagaggaatgagccccttggggtcaggaaacagaacgccttttttcctcttagaaacacagcctcccatcaccaccttcaagaagtcactctctttcctttcattggcagtaaaataggaaccagaggctgggcgtggtggctcactcctgtaaccccgacactttgggaggccaaggtgggcggatcacctgaggtcaggagtttgagaccagcctggccaaaatggcaaaaccccatctcaactaaaaatacaaaaattagctggatgtggtggtgggcgcctgcaatcccagctactcgggaggctgaggcaggagaattcacttgaactcaggaggcagaggttgcagtgagccaagattgcaccactgcactccagcctggatgacaaaagcaaaactccccatctcataaaaaaaaaaaaaaaaaaaggaaccagaatctctaacttccaactttgatgaaaggaaatgaggtaatgtgcaaatctcactaatatactgcatgcaacaaaataaacgaacagacctgggaacaaatgcacctggttttcagcactgtcacctctactactaagtgggatgactgtgggcaagccactcggactttctgaatttgcttcctgtaaaaaatgagatagctgttgtcccacgtcctcaccagggttgtgggggataaagtgacagaatgggctgtgttttgtaagctgggacagctctgtgaatctagcaacaaagaaatacagggaatacagtgggtgttgagcagaccccagatgaagagaatgggcaagccgcacgttacttttcaaaatgattctgcctacagaaaaacagccctctctgcaagagctatcctgctaaccatcctgtaatgtgtacaagtttcaagcatctccaaaaattaggattgtagatctccccatcccccaggtctgaggtcacaggcccctgccttgcccctgcccggcactatctgagatggggcctcgtgagggaatcgccagcttatccattagctgcattactgctggctgcattactgtttttctgtggtcagtggttctgtgaaaatggcaattttgtgattaacagccaacaattactcctcagcagcaagagcaaaaaactttttttaaaaatggggtaaggtaaacatccatctacatttttcttcaggttctttcagagactggtgttacatttaacaatttcattcttcttatgtaccattatttaaccacttttttttttttttttttttttttttaagacacagggtcttactatgttgcccaggctggcttcatgtgatcctcccacctcagcttcccaaagtgctggaattacaggcatgagccaccaccccccgcctattaaccaacgaaataacaggcattaaatctcagtgtctgctaatgtggcagttagtatccctttggtattcggtattctgagttacctcttaggtcattaccttttgaaatggtttgcattggccacttgtagatctaattttatggcaaatcattcatgtcctttgctatttgggtatttgattttttatatattgaggatctagactaagggtaagttataatttaaaaaaaaaattaaaattattattattataattagagacctagtccccaggctggagtgcagtggcccgatcattgcttactatggccccaaactcctaggctcaagggatcctcctgcctcagcttctcaggtagctgggaatacatgtgcacaccaccatacccagctaatttttaaaattttttgtagagattaggtctcactatgttgcccaggctggtcttgaactcctgccctcaagcaatcctgccacctcagcccccaaaagtgctagcattacaggtgtgaaccatcgtgtctggcctaaaaaaaaaattaaatgaaaacttgaacctacaagtactttgtcgccttatttatgaggctcttcactctaagatgttttcctatgagatcaggagtgagtcaatggttctaggaactgaaggtagtggatggtccacagttctttgaatgcaacggccagggtcaccatggttctagtaaatgcacggtgtaattctctgaaatgtggggtggaagatggagttttgctgttctccaatgaaggaggacaaaaaaccaagaccatgttagcattgactaaggggcaggaagctgaggagacgcctttatcatttaaagcttctcaagcagcaaaactaagtcgtcctgcagtgcttaaatttgtgccttgaattttgatagttattgctgttcttctttgattatgaagcaaacatgtgctcataacaaaaaactttaaaaagggcagaaaagtgtgaagaagaaaacgaaaagcagcaaccagtggtatagggcaacaaaagagttaagaggttgggaaaggctcagaaataacttgctcacaaaatctaaaccaaggtaccctccccccaaccacatctatgaacattacgctgaatccctgcaccaaccctcctgcagctcaacggcagcaggggctgtttctcctgtctctgagacccagcacaacgtgaggcatacagcaggtgtattagcaggatctagaatacgggtaagttatactttttaaaaaaaaaactttaaaattattattattataattagagacctggtccccaggctggaatgcagtggcccaatcatgattactacgtgtataattcagagacctgctcaaagctgaccgtccagagccaggcctttccagactgctaggaatcggcctccctctgtggtttccaactttgagctggagctccattaaggcgctcagcaaagcgtctcatgagttttccctaacaacacaaaaccaaaacccctgaaaacccccattattcactgaggcctacagcatgccagggctgcagtgggtgcatgggctagaagtcccccacggaagaagagagaaaagaacactggattcagaagctagagatctcctagctgggagcccacggacaggcccctttctcgttctgggactcagtttccccatgtgtccaatgatggtgttagaggagatgaccactaaggctcttcttccaagctgctctccccagctaagtctacacaccaaggggagctaggtctggaaacagcagctcttccatgaacaggacagcaaccctctttccagggcacctgggttttaactcttctctgttcattataggccattttgtgatcaaagattaaacactaccgagagacctgttatctgagcccacagataacagtgggtgacattgggttctaaccgcccaggccttccttcctcaccaatgcttatccactttttggactcaagaaagccaactcaaaccacccatgcagtttggtaacatgcactttaaaaaacaacaacaaaaacaacaaataaagctaatttaaaattcttttctaaacagcaaacaggccttaaacagggtgatgaggcccattccagccaggtgcctcctctaaacctacagtcaacttgaaaagcccgaagtgctttcccagagcactgcctgaagtttgccgttcacagccagggagacttgtgaagaggactgatcccacagctccatctctaaagagcagggtttcttgatgatcccaggatgggtacacagccatggggctcagggactacccctgcctctgccctatccatgctccaacgggacagacacatgccactgcaaccagagatcctcagcaatcccactccgtaaggacacctgaaaacctcaccaccagtcccaccctaggagatggatattccccctctaacctccagggtggagaagcagggttcaaacagggggcctcagagcggtgcttccaagagaaagcgccttggaagccaggctaaggaatggaactttctgctctgggcaatggcggagcggggggacatctactgccccacctcaccctgtgccgggcatagggacctttcatgctcactcaacaaatcccaataccaccagagtaccccaaattccaggagcaagtggacttgacgagtccccacattcccagaggcctctcatcccaccctgagagagaagcatctcagagtaggcaacagtgttgatgcttttccttcaagaagcaatggtccaggggcattccctgcaagatactatcttctggcctcatttcaagaaccccagctatcctcactcacaaactagcctgagacccccgctccaaccctctctttaaaattagttctaggcacaggaagctcctggaaaactgaataaaaacaaatgctcagagggaaatgtgggactcctgccaggtcggccaacccctcctgactgatttacaaggctgcaaaatggtactttgttctgcaaatcccctcccctccttgccccgccctaatactcaggccttggcgtgcagcagcttgggggccacatgcagaaccgcatgtgcagacgacttccttgactgaaactcaacacaggctgcgtggcccagggcccaaaacaccagggggtgggaggtgtgtgctgagggtggagccatgtgctcaaagctgggaaatggaggtcactcaagggagcttggggcactcctgtgatgactacatacagagggcaagtgagacaggaagcctccaagtgacgcctgtctggtggcctggggaaggagggagggagggatgctggcactggtttcagcaagacaggggcttctgtgcaaactatggagtaacccgggtccctctggggccaggtttcccagagggaatttcagcagcaacaacaaactaaagatataaatcaggaatggaagcgaccgggggaatgtcatcacccagatggaaaggccaagacagacagaactggggttcaaagaagggaaggggacaggaagaggattcctggtttcatatgcagaccacagaacagaatcagttttggagaacaggggctctaattgtgcagtttagagaaaacagagctgttgctacgtgaagaggcagaaccagctgacgttaaaaataggtttggatgacacacaggagtgacacaagatccctgccttcaaatagtcagggggccatcgtgtgggaggagggatggatgtgtctcccggcaccaatggacggccctgggtccaacagtagatgccccaagctacaaaaagcttcttggctgcctcagaagggggcgggctgtgataatttggggtcgctcccagcggagacatggcacaaaccatattaaaaaaggattgccataggacccaccaccgcctgggcctggggattattaagacaaaagagtcctgcactgagggtcccaggatcaggattccagctctggcggcaaaccacctactgtgtgatctgatcaggccttcctgccccgggccctggactccacacaaggcagctgatgtcctgctgctccagtgacactgtggatgtccaaggagctcttcagcaagcgacctgaaaagggccacgtatagacaacaaaagcctcaacctgtcagggccaggccatcagacccaaatgagggtggtcttgatacctgagcttattttactaagtcccagctcatgtctgccacctgggtatgaccctggaatgcaagaggggctggagaagtgcctgccttttcattttgatcccatacatcagcaggggtggggggggggagggtagtatttattccccaacatcgctgggaagatgtcatttctgttttcctggtaaggaaactgaggcacagagagctgtactatctcaaggtcaggcagctaagtggctctaacattagtccctctgtgcctccaccttttatcttgggttcaaaaaacaaaaccacagtccactctgggaggccaaggtgggcggatcacaaggtcaggagatcgagaccatcctggctaacacgtgaaaccaagtctctactaaaaataccaaaaaaaatcagctgggtgtggtggcgggtgcctgtagtgccagctactcaggaggctgaggcaggagactcgcgtgaacccgggaggtggagcttgcagtgagccgagatcgtgccactgcactccagcctgggcgacagagctagactctgtctccaaaaaaaaaaaaaaaacaaaaaaacaaaaaaaaaaaacagtaatgtcccactcacccctgtagttcccaggaagagttctgtgtgctttgactcttatgaaaagaaatagccggcacttcattaaacacatgagagaagcacaatccattcccgtgtttgagactgtctatatgtttttgtgcttccccaagtaggctgaccttctagctctgctctttctgacaaatacttcaatgagttggcattcaccaaggggtgtgtatgtgtgtgtctgcacacacatgtgtgtcaaggaatgcaagatcccactgaagagtctgttggatctaactggcaaattaccctgagaggaggagaaacaaggtggggggtggggtggggggctgtaaaaaggttcctagtgctttttacacatcagatgcatcagcaaacactcgcttctggggccacccagactgcgctgtgctcaccagagcagatgacaggttgcaggtctgccctgcaggtcaggaggatgcaaggagttgtggtgacagagaactgagggacaggcaaggtgctctgggcaggcgctgtgagcggggattagggggatcagggaggctttgtggaagagatggtacttgagctggggccttaaaggacggcaggactcgaggatgcaggaggtgatacaggggtgagagattatgctgtcattttaaccctccctgggcacagggcctcctgacagcctttccttagagagcaaatccctctaggacgccacccgccccctgcaccatctccagggtagggggtgggtgtggggcttgttcgctttccctcccccaggataggggggctcccccacaggcgaggagccagccacctagtcagagaaggctcactgtccccaggcggtcccttgtgacccagctcatggtgtggctcatccagtctctctccctccatccttccaacaatccacagtcactaccagaactcagaggctctgaggagtaaaggcacttgtccaaggtcacatggctggaaatgggcagaaccagaagtcaagcccagatctgctaaaaccacagccccagctcttggccacacctcagcttctctgatacaaatttcagaatcgacacttaaaagtggtcacctggaaacaggtcagggcccagtccttccattcaccaggggccaagtcctcaggcacctcactttaccttctgcacccctcatcatttgctaaggaagggagccccctaccctctgtggggggcatagggaacttaaacatgacccttaggtaaggtgcccagccagactcagccaaggtacgggttcagcaaccggcggcccagagccagagacacagctccaggtaaaggaccacgtgctgacgtcctaagattccctgaccacagcaggctggggatggggagacaaaaaggggctgaaagctgtggaaagacttggtcttctgagaaggggcctctctcttcttagtggccaccttaggaggaagtgaattccctgggctgggaagtctgaggccaccatactgccgggccctgcccattcatcccaggaagcacccggcttcttctggggactggatcaaaggtcactgtttggtaagaggtggagccccatgtatttaataattagtacctggtgagggagtggatcccagccagtgcaccctcctccacaggcagatacctcccatctgggccccatggcacaggacgcaggtcccaggcatgtgcatgcaagacaaggaagattaagggctagaggatcccccctagatgaacactgcagagtggatcaacagctcggtatttgtacaacgttgattttcttcttaaagagaaatgagcttcaggccctagtttacaccattagcaaaacacacacacacgcacacacacacatttcccactgtcttaaaggagctacttacaaccacaaacatgtcatagtaggccagtgacagctccttaacaagaacactggcagttgcttctgcaaagtggaaaattccctggcgtggacccgcgcacacgctcagttccaatgacaacttaatcctgccaggaccgaggtgtgcagagaacagaaaaccacccgcttctagaaactttttttttttaagtttaaaataaatcattaaaggcagggccctcagaacatctttcaaggatgggagcccacactctcctcagtgagcatcaaatttagtggggaccaagtcactttccctcacctcctctgctgtgacaggacaaaatgtacacagtctgacaagttcacccgggtcccccaatgccagggaaggggcgcataattcaaacccaacactgcctcttctgtgtaaatgaacagtcgggagcccttgagctccttggccaggagggaaggcagtgagcagtggaccaccgtggtctgcacagccaccccagcgcacagttgccacacgggttcggcgctgagcagatgccgtctaagcctttaaagcatgcactaattgcgctaatttagctaacagtctctgtttcgtcccccactctgagtcaaccagcgtcctttggtactgctggagagatgcaagctgttggctttagtgttattttgtcagccattaaacgattcatcagagtcattaattgatttattactgctgcctgctcagagggtttagcaaataaagaatgatgtaggtcacaaagcaaaggaaattggacccaacaacactacgaagcgctgggcacttattcgagtgtctgctgctgtccattcaggcagccctccacgcccagctgtcaggcaaggaatagcatagatggttctcctgcctgaaatccaggtgcgagcccgcatcctgctcaggcaccagtgctgccaatggggaaccttgtctggagcccctggaaggctgctctcgggcacctgctagatacagctgagaaggaagggagagaggcccacactgacccccttacccactaggtgggtgctgagtagcaatggctgggcctgcagctgggccctccagtgctctaggaagccaaggacagacccttcagccaagactctactcccctggaggtgacaagctccagctaggccctccctctttctcccctgcactgcctaagggagtgggaggaatgcaacagttggtgcatgccaggaaatggcagtcctgggattcaaacccaggtctacctgacttcaacatccacaattaattcccctctaccgaattcttcagactgacacaagagaggactatagcttggccttaacgaaaaccctgacagaaactagctaggtaaccaaaagcaaggcaaccccttcccttctcagagccccagatgcctcatgtacaaatgacagggtgggtgagcccccaagctacaggaagggatgagagtccaggccatgtcctctacggccccagctgccctggccactgtgaagcctcatgtcagttcccccaagaacactcctgtgttgtgagcgaggccctgcacaagccctctgaggacccctgctgcccttcaaaccccagactccagggcgcaggtccaggaaggtttgtcgcactcagaccagacagcggtgaccctcatcccaccccaatcccagccctcagggctctgaacaaacgagagggagtggtgccaaagcaagggaatgctaatgcctccaacaggagaattcaccaggacatgaattccgtgtgtgtgtatgtacatgtgtctgtctctggggcaggaagggtaatatctctggtacctgatacccctaggaaccaaaaacagccattctagataactcagattctggcatcacagttatcagcccctccacgaggcatcacatccctaccctgccaagtggccttctagaacagagcctggcatgctttcagaggagactcttggaggatggtgactggatggtttgctccaaaagtaatacagaggggatgaagagatggttcaggtacccaccaagaaccaacctgcttctgaccaagacacagccccagcctgcgaccccagtctgtggcctgctaaagtctggtgggagccacaaagctaaagggcaaggcggggctgccacttcggagctcactacagattatttgttgggcatctaccaggtgcacacagcagggctttcttgtttgcacccaccaagaagagggccagagcacccaagaacacacacatcgcttaggatcccggtgagagatctgctaagggggtggggcctgggaggatcggaggcacgcgggctggtcagaggcttctgaagggacatgggagttcatccactgagaattctgacccaaactcagcttctgaaacaaacacgggacttctcatagaggtggtccatcccctactcatgccacccatcgatatggtattgaaaacacaaaggaaggtctttacaaaacatttattggggtcccattcagagaagaataacctattattacttacacatatttagtacctagtaccagcttacaaaggcctttctttcacacatatttccttgatgaatacagcaaccaccctctgcacaggcaggttcctctctctgcaacactcttctcctctctactcaggcctgggtgataccctttcgtcatttatgtgtttctcagcacagtgtttgtcacacctgactgttaattccttattaaattagccagctatcttccagggatgggagcaggaatggtgtgcacagcacagggaagatgctggctcagtaaatattttttggataaataaaattcttgcagaaatcctgcttttcggccaggcatggtggctctcgcctgtaatcccagcactctgggaggctgaggcgggtggattacctgaggtcaggagtttgagaccaccctgaccaacatggtgaaaccccatctctactaaaaatacaaaaaaaattagccaggcgtggtggtgggcgcctgtaatcccagctactcgggaggctgaagtgggagaatcccttgaacccaggaggcggaggttgcagcagtgagccgagatcacgccactgcactccagctggggtgacagagtgagactccatctcaaaaaaaaaaaaaaaaaaaagaaagaaagaaagaaagaaagaaagaaagaaaagaaaaaagaaatcctgcttttcaagagtagtcaccaaatctaaaaggtcaaactctaagactagctatctccatcaccttccattaacttaccatttggctacatcctaacaactcgcccctcccctccaaataacaacaaacaaaacacacaccctgccacaaactgttccttctgcccgtaaagccctcacaaacgacttgggcaggccacatctcccagatccattggtcattaaaaatggaaatcacccttgtatcaccccctcccaagacaatgggaaagacaacttcagctagtgtctggggaaagcatttgtagctccaaggaaggacaaaagcaatgagagggagtggggtggcctcacagagctggggccctgttctcattcccacagtggaagaagacaagaccagcccagtgagctgggtgcaggaaggggttcaagtggcctctgtgggttactgagacctagtggcctctcccagtcctctcggccagcctcccttccatctccaagatgaagcctgctatttcttctcagacaggttggattccctggcctctctgaagacgagtgtctgctccactggcccagggagccactttcccataggctttggctgcccaccacttgtggggcccaaggacagcagaggaaaaaggggcttggacaaaagctgagaacagcagggtgtagggtaccaccctgcgataccttcctccacttccctgaaaatgcatcccacaagcagaggctcctccaccaaactagggactgtcccttacagctagaccctccaagccacagatttatagcagacatggtttttgcaatcagagacaaaccacagagcaagccctgagctcatgcgggaggaatccatcacccccagcctcccctccccgtcccttcctcagtccctcacttgacatgaaatgaaacttgagaggggcagagagaaggggagagcagagagaccaggatccctgcagctcactagggccccccggccgcatccctactctgccccacccctgtgctgatcacgtcctgggaatggctccagcccctaacagatcaagtctcaggtccctcaccactccctccatcccggtccatgtatctacctagagaactcccagttatccatcaatgcccagctcaaatgccccctgcttcctagtccaagtgggtactaaagtcccaagtaggttcatgagctggaactcaatactagaagttaccagtttccacccgtgtccctttcatgaggcatcccacggagcatgcaataccaatggcctcctaaccaagccgacacagcactggatttagggcaggagctccagctcttgggctccctgaccaattcagagaggcaggcaattcacctctgacttgagctgcaccctgtaatataggacaatctctgggttgacaagagattttaaaaaaacaaggagataatgaaagggctgtgatctcatctcagcctttcttctctgcctcccattccaacctcccccttttctcgtactctaagcttcagccacaggggacactagctggtccccagcctttgcacatgcccttctcccctccatctggaatgcccacctccctgctagtttctgccattctaacatatcccttaggctaccctggacacaaggcaggatgatttattcaccctccaatcctatatgagactctaccttgactcttccagcatttttctacctggtcttattatatagacaaaggttatctccctgcaggactgttggttccaaaaaagtggaatccaaatatttgtaatgcctactatcaataaacatcaaatgattggagactgcaaaggagctttctggacaaagctaggcctggttcttctgggacatttctcccttcttccttatttgtctgctttataaagatgtaactttaaggaacagaccagattttggtaagcccaaatgtcaaaaggtgcaaaaagcagccttaactcccaaaggttttcatgtctctcttctcctcaaacaactgttggaagagacaaacatgaaaacctctggagagatctgaatgtgaatgctggttccgttcctagcctgaaacttgcaagtcagagatagcaggaccattcttgacaaggtccctactttgctgcaaatctggcctaaggcagtctgtttttcttctatttttgtctaactccatttaaggccattgccatggtcctctctggccaagacaggaattattaatttaaatttgggccttcggtaactttgaatctacaacatagtacaggaaggagtcccacagccaggctggacagatgtggcctccggtccatacaccagcgtcaagggtggcaaaggtctggaatccggttttcccaagatgtctgtgccttggctgtgtcatctagaaaacgaggacaataagcactgcctgcctcacacgacttgtgagggtcaagtttctgctgcatcccctggaacagtgcctggcacgcatccatcaggtgctccagaaatacttgccaaatgggtattcattctaaaccctctctacctgttttccccaagggtggcctgtcccctggggaccagctgggtatcactctccggcagaccagactcccagagccttgccatccctgcccccaaagcctcctggctctctgtcccaggaacaataataagcccccacatcctaagactctatgtaggcaccaaaggaggctgatctcacttaatcctcccaacaatctcctgaggtgagtgaatccactcatttattttatatccgacctatcttgctggtgacacgaacagttaagtgtcttgcacaaggtcacagttaatggatgctgggattttcttcctggctggatccagacatcacaaactcacataccacccaccaccacctccagtgggaaccagaaggaagatttaagtaatggaagggaaagaccttaaccctgaatcaggtcctttgggtctggtaccaatttgggacaggagtccaacctgaatttgcctatctgtaaaaagagaagtcaccattccctgcctggcctacctcacaacagtggcatgaagcacaaatgaagaaacagacataaaaactgtctcaaggctgggtgtggtggctcacgcctgtaatcccggcactttgggaggccaaggcgggcggatcacttgaggtcaggaattcgagaccagcctggccaacatggtgaaacccccctctctactaaaaatacaaaaattagccgggcgtggtggtgcctgcctgtaatctcagctccttgggaagctgaggcaggagaatcgcttgaacttgggaggcagaggttgcagtgagccgagatcatgccactgcactccagcctgggagacagagtgagactttgtctcaaaaaacaaacaaaaaactgtctgagaacagaagggcaacgccaccatccccatcaccctggataatcaaaggagctgggaacaaagatgccacacaagagcactgggtgaggagtcaggcttggctggctgcccccagaaggcccttccctgtacccataaaacaaagggaatggattcacttcctggtttccaagcctggttgcacatcaaaatcatgtagtgagctttgcaacaactaagctgcctgtcttcctgagggggcagggatccagcttctgggagctcctggaccagatgttccatcagatccctcctcagttctgtctctaccctgaccccagcaggggaaacagatcccaggttctggggatggctgggccagatgcgcaggcctcttctgccccctcatgctccccaaccagtctcctaggaggcctgcaggaagcctccgggtgcaggtcagggcttcaacagctgcccaaacaggtatgggcccagatttaattggcctcttggttaagctttctaatctcattaaagctgcctccatcaagcagaccgaggctctgaattgaatcacagaagagcgctgccctgccccactgtaagctgattaggtctggggaggcctagctcggacccctctctgcactaccatgccgtacggtcacacggaaggcacgaacccagactcacgaagaggggcacactgacgagggggcagcaggaaggaagttcagcgaagcagtcccagcaagggtgtggtaccagacctgcctactcccaccactctggggagccagtgctgtccccaggattttcagtaaatacaaaccacagagtaatctgatttcctatcttatcagtgtgcagtgccagaggccacccggctccaggagaaagctgcccttctaggcagagcgtgggactcacaattacctctccaacttcttttcgtagctttagagctctacttcattcagatggaaaggaggcagcagaggggtgtggtgtggggcccaaacacctgctttccatctctagaagagaggacttgtcttgccactcactctctccctgaccccttccacctccacaaggagctacactgcggctcttctccgatccagctcctggacgtcagcttcaaaaacaccatggtcagcgtgtgcaaacagccctgagcaaatacgcgtcgcccacttctccatcatctcgctttatctaaatatatcccaaggaaataacttggcagtggtgagaaattctgcagaggctccaaagtaacaaaaacaaaacacacacacacacacacacacacacacacgagctctgttcaaggtgccacgctgagctgaggataggcatggagatacaaacactcacaaggaacagccacccagggtgtgctgggggttcagtcccactgagggttcgtgcttggttgttattaatatttaatagggaagacaatattttagaagagacaggactctgtgcaggttgcaggccaggctagcatagatgccctgtccaagggagatgttaagggggcacgcctagccaagtacacacacacacccatcccacaccctctgggacttgctgcaagacactggtattttccgctccacttgccaagaatggagccaccctgccctgcatgcttgatcctcaaactcctggaaacaaaggcggcagtcacgggggcgtgctagcacacctcaggcactggtccgatgttcccctaccctctgccattttcactaaaggggaaactaaggcccaaagcagaagacagacatgcccagaacctggccagggtccctcttactccaccacgctgtcgataatttggatagaggtggctttttttttttttaatgcattacacacatctaggctattcacaatcacccccaagcccacccttgtgggcacagggaaacaaattattaggaaaatgagagtcaaaggggctatgggcaatcccccaaatcatgccagctctcagcaggccggcccactttctcaggttccacacaaccaccccagtgtctgccttctccatctgccatctagacacggacatgaggcctggaccactacatcaggcccctcattagtttattagccttaatctacttctttctccaaacagatcaaacccagatcgctcacacggcaggctcacaacctgaggattttctgctccttgccacacaccagctcagccgaggccttcaggacctggcctgaaccaaccctcattcccagctccaccgacataattcctccttccctgaacactgcatgtctttttaagcttctatgcatttgtacagacttcccagacactggaatgctcctatcacagtcttccttctcagtcaccaataccagaactcaataatcagtgacaccatccaatcctagctatttaaagacaagaaaatggaaggccgagagagggtaagggagcgccacagaagataaggttagcagtgctggactcgtggctggccagagtcttcattgactccaaaagccctcaaagaccctctccaactcaacagccctacagcaagatcaaacccaggagagggccactgaggaccaaatatccaagaaagagggcccttagggagttctagaggcagcacaggaagagctggcctggggtctcaggaggccagcagaaacgagatgcatgcttgggcctggaagcccagagagtggagagtatcatcatgtcagttcagctcaggggcccagagcaggtgctcggggaggatgtgcagaacgaccaagaatggtacctggcacacggagacactcggtcaacatttgctgttgcacacattaatgacacaaatggccaatgacaaaccagtgcaacacagagtaccgcacaggcctgtactcagctccaggatcccaaagaaaggaaggattatttctgccggagggtggggcttcacagagcggtgacatctgatcagacaccatctgttatttttctctaattgttccacatgtgtgaaattttgattctcaagctagaacatagactctgagagggccaagaccatagctgctttctctgccttcacctactctgtctccaaaatgtccattccatggatgggctctcagtggatactgaaagaactccaaaaagagcaatggaccccattttttttatttcagagagaagggcaaagcaaaaagttgttttcccacaaatctgcgttaccttgaagaagttccctgaaccccatcaggaaatccactgatatccacgggcatttccaacatcccaaatgctctgtgcccctggtgtggcatttaagagatggacactcttaggatctcctgaatgcttcccacatctgacaggtggcactgggtctcctagacagcttatctatttcccccttcaacaaccctgcaggacaggaatcaacatccccacttgcttgggaaaactggggctcagagaggtcactcggcaaggttaggagaagacctgcatctcatcttttaccacatcacaatgcccataatattaattctctgccaacagttttccgcaacagaagcctcacctggaccatttggcaggaaggaattaatgcccattcagaatctcatcaacaataaagcggtgttgaagaccagcagcagcagcacgccaactttggttcaacagcacaagctaacctaaggggcacactgtaccaggtggtgctcactcatccggactgtgctgtaccctgagtttctgcagactgtgccccacttttgtgaggtctcaacaccccctacccatgcccagccacatccctgtttccatagaggcccagaagaatgcaaactccaattactccctttcttgtttggataatggccacttcacaactctccctcccacgcggggaccctcgcggctcctaaggcacataaccctgaagaggcgctcaggccagggagagaagaacaaatgggaagggggatgaaaaacacacacaacagtaagctccaacccaaacagaactaatccattcagagccaagcgaggctgagcagatgggaagccaggcatcccccacccacctgtccggccgccaccaccaccctaggttccggggccttcaccacagtgctacaattacaaagggtgacccagccacatgctcccggggccacccctgctcccaggcacccacaggctctgccttcatctggtttgggtttagaatcctacccaagcctcccccaaattatgtgtgcaaaggcaagaggaacacaaacaccccagccctatggcaccaatccctgggaaagaggaagacggaggcacgaactatgcaatcctctctggattctcctacagctccagagggcggctgggtgggggtgggggggtacccccattctttccagcctggtgcctgccactcccactcataccatcgtcccatgtgcgcaaggacaccttcattctgtgtctgtttgtgtgtcttcccctccagcctgtaagcaggaggacaggaacaggacaacctctcttcctcactgtagcacctaccccctgcccccggtgcttagttagtgcaggcaaggctgtgcaaaatgtattctaatacctgctcaatgaatgtagctcacgactctgagcataattttttttttttttttcctgagaaggagttttactctgtcacccaggctggaatgcagtggcgtgattactgcaacttccatctcccggttcaagtgattctcctgcctcagcctcccaagtagctaggattacaggcatgcaccaccacacctggctaattttgtattttttagtagagatggggtttcatcatgttggccaggttggtctcgtcttagcataatgttgatgtgtttattcctttaatatttgtttctttctctagcttttaagcaccctaagggcagaaataccacctgtcttatccatcattgcctccccagtaactgacacttagtgggcgctcaataaacatttgttgagcaaaggaataacaactcaccacttcgagaacactgacgtgatatcaaccagtggaggaatctccaccacattagaggatgttaaggctgcatgggggctcagaaaccacctgctcatttatgacaggagggagtatgacttgtttgcagctgcagaccaagtcagtgcggtcaatgcaggactcgaacccaggccctgatgccaggctcctgacacccagccatgccctggcagtgctaggccctactgggggagacaaaagacacaaaagatggtgcctgctgcttaggagaagcaggtgatctagcggggcagacgagacagacacgtgaaacaattagtgaacaagataactgccaggctagcggtattatatcctgatataataaagtacacgctgtacaacacaattagagacaagagcgaggcacaccgcgctaattacacagcacaaagggtgagctcacgggagccatggggtgctggtgctgccacagaaagctctggaggccaagagagcagagatgagcttggggtgggggcgcctctgccatgcagcctctcctgactacctctccctcctccttggtgctcctgctaccagtccctgtgctagatgatcccttttgacacttctgatgcctcgctgcccttgttcgggcagtttgttatcaaccccgcctagacagtcagcccagggggcagggggcaggccctggcaccaagccagcctctggctcattacttcaatgtaaacaatcacccgcatttcccctcactatgcactgggttccatgctgagcccttccttgcactcatcccgttcaatcctgacgacaactctatgaggtgcacataagctcggagggggaagtcacccacccaaggccacaatgcccataaacagcagtcaagaaactgcattaaacaggtccaccatgctacaaatctcgtgctcttaaatctttacactcacacggtcctgcatggaagccctagccacaagcagctaccaagtacttgaaatgtgggcggttcagagacgcaccataagcataaaatacgtaccagactgcaaaggcagtttgggggaaaaaaatataaaagatgtcattaatgatttttacactgatgacatcttacagtgctattttgaatatatttggtcataattaaagtatattactgtaactaatttcgcctatttctttttactttgttatgtggctacaaggagctctgaaataacctgcaaggccctcagtacatttctaccagacagcgctgctccacacagcactgcctccacgtgtttgcagaacgaatgatgggtagcacggagacagaggacaggagaccggagaaggtggcccttgtcaagtttcagacaaggggaaacttgaaccaagatgtggcaaagggggtactcctgagcctgtgcaggacaagggagccatgacgagttctgaacacaactggggagcacttgggtcgggcatgttggaaccaaacgacacaggatgaggacagcagggcagccttcgacctagagtctttggcaatgtgaacaggcggcgaggctgtttaccatgctgaaaagggagctgggaatgatgcctccatgagacaacagtggcctggaaccagtcacctagtgtccttccagaacatgacaacaatgcctcaatttcctgaattaaagagctcttggggggatgggggtggggaggggggctctcctccaaggaccagggcgtcttctgggcacagggctagctgcacgcagcaggagtgaaggggctccccagggaagagaagccaggtgaggctgagtagggagttgcaggtgatggtgggaaaaggacacagcaggctggagtgtggaagaacagataactctggcagaaggtccagttcctgcaaaggctgcatggggagcaggtggtaaaaggacagccacaggcagaggaggaacaaagcacagtccagcggggtcactggagccagaccccagaatgttttgctagacaaggaacactgctggtgcaaggctgagggttgagtttgtggatgctgtcagagaacagacaggtgcctcaccagtggaaacaacccagggccttgtaaaaagcctctcagctgtcctctgctgagatgagttggcctacgcagggtagctgctgagaaggcaatcacagataaacagagaaacacattctcagagcctggaagaccaccaccaccacccccaccgacaccatgaggaagcgaggatgcgtgggacccggagcggctcttagtggagcatgtgcactccaccagcatggctgaggctgtcctccacgccagctgagatttaccataaccagagaaaggccgagcagagaccatgtatgcctggcgggaggcgtggcgtgggaggccaggccaggggtaactaacttcagctttgccatcgctagctgagcaactctgggctctttcttaactaagtaagatggaaaccaccaccctttactgcccagggcctatgacgaggaataaagacattcagtagctgtgagtttctcagcacagacccaggccctgcccttcccaatatcactggtcctccaaatgcctcctttcccttttcacagcacctgcctagcacaccggccagcacatggtagggtttcgataaatagcaccattttctatgatgagacatcacagctgaggaaataccaacttagatccatctatggctggagttggagtttaggagagcagaaagttcacctaactgagcaatcacagagccagggaacattttcaaaatggaagaaagtttcaggctccaggccactggcttcctttgccagactgggcaattgggagctatggagaagccagggaacttgagtttggatgccatcatttagttatttttctttaaaaaaaaaaaaaaagagagagagagagagacgaggtctcattatgttgcccaggctggtacttctgagctcatgtgatcctcccaccttggcctcccaaagtgctaggattacaggagtgagccactgcgtccggctgagtttggatttattataaaagacacgccataggtggaaagaaactctcgcttggatttggggctcaaagatggtcactattatcttgctttctatctagcagccgtctctccctgctgtcagtttcaccccaagcccagtcactcttatctgcaagctgtttcctatgatgttgtcttctaccatgatacccttccccagtcctcatttgtaaaagtactactaactttgagggtccaggggaaacaccacattcctcggtagcccttcccagacttcccccagctgaaggttctccctctcccatcctatccccaactccttgcacacttctagccagactggcagctcctgggttcatttcttattcctcctcctggactgtaagcacccctactatcccctatcccccaggatccagtcttgccggcagcacagcacagaacgcactgggtccctcccaaggagtgagtggatattacacacttgctaagtgaaagaatgagaggaatatgataacgcacagcttggtgtgataagccccaggctggtgtcagccgtgtgtcaaaaaacacatccattggagaacaggggacagctacaagtccaaacaggagtacagtttcagtccaggacaccaggctcattactggcaaagactgggttatctgaaaccagactgtgcaacagaagtaaaaagcccggccacactgcagcctcacctgaggccatcttcaactcttacctcggtcatcccttggctgagtgggaaagccactagctgggtacaccagggccaggaccctgcatttcttaggagctgccactggtattatcattagaaagaagataataatactaaacattttttggtatttctgtgtgctgagcgcttcgtgtgattgcctctcttaatctacctttataccaaccccaagatataaatataaaaaccacctcacaggccaggcctagtggcacacacgtataattccaggagttcgaaacgaacctgggcaacatagcgagacctgatctccacaataaaaaaatttttttaaataaaaaagcacttcacagagcaggaaactgaggctagactgcccaggatcacctgaggtagtggacagaggtggcatgcgcctaacacgaggctctttttactacaactttccaccaggaccctccaactactgcttaccttgactttcaaccttgagattctaaaggccaaactatgaagactcaagcagcattccagctgttccctgcccacagcctccaggaggaaggccaggcctcaacacatcaccaaggccctactacctgggcaccctaaaatcccattactcagtcagactgtgctccctctacttcttctgccttccggccctagagcccagggcccagggcctcctctaaaggaaccagctgcccccagttatggccacacccccactatggtcacgcccccactatggtcccatcatcttacactatggtcctccagcaaacacccgctctactctctactcccaaaacagctccaggtcaccttctctatcaacctttacatccactcccaggcaccccctgatccagggagaaccaacctctccctgtctcccctagcccgggccaggacttaatgctggtctgggcccagcacagaatctacactcccttactatgctgtgtttaacacttcctctggctctactagacttgggctccttgagggcagggaccttgtcttaattgatcttcatatccgtcaggggtgtgtgaaccagagcaactccatcttgaaaaggagctgggtaagatgaggctgaaacctactgagctgcattctaagtcacaggatgagacaggaggtcagcacaaaatacaggtcataaagactttgctgataaaataggttgcagtaaagaagccggccaaaacctaccaaaaccaagatggcgacaagagtgacctctggtcgtcctcactgctacactcccacctgcgccgtgacagtttacaaatgcaatggcaacgtcagcaagttaccctatatggtctaaaaaggggaggcatgaataacccaccccttatttagcagatgatcaagaaataaccataaaaatgagcaatcagcagccctcggggctgctctgtctatagagtaaccattcttttattcctttactttcttaataaacttgcttttactttgtactgtgaactcgccctgaattctttcttgtgcgagatccaagaaccctctcttggggtctggattgggacccctttcctgtaacatccctagtgcttatagaatccattaagtcatgttttaaagcacaacttcccctgaaacaacctccaaaccccttaccagagatgctcttcaataattaaaataacaaagaagaggccgggtgctgacatctgtagttccagcactttgggaggcagaggcaggcagatcacttgaggtcagctggagtttgagaccagcctggccaacatggtgaaatcccgtctctactaaaaatacaaaaattagccgggcgtggccgggcacggtggctcatgcctgtaatcccagcactttgggaggccaaggtgggtggatcatgaggtcaggagatcgagaccatcctggctaacatggtgaaaccccgtctctactaaaaatacaaaaaattagccaggcgcggtggcgggtacctgtaatctcagctacttaggaggctgaggcaggagaatggcgtgaacccgggaggcggagcttgcagtgagccaagattgcgccactgcactccagcctggccgacagagcgagactccatctcaaaaaaaaaaaaaaaaaattagccgggcgtggtggcgcacacctgtaatccctgtcacacaggaggctgaggcaggagaatcactcgaacccagaaggcagaggctgcagtaagccaagactgcaccactgcacttcagcctgggtgacagagcgagactcagtctcaaaaaaaaagaagaagaagaagaagaataggataagccattgatcaccaaggaaagcagagatttttccaaggttagctctgaaaactaggactctttaagaatacctgagcttcaagtcagtgaccccacctcccctgcaaaaaaaaaaatacctaagaaaaaggcaatctctgcagaaaaatctcactgatttagaataatcagggacaagagacaaaaagatggtctaccttaacactgcaacaaaatcataatgctcatctgatgaactggggcatatgtgcatacagctttagagactcaatggggtcatctgtcactggtgcatcccatgcggacaagcaaacggaacacaccaatttcaggcagtttaagattatcaagcaggttttgtaaccttcccacatcttattaacaccactcatttgcttgacaaacctgccctctggtcttggactgaaggactgaggcatgagccctgccctgaggccagttataaatttcaaactgagccacccccaaaaaacacacaagttttccaagtagcctaatgagagctgatgatactgagtcgggccagcccaagttgacattggcgagtgaagtttttagtcaagctgcagtaacaggataaccaagacaacatcggcatcccttctctgcgcagcaaagggaaatgaagctggttctcaaacagccagccttgctttggactgatatctagggaaacattccccttaggattcaaggcagactgcaccgtgagaaatcatttgtcctttgcacacagtcaatgagcttagacaacgccaggcagtcagaaagttggcttctgtgccactcacttgttcctgacaccacttggtaactcaaagaccctggagtttggtcctgaaaaatccctaactccccggttgccctgtactcagaaataaccaaaagctttagctgctgccaaaaaagggaaaagaaagaaaaccccaggaacacaccaaatccatgtccaactcctttgccccttggaacaaaacccattgcaggcacacacaaagcgggggaaggcaggacaaagaagaggccaggtcacactcgacaaggcgctttcttgtcgtttccaaaacagaactgtcctctattaaaatgctcttgttgctcggatgttggtgcgggaaggggtggggggagcacaaatctcaaaacaaaaggcgagacacagcatgtagggaagcccgggcaggctccttctccctgcacacttccaagcctttgaatacccgcagatctcggtccagagctggcagctgtctgttattatcccagcaactccaagggccccagcaccagggagcatgtcccgagcaggtgaacaccatctgcccggctgacaagatgcccgtcttagtgcctgctgctgccagcaggccgtgtggacctcggggaggcgcagccaacctcaacaccctctctgggatgattcttcaactctcagccaggctttcttctctctccccaggggccgcaggctccgtcactacctagcatttttcacaggaggagagctcttttaaaaaacacctggtcaccttccatagagatttctaaaggcattgagagcatggtttttctactggggggtgggctgggggaaaatgcagagttgggtacacataagaaaagagagcccacggacacaccttcccaggggttaattttaagaagggtttttaattgagctacaaagagaagaaagttttctacccgccttttaaaaagcactacctgcattagctaaaccattcccaacacaccccaacccacttcctccctcccccaccctcacagttttaattggggtaagtggctccctgatgcaatctgcaaagcaccagcccagaccagggcaagagcaagagctaagtggaatagtggggctgggtgggtgggcctagagagttccaactctgtgcttccactcaccactattttacagattcaagtacagtatttccacttgctggtcttttcaaacaactgaaatacctataccacctgtgaggatggggggagaaccacccccgctttatgcagtgagggagctgagctgactcactgggagcatgcagattggcagtggtgagcatgaatgcttttgggtctgggtctccgtgtgggggctgacatcacctggaaggaccgcaggtccccacccacaatctctctagaactcttgggcaataagaaatctgtggcttgatgtcttccaagccacacatgcttgggtctatttcgcggaccctaatcgatggctgacttctttagcctgctgaccagagccgattctttgatgggaaaacaaggtgggggacacatcatggggagagaactggccatcccagaagggggcagcagagggaaggtctggcgctgggcagcctctgggctcaagacggaaatccaccaccagtgaagaccagggtcctccctgacttaatgcaccaactgctgagaacaccataggaagggctgagatggagtgttccctgcttcggaacagaagccaagaaggagagaggcagcagtgtggagggtctgtcatgtcaaagtgggtccaagccctactgggcccccaggccctgggaaactttccaggcaaagtgaagacaatcaccctgcctgcctgacttgcaggacctgtcgtgaggctcctccagggacaatggaggtaaaagagcttgaaaaactattaaaggacctacccacaagatgtcaaaatcgagacaaccctgcctacctcatggggcccattgagagcatgtgagccagccccacagcccccaagggtaagacacccatagctgcagcatcaccaccgtcactcggaggggcggcagactcaggagggcagcctgaccacactgagcagcagccctcctgtcctaccctgcacccgtgccgagtcagagtctccaatttctaaggtttttggctggagaatgagccaaaccatcatcactataaaaaagcaaggaggtggcatgtagaaatagtccttgtatgactctacccaaagcaagctctgtgttgttccccggagccacagttctggggactccttgaccatctacagcagccaaggcccctgcccagcgcactcacagctggggagactctcagatccatctaagcctaaacccaagactgcctctctccagcatccaccggctgatttgcctccacagaaaaggggctccagcacatagcaccagctctgagctctgtagtatttcaaaagaaagtcttgctgggggcaagtggccaaagagggcttcccttctcaaggagggtgcagcttgggatgtgtgttaaagaatatgcagtggccaggcacaatggctcatgcctgtaatcccagtgctttgggaggcgggggatcagtggaggtcaggagtttgaggttacagtgagatatggatcgcaccactgcactccagcctaggtgacagggtgagatactctctctttaaaaaaaaaaaaaagaggccggacaaggtggctcacacctgtaatcccagcactttgggaggctgaggtgggtggatcacctcaggtcaggagttcgagaccagcctggccaacatggtgaaacctcgtctctattaaaaatataaattagccgggtgtggtggcgggtgcctgtaatcccagctacttgggaggctgaggcagaagaactgcttgaacccgggaggcagaggttgcagtgagctgaaatcacgccactgcacttaaaaaaaaaaaaatttgcaggattacatagaggaccagagaacatgtcctgtacactccttccttcacagcctctactatgggcccaaaggaaagagatgacccctctctgtatccttaaggctcccacccattctgatgtcacaagtcctgaggccagtgttcagacaagaccaccacagccatgtcagggggctaccaggcctcacaagcttgggtcccacctgggagccagagcccacagcacagtgccatactgcagcctttgggtgtctctcccctctgagctccccctccagtgggggttgattggtccagcttcctggaaatgtctcttccactttgaatccacttcagaaaggcaggcccaggagggaggccaggagggggtgggatgggaaggaacatcctgtctgcatcagagcaggggaggtggccctgagcctgcccacgtgtgcctggagcttttttttttttttttttttccattgagcaggaagtgttcattccaccgacaaacaagcatctggggtcgtgctagggttagggcggtggagccagctctgatttgtagaagtgaacaatccaagacaatgggtgtacaacggcagagaaatcagctccagatgcaggccagagacagctgcccagggaccaatcggggtaatcaatcctgttgatatgtttgttctccaaagaagaacctgggggagggggctgcagcctctgcctcgccagacaatggaaggcagctgggagcacagtctataacccttctttctgatacagtctagggctcctgctttctcttctgtctcaaggcttccctgctcctcagccaggaactaggggggctcacaccgaagctgtgtgcctgtgcttttttttttttttttttttttttttctttttaaagagctggggtctcactatgttgccgaggctgggttaaaactcctgggctcaaacaatcttcccacctcagcctcccgagtagctatgcctatgctttttgacatcaacagtcaagtactctggggtcaatgcctaaggtcttgcacaaaagcacgggggcctggagtgttcctgccctgcagccgtaggctgcccatcacttctgtgcagtgctcgtaagcagatgctactcagagtcaagatagctaagctttcccaaatattagggcagctggtaaggagggagactaggatttttactttttttttttttgagacaagagtctcactctgtcgcccaggctggagtgcagtggtgggatctcagctcactgcaacctccgcctcccaggttcaagcgattctcctgcctcagtctcccaagtagctgggattgcaggtgcccaccacacctggctaatttttgtatttttagtagagacggggtttcaccatgttatccaggctggtctcaaagtcctgacatcaggtgatccacccgcctcggcctcccaaagtgctgggattacaggcatgagccactgctcccagccagattttcacttttcagatctatgaggtatcagagtggctgagatggaaaatgggagccagccaaggggggcttagccaaacagttactaaggagcagagttggggccagcacccaaggtaaaacgtagacccagtctccaaggggagacaggattacctgattgtctggcaggggtaggggaggaagaccacatactgacaagacacaccaaggaagtgtatgcgggcacacattcaaataagcagttctgaggacctaccatgtagcgcaaactccagagggaagcaaaaagggcgaaggactcctccacttcacagagctgtgagatccagaagaagggcacagcaacccttttatatcacacatgtcaccaaaggctgtggcctgcagttgtgcctacacctggctagtgcagtttcaccaacattggtggggacagcaaaagctccctacctggcactcacaaagcctcaacattttctttaaaaagatttgtgaaatagactgttaaatggatgagcagttagttgggtctgataccttgaacatgcttccctagacaaagattctatgaacttaaatatttccttagatcctgcctaaaagggacctcaaagggctcttaaggaaaagagttgttctttttgtggaactggtctcaccagaattggagagtgagctgcctagttaagacagtgagcacccggtcaactggcagtgtcccagcaaaggaggtgaatgaggaggcttccagtgtcccctcccagtatgaagtcaaagccacctgggtacagacgctggacagggaggggatacttgttgatctggccaaccttccttgataagcaggaaagggggaagggagctgaaaatcctaagaacaaaagaacggcagagcttgtcactcggccctgatcatccatggcaccctatccagccatctgtcacagcatatagaaattccccgcgtgtgattctgtctgcctggagaggctgctggctcttatccatctccctattcccactgagcttggtgcccaggaggcccccataaacattactgaacaaaatgttgaatcaaggctactaccggagcctccctgtacagatcaagcactgtctgtacccattcctcaaggccaaggctctctgggccacataactctctctccttaacttgtgagacagcctgcagctcataactgcacacaatagcacaagaccatgcctggtctacctctgtttccagccgccgcctgtccctcctctcttacatagctgcaagtccctggcagtcaaggaaaagaaagaactcaccacacaccacttggtactatgagaagcacacagcagatggacttggtgtttggtacagaaagtagaaaagtcggagttataacatttttcatctagagcaagcaaaaaaagagattcttcaatgtttaataacttccagtgcaagttaaaatgcagttagagtacccatttatctattgctagcctcagtataaattaagacaacttttttttaatttaaaaaaaaaaaaaaaaggtcttgctctatcgcccaggctggagtacagtagtgtgatctctgtctttaatttttctaaagacagggtctcttgctctgtcacccaggctgggctgcagttccacaatcacagctcactgcagcctcaaacccccaagctcaagcaatcctcctgcctctgcctcctgagtagctgagactacaggctcacgctactatgcccagctgatttttttttctttggtagagacagggtcgcgccatattgcccagattggtctcggactcctggtctcaaggaatcctcctgcctcagcctcccaaagtactgggattacaggcatgagccattgcacctggccaagacaaccctcccgaaaataatttggcaaaggattcaagggttttagcaggagggtccttattttctgacccagtaattgcacttctgggaatttattctaactgggcgcggtggctcacgcctgtaatcccagcactttgggaggctgaggcgggaagatcacaaggtcagaagatcaagaccatcctggctagcacacagtgaaaccccaactctattaaaaatacaaaaaatcagctgggtgtggtggcaggcacctgtggtcccagctcgggaggctgagggaggaggatggtatgaactcgggaagtggagcttgcagtgagccaagatcgcgccaccgcactccagcctggacgacagagcgagactctgtctcaaaaataaataaataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaataaaataaataaataaataaataaataaataaataaataaataaataaataaaataaaataaaataaaataaaaatgtcttagtctgttcttgctactataagaaaataccttcgcgtgggtactttataaataatagaaatgtattgctcacagttccagagctggggaagtctgagatcaaggcactcgcaaatttggtgtctggtgagggcttgagctctgcttcaaaaatggcaccttcttgctgcatcctcacacggcatcccttcagcctcttttaggagggcactcattccattcatgacgatggagccctcatgacctaatcacattccccaaacgacccacctttcactactatcacactgaaaattatgcttcaacaatgtgaattttggggagactcagtattcagatcacagcaaaaatcatccacaatggaaggcaaagatgttcactgcagtgttatgtacaatggcagggtggagagatggaggacaggaaggaatcgccaattaagggaatgattcaataaagcatatgaggccattaaactgtaatgataatatactatttatcaaaagaaaaagcatcggccaaccgtggtgactcacacctgtcatctcagcactttggaggccaaggcgggcagatcgcttgagcacaggagtttgagaccagtctgggcaacacagtgaaaacttgtctctacaaaaaatacaaaaatgagccgggtgtggtggcaggcgcctgtgatcccagctactggggaggctgaggtgggaggatcacctgagcccaagaggcagaggttgcagtgagcagaggttgcaccactgcactccagcctgggtgatagagcgagactctcaaaaaaaaaaaatcataatttgataaacatgtttatcaaacaaaaaagcatcaaaccacaaaaaaatgtgtagacctgggcagccttttttccaagtctagaagtcactcaggataatagtaaatgtttccctttcactttccaaaacgtgtccaaagttgtctacaagagatggggtgctgtactcaaggagggaagacagtgaggtcatgtctccatcctctgtgtttttgtttgtttttgtttttttaagatgaaatcttgttcttgtcacccaggctggagtgcaatggtgcgattttggctcactgcaatctccacctcctgggttcgagtgattctcctgcctcagcctcctgagtagctgggattacagctgcctgccaccacgcctggctaatttttttgtatttttagtagagacagggtttcaccatgttggccagactggtctcgaactcctgacctcaggtgatccacctgctttggcctcccaaattggtgggattaaaggcgtgagccactgcgcccggcctctccatcctctttctatgccatctacctcatctccaggcttggggtgggagcgaggagaggtgggtaaagactttgaaccaaggcaaatgaacatggttccaggtagtgttcacatgacacctccaaggatgacatttaaccaacaggaaccttctgggagtatttcaataccctccaaaaaaccaaaccaggcatgcaggctttatatatgcaatgtgcatgtgcgtacagagagccataattttcaatatagagatacagctataccattccgttccctaacagcagcagtggccaactttctaccccaaccagccatctggggctcaaagggaaggtgtcagattgatcaccagggtaggattaagttttttttttcttcttaaatccccttaactgagaaagcagcttgagccaattctgctttcctcacagacaccaaaacaccaagctatagttacaccagttcatcttcacaccccagagtttggggggctgggggaggataaagctttccaagcagctctctgccgagtctcacctcctggtggaggagctggaggcacaggctgtaaggaacaggactgccaggagaggaatgtgtccatagcctgctctcccaggtccccttcagatgcaggaagtggcatcacctctcaggagcctctccacatcccccaccccaagccgggaatcttccccctcctcccactacaaagatattccagactattatatcactgtaccagccttacctatgccagttacaatatccttaaaacttagtgagagagtaacaggagggaaggggtcgtcctttcccaggatgtatccggcacctttccctgctatgatttcatctatcccccgcagcaacccagtgaatggcaattcccattctatggatgagcgaattgaggcttggaaacactgcaattctttggccgaatccttagtgttctaggctgtccacaccacaccagctgcagcagaccacgctcaatggagtagaagggcaaagaaccaaccagccctgagcactggggacctgcaggtgcttctacatgtgttctttctaatccttctaataacctagagaagtgaggaagtatccttatccgcagcctacagatgagaaaactgaggctcagcgaagagctaacatccttctcaaacagcttctaaatgatgagccagatagacttaagagctagggcccatgtccccttgcacagtgacggtcaccttctccccaccctcaccattaaatggaaagctcctctgacaatgtagacgtgaatgggagttgcagagtgacccgctctgcaactcccatccaggtctacacctggcactatgtaggtacataagacatctgcctgtgctgggggaaggacgggaagcagaaacccctttataagggaaatttccaaacacagaagcagcaggagcctcaggactcagccttacccactcagtgtcactttcagccccacaggtgggaaggtcctcagcatcccctacctccacgcaagccaactttctgtgctcctgcttgtaccacacagaccctccctgaatttgttaatgatcaaccttccaggctggcgcgagccttccaaggggacaatgaccacctgcaggaaaaatggccagaggcaggttctgcatcaatttattaggtttaaagaaaaaaaaaagtcctgaagaaaaagcagcagctaagacatggtatttccagaaaatttgtattattcttttgttggcctcttctctttgaaggacgcaggtggcctgggaagcatctgaggaatgaagcaaccacaaagactaatgctggagaaactggcttcaaactcactgtctagacagacttcacgatttttcaagatttgacagaaggaaggctccctcagtgtccagacccctctgaaatgcaccaacaggaggcagcttgccatccattcctgtcccaggtacctgcttcatgccaggctggagagggaggtgaatcttcagaggtgaatcagaggcctccctgccctctagggacttccaatctagcagaagagtcaaatgccagtgacttccagggtggaaaagcactgaacaaaagtgaaagggaagccagtttcagagatgagaaatggggtgacactggcctttttcaaaaaaagaaatggaccacagagggaagacatctggcttcaaagaagccaaagacaggcaaaggcagattataccaaaaaggtttttttgttttgttttgtttttgagacagagtcttactctgtctggagtgcaatgacgcgatcttggctctttgcaacctccgcctcctgggttcaagcaattctcctccctcagcctcccgagtagatgggactacaggtgcccgccaccatgctggctaattttttttgtatttttagtagatacaggttttcaccgtgttagcaaggatggtcttgatctcctgacctcgtgatccgcccacctcagcctcccaaagtgctgggattacaataggtgtgagccactgctcgcccaccagaaaagttttaagttaatgccagagtcctgagaggtgggaaggaggtcaggaagtagctgctgaacatcatccaggtgctaggaactgggggcagacacagaggcacaggccttgacttcaaggaaaccaggagaaagagaaggagagcagataagcagatagcttcaatccacacacggaagcttctggggctttctcggaaactgcagcaactagaacagtgcctggcatacggtacgcattcaaccaatgaatttgtggaatgaatgaacaagagtacaaaaaaagggtgtagtttattccgctctgggaggcaggaaagctttgctgggaaaataacctggagctcagttgcaaggggaagcttgccccctagcaagcaaaagcagcaaggggcatgtcaggcagaagaaaatgcacaggcaaaggcacagtggcctaagggaacatggtatagccaagaactcccaagaagcccttctgttcatgctggagagacagaggatgctgtgacaaaggcactgaccctggagagacaggagatgctgtgacaaaggcgttgacccacagggccttgggggcccagccagggaactcgggcttcaccctgaagaacaggagaatgccctcaagactgcaggcactggtgcagcgtggccagatgtgtttcagagagagaactctggcagcaggctgtattcatctcagtgccctcagtttctggatgaagaaactgtggacttgagtggggctgtcatttgcccgaggtcaagtggctgggtggtatccatccctagcttctgtcccagggctccttttaccacaccctgctaccatcccgaaagctctcactgcattacctcaatattccacaaacgcaacaaaggctcttctaggtgagtctgcacaaacaagtagggcaactctcaggccagaggcctgggaaggccttaacctgactgcacttcggttttctccatggaaaactgggaaatcgatatgaaacctagagttcccgtgcaagtcaaacgaagaatgcacgcacagcttcagctcactgacttgcagatggtaagccctcaaaggacaaccgactagcatcactcacgcaaacatactggagtgtcttccatgtgctattctggaaattaagagcagaatgaggaaaagggagctgaagtcgaccaggctcaagatagaatgtcccccatgagaaggaggtggggtctcagcccactggcctacaaagtaaggaggttcagtgagcatgagtagaggcatgatgttttgagtactgcttgattgcctggagataaaaactgaaagctggttggaagaagggctggaaaataggatgcactctgctcaaccctgcccttccaaagcttcaggactggaaaatgaataggtctaccagacctcaaaggctgcaggtgggaagtgggaggggcacagtggtggccccgcttccagcctttccatgtcatttatgacaccactgtacaagaaggatctggcttctcacaagtctccacaatttctcttgtcccttcctggctgctgggacaggctgaccaggcaggagaaaggaagacacagaatcaggcagtaaacagggctgacaaggactaaagacacctgtggatttgaggcatcagagattcatcgcagcactgctggtgaagttttgtagcacggggaagcagaggcttcagtgggttgaggtgcaggagaggtgaacagccatggccaatagccaccagcacagacaatggctagccttctctgatgtgtgcccaccacacatcagaactttttgggagttcttgggccaggaggcaatcccctccgggatctaggatatagctcattcttactgccacatctgataatgcacctggccacataaactcaagatgacacctatcaaataccatgtgaaaatgcccaaagtcaagcaggaacatgggatctacattatgtatgctaaagagatgtaggaagcaagatcctcccctgcaggaaggacaaaagaaaaggaaaaaaaaaaagggaatacccactctctcctctccaagcaacaactcacctgtctccctaccccccaaccccggcacctcaaccaaccaacctaggttcaagcaaaaccatccatccacttatgcgtcaggtgttaagtcagctggcattaccaggtggcctttgaaagtcccaacacagcacccaacataaaacaggaacccatacaatcactggttgccctcaaactgccccaggcacttacaggggggctgggaataaaaagccgtaattgtcccaggacaaaactgacaaataataactcgtactccatgggtttcgttcactgaactctgacctatgattttcaagggaactcaggaggagactccaaacttccagaacaaagacaaggcagaagaacctttttgagttatttggaacttcctggggtgaggagaggtacagggcccttcaatctcccacttcccagctcacagaaccaatggacagcccttaagcaagtcaatgaagctcccagagcatttgactactcttcagtggggaaagaaaaaaaatttaagcccccaaattctgcttccagggcttaatcagtgttgtaaaggccagaagatgcacaagataacagatacttttaccataagtggggagaaaagtaaactactccaggaaacagaggcaagatctctgctctcaggcctctcgaatcccaagacccctccagcaggtggggctgggagtcaggccctggaaaccagttcctccagcagggcaggacgccaggcgtcctgctggaaggaggctccccatcttcctgggaggaggtgttgctccagcctcctgtcctggcctgctcatcagaccctgtcccaacaggcaggtaaggactgctcttggcctcacctcaccacgctatctgccttcaggcaagtgaaggaagggccgagagaaggccagcagatgtgtgggtggatgcgggtgcttgggggcaaagctcagccttggattgcaaaagcctggattccaatgacagctgaattcccacctatctggaggtggaaaggactgacccagaaggagcagaggaaggctctgccccagagactgtctgactctaacccaaaagtgaggctgcaaagactgggttgtggtagagggagataggaactagcaaaaaagacggtcttcctttttcaagctagcacaggcccacctgagcaggatgtacaagcagaatgcagcaggtatcctatgtgtccccccagagaagattaactgagtatcatttatagaatgccagcatcgcactaagtattatcctaagcattttacaagaattatctcatttaatcctcaagcatccttgaagaatgtgttttatccccattttataggtgcggaattaaggagcccagaggttaagcgtgttgcctgcgttcctgaggttagtgagcaaggaatgctggcatttcaaacccaggtttgtcaggctccaaccagctcctggacaggatcttcttccaaaaggagaaagccttccggccacagaaatcagaagtggggatggactctttcgacagtcttcagggctgcagacaaagcccctttacaacaaaatccctcttggcaatcagaaaagtcaggcaaggggttggtcccttccagacagtccttggcacagccccagcatgaggctcggcttctgtgccatcgagaagccggctgcattctctgcagctcttcctgacgacagtccccacccccacacccctacagaacacttcactcagtgaccccataggccagagcaggataaagtacagcagccccttaagactgacatccatcctggggacactccctcgaaagcctggaaggctgcagatctaccctcccacgcagcaacccatcaccaaggctggagaggccgaggagagaaggccagcctgatttacagaatttaccaaatgggtccgtttttcaccccgttccagttccttttgggaaaactccaggtttttaggagtagattaatggcagggagttaatggggtggtgatatatcctgcttgaaattttttgaaaagttctgcgtcaaggcatccagtggccccgctgtgatttagtacgctggcccctgagaacaggcaggtccaatatgtcggtaaatctgctaaacgaggtggtttctggagggtggttttcaagatacacggcctgacatgttgccaaacttcccggctagctgagccccaaatgtgaagacaatgggagggagccaggcagaaagccgctctgctctaccaagaggagaaggcacagcctgcagcagccagcactggggagcagagagctggacctatgttctctggctttctgctttggcgggagaatggggtctaagaataaacaaactaagagagtagagccaaaagggaactttgatatcatctactgcagttccattttataaacggaaaaatggagcagccgagcatctgggcccaggacctcatcccagcacgagtcactccagcactgagcgcccagtgcctttcggtattgtagctccatttctgcccactcctctaaatcccagccagaccccacagcctagctgcccctttctctgagaaccatgttaaccaacaagatgatttgtgagcctctgatctcactaggaaaaggcaggaacagaatcttacttctctaggcccaagcatcatgggattcaccagctcttctggatctacagacgtggctgaatgaatgaagacaggagtggaaggtgggaaaaaggtcagacatgccataccaaagctttccaagggccaaggctttaagatgcaatacatccaatcacaatcagccctcccaagatgaaatactcccttattttgtaactcctgctgatgtaaaattctgtatcagattacgacaccatcattccccattacctttgctgggggattcaattattggattaatttataatctgccttcctggttgtttttttgcctattgctctctttatactaaaatcacatgtaagtagaacttaatcaaacagttcgaaaaggattttgaatttgtctcgactgccgatgtcaattcattagaggcgctactgtttttctctggtttcctccacactcctctccttattttgaaatccctagaaccaaacctcttatctgcggacttaacacagtggcaaagataatcaaagggaaaatcctgcttgacatcaggggattgtactctcgggtggatttcacaggcagctcccccccgccaccccccacccagcagcctgtcacaccttcatgtgatggcttagtgagcaccggccagaggcaggcacaggggccgaggtataggagcaggttccttttagcagggatggcggtgctgatggcagcagcagccgcagctcaaactctcaaatctccctcctggagctcagggtaatctgatgatcgcagtgggtaattagagtctcttatcaaaacaattagcggatgaatgaacagccagtcccatctctgacacaactgcacaaggcgcagcaacaagagggggaggcagaagcaggggaaatgacgaattccagcccccaccgtcatgcccattccgggggacaccggaactccagcctcacctccagcttctccagcatctgcccggaataccctcccgcatcccttcctctttgcagccaggtcagcctccttttccttccaagcctggtttggtatctcctccaactctgcagataccagctcctctgtgcagaaaggtcctgccagtcaagctgcttctctgccccaagcttattctatttagccaccaggctgggacaccctgggcaggactcaaagctcttccttgacgcagctcctggcactgggaaagggctccataaatgtttgtggcacacacacgcgagccaggcctgcctttctccctcatggccgaccccagagcattctgactctaataactgtttcatgggaatacccaggccgttccacccattgcccttgtctgcaatttcattagctaatgtttaaaattcaaagctcttccatcatttccgtgtctccccatctgtaaacaggcctgtgggtctgataccatttgtttccaccactgaaaatacacaaggattagccagaaagccctgtggaaacataatcctaagtagcgcaggccataaggcaggaacaatttacaagagcccagagttggtcctcctgtttggtttgtggacctaggaaacggggccaaggagaaggtggtggtggtggtgggtggggggtgcccaagatgtttctggggatttcaaggacaggcaacgccagggcagagccgggcctcctggtttctaagcagtaactcaggcacttgggattaggggtgcctcatcttgggcccagcctctctaggatcttaccccagtgccacacccaaaagtgacacattctggggtgctctgagggtgcagaatgcccttctcccgcttcctaatgctcaacaggaaagagagggaaaaggaaggaaggaaggaaggaaggaaggaaggaaggaaggaaggaaggaaggaaaacaacaacaagaacaacaacaaaaaaccccccaaaaaaacaggtaagggccaaggcagagttctccatctgcttttgttttccatcacgttcctttcaaggcctgggatctgctaagccccgggaaagccatggcatcatctgtccacttccccctctgcaatctgccgccctgcctgctcctgacagccatcaatcactctgtaatgtgctgacctcaaggctcaggggacagaattttcaagtcaaatgtagccgttaacataaataaagcatcgccctggatttctttctttctttccctttctctctctcttttttaatgattctgcagctgctgctggggactcggtaggcaacaaaagtgagggcagacaggcatagtggaaaggcaattctacttttctgagtcataacaattatgacgttataataagaaacattttctatgaatttttaagtacgagttatcctgttctgcaactgtccccagggaaaaggacaacagattcaacaggactgtgggctacactcatctgtccagagccaggcagacccctgggtcctgtcccctcccccatcccaggcacgctctagctggggctcactctgcatcttaaataaagcagttgtcctttaagcacatttacatgcaaacgacttccatataccaaatatagttccgtaagccagcgtttatttttaaacacgaagaagagtctcccataataaagctcatgataaatgttatgatcctcaaaatggttgatagggaagaggacgggcgactctagggagtgggagggagaatgagggcttgtaccctggagtcactccacagccgtcttgacctcgtacccaggcagatcacatgcagggcggcactcctcatctcccatcctctctccttgcaagcaacagggcccgcagcgaacaatgagtcagaggcaaggaccacatcgtccagtgtgttcacaacaaggaacacacgcacgaccctgcctgagcgaggtgttcatgtgctgaaatcaggactgctgagtcgccagcacgacccacctgaggcaggaggctgaggtgaccaaaagcttctggtcagaagaactacctggcagggctctggtcctggctctactgctgatctgctgtgtgaccttggccaagtcaccaccctctctgggcctccaggtccttgtctacatacttgcagaggctagcccaggcctcaccatgtgtgactgcctcatcacaccagcaatcccagcagctctcgctcaggctccatgctgccttgtccaccagagtttctgagttcctgaatcagcctaacagtgttttgacatcttcactcacatcttgaaaaacgctggggttcctccagttccttctgggagaagcagctacagccatgttgccaaggcgcctttataaaaagccatcacacaatgacaaccccacagactgattccctctccagtggcatctcccttacctgtaacccaatacctaccgggaccttaaagaagctgagaaggggccactaccccaaccttggaaatgaagctctggccacaggcactgcatcaggaacgcaccaggccctacttcctccacatgacggtggaacggggagccagtgcttgcctgtccaggagggcaggggctggcgtgtgcattctcctcctcttcgtctctggctagtgggtttttgtgggaaatgagaaggatgcccctgaagggtacctagatcctgcctgttttgcaaagttccaaataatattctagaaactctgtatggctttcttgactagcctcaaaacagagaaaagaaatgcatctcctggacttctggaaggaagggggtttgagtctattcccctgcccccacccaaactcagctcatagaagaggtggatagaccatcaaaggcagggagggaggcaaacagcctgtgaccctgaggatgaatgatatactttttttaaagggctgttcaaggcagacacattaagaaggctgcacatttatctttctgacattttaaaatatgctgcaaaaagctgaatcttaaatcaaggtgcatttttaaaggcatgttagatcagggacaaaacctcttcctttcttccttcaaggagcatgcctgctgtgaagcaaggattactgcatgtgacagtcccagcctcctgcacaatcaatactgattgtgtactgggaggaggcaggatggcctgccaggctggggcttgcaacaacaagagggcccactgtcaggcctctgccacctgcctgtgcttggtccagggccccaggctacaggggaggtgagcaagcctcaaggagactataggctctgcaagggtcaccagaaaaggacattttcctgatctaattcagggatctccctccccatcaactgttccaagttacacaatcacaggcagggagcccccagcttcttgggaatctggatgccatggcagcaaatgttcaatacaaaacagcggcccagccgctcccctccctgagaaatgggggaggggacaagcctggttggctgtccttctcaccccacaattcatcttgggctgctagggctggagtacggaggggagaggaacactggactgcttttgggtagattttggtcaatacccagtagctggaaggagagcttccaacataacaccaaggagaccacgcatcccagactttgcacgttcacacctggcgccccaccatactgatgaatagcactgcctggttataaaagtatcctggttgggatattatatggtcccctaatacatacacacaagagccttgagcccaagaacaaaacggacctgcatggatcccccgcacaggcagcccccaaagcagagaaggcaggcctgaaaatcaacctgagccagaaggaaatctgggccaaactgaaaaaaacgcaaacatcaatcaacgtgattaccaccagcaaggagggaggaccagcccaaagggcactggttccgggcacatgaggactgctggtgaccaagagggaggcatgaatggcttcccttaacagaggctcaagtagtggttcagggaggagcaaatactgtgcccagggagtcacctggcctggccccctacacctccacggccatccattcccattttattcatccttatggctataccaagttctttctggcattgagtgtaaaattctactatgaatccaccgcctagcagtccctgggggcaaaccagagcaagggcgaccgctttgttcacaggagtccctccccaccaccagtacaccctaggttcctcatgcacatccctctgatggaggtacccagcactgtctgcctgtcacctgcaaggtgaggacacgggctctacctgctgacacagcccaaatctcaacgctccaaccttgtgcagtcaaaaaaaaatccctttcagagcctaactctcaaggacacaaccagcccagaaatctcccaggacaggatcccacccacgtcaaaaccaggcagcaaagagacacccttaacagatcgccaacgcaggccaccctgaagtccgtgctacctcctgagcacaccaccgtgggtgcagatcactgctcctggtgccagggagcagggatcccccaatgcatgattcggcagagcctggaagtaatgaagaaatggctaatgacagccactgaaggcactgttaaatggcttattacattttgtaaagaaaaatacatcaacatccatcattgcaaacactttagtacacagaaagcccttcaaaatttccttcttctaagtagaaataaaggtttatacatgtgtatgccacataaacatatgccccgatataataacctccgcatgtaacgtcctctatatagaaagaagcacaggtatatgcctggctggagagacaaaggcgcattgtctggacacagtcactcagtattacagaagtgtgtgcatgcacacacacactccctcagaccagatgcccaaccacttccagatgctacagtctcggatatccttggttaaggaagaggaagaaaaagctcgcccttcacgtccagatacttgggttcgggttacatgaaacaggattagttcagaaaatcgtgccacttcacagccaagacaaaaacccaagaatgaaaaccatgtatacagccaacacaatagcaagactgaagacagtgacaaagagagttttctggttctgctctgatgcctctccctccacaccacacctgtgatctactgtgcataggatctcacaggcccaataacagagctggagttcctcttacgtgacacaggatttggcatttgcctgtgccgggctatcactcctgccctgcaacacgctggtcagctggagaagcctgctgctcacacactcaccagcaacttctctaccctggatggtcaccaaaaaggaagagcaatgtctgtgcccccagcattggtgcaaaggaagtggcagagaagcaacaaggagggtggtgccttgccccaactgcccgccagcacccacagccaaggcaactgttctctggtgaaggcagagctggaaatgcatgcctgagcctcctaacacagggtctttcccaccagtccatgtcatctgcccttcccaacagcttccaacaacaggtcagtgtggctcttgctccctttcatgaaaatcaccagccacagacctgtgcagggctgcaaggtcactggaggttatcaagtccgaatcatcttatctcccagatgagaaaccagggctcagaaaggttgaaggacttgcccaaggtcgcacagctcctaagtgaagggctgagagtggattccaggctgcctagccaaagcctgtgagccttcccctcagttccagctgttgctattagctcccaggaggcaaggggggtggcaaatagaataatcagatactggcaaccaaggaaggtggcaggagcagtaggtgaaaggactcccacatggcagtcacagatacacgcatcagccctgcaggagaggcagcaacagtaagtgagatgcaaggaaactaaaagtggagcagggagctgctgggaggggtgggagtgtggagaggatgatgtgggatctggagccaggagacctgagtctagtcccagccaccttgaatgcctcagccaggtcaagctgcccatctggctgcattgtttcatctgtaaatgaaagggctgggcagaagagatcatctttccaaacccccctggccccagtcactagggcctgactatagctttggcccacatttgctagctatgtggcctctaagaagtcacttcaccttcctgtgcctccactccctaaccagagccaaggaagtgacacgctcccaggggtccttgacaagagctccaaaaaggccacataagcctaaggcatccctctgtctgccctggcttagggagaaagataaaaaaaacggacttgctcccttgtcccacagccaaagctgccactcaacaagggccctgagagggcgtcaagcgcatcagagagtcagattcagtgcccacaggggaccagaggggacaagtaaagtgtgtcactgctggcactcgggtcaggaggggagtaagcaaacatgcacgcacacacacgcgcgagcacacacacacgcgtgcgcctcctcccacgcagcattgttcccctgtgtcactgtcagcagttctgctgcgcttgacaaccagggcttcctaatagggccaggctggacctggcaaacacctggtcacttcccctcctgtggtccgcagggaccatcaccactgaacacaccactgcttgggggtggggaatgtccaggaaagctgaccttgtcctcaacaaagccctgggagccagccagctacgtgggtgtgcctggagaccttgcataccccacagaatacggaaaggattttcataacctcatagactctcgggagagaagatggtctcctgcatcctcccgcctcctctgcctattcctggccatttggtgtgcagagtcaggagagcagatgcctctcccatttatacagccatgctcaggctgtagctctgccctggatccaaacaggacagccatcatcctgccaaaaaacaccgtcagatttctcaccaccccaacccacctgactctccgtaaggctgcatggcctggtaattaaaaacttcaacaggccaggcatggtggcccacgcctgtaaatcccagcactttgggaggctgagggaacatagtgagaccccgtttctacataacaaaaccaaaatcaaagaactccaagacaggctatctgggtttaaatcccagctctgccacgtataagctgtatcatcttgggcaactgacttaccctctctgtgtctcagttttctcatctgtaaaacagagataataatggaggtgatacatgtaactgtttagaatggtgcctggtacacagtgagggccatataaaagtcaaatgtagccaggcacagagccttgcacctgtaatcccagcttctacggcagctgaggcaagaggatcacctgagcccaggagtttgagaccagcctgggcaacaaagcaagatcctatctatataaagtattttaaaactaggcaggcatggtgatgtgttgtctgctactcagagactgagatggaaggatcacttgagcccaggagtttgaggctgcagtgagttctaatcataccactgcactccagcttgggagacagagcaagaccctctctcaaaaataaataaaataggcctggcgtggtggcttatgcccataatcccagcactttgggaggccgaggcgggcggatcacgaggtcaagctattgagaccatcctggccaacatggtgaaaccctgtctctactaaaaatacaaaaattagctgggcgtggtggtgcgtgcctgtagttccagctactcaggaggctgaggcaggagaatcacttgaacccgggaggcggaggttgaagtgagctgagattgggccactgcactccagcctgggcaacagagcaagactccctctcaataaataaataaataaataaatttcaaaaataaacaaataaaatacaagtcagatgttataaagactctgccagcaagctaaatgctgtcatttccttcagtgtttctccattccaaatctctaccatctacggacccactcattagctccaaatggcacaggctctgagtctgacctggattacagttggtcccgccactttcttgcagtttaacattggtcaagtaacttaacctctccaagccagggtctcctcttccaaaataggaggatcatatgacctacctcaaaggatggttttaagaatggaagaataatgcatgtaaagtacctagctattaggatgaattattaacaataacaacatcatctttctccttgcggacatgatacctgtgcagtgagcctgtattactctctttcagtgatggccaactgctgccacacagagccgactggcagctacattcaagggccactttctcacttgccgttcaaatgaatcttcttcatcctgtgcctgtgaagttgatttttttgaacccacattgtaggactttacatttatgcctattaaatttcatcctgttgttttggacctggaaatgggaataggaggctgaactaataagctctgactcaagcagcacagaggcactgccccgggaagagctgcaacccccaggaaaggacaagggcctagaggagccaggctctcagaactaaggtgacagccacagctgtgagggcctcagccagctctgccctttgtttgcccaacacccggacacaagaatcagctcttgttaccagaatcccatcaagaagggcaaagcactacgctttcaaaaataaagccacatgtgcaaactgttgtcataaacatagccctgttcaaggcctccgctgcattcctccttggagagcaatatgtttcatttcttcaacataaacagaatcagatttattacattccgacaatgtttctaggatggggactgagaaagctgcatttctgggaacaaaaggcacttgtgcataagtgtgcaaagaaaaaggagacaagagacaaaaaccaccttccagactctgggccccggcaactgtgatccatgtcaagaaccctcatgcaatctgccctgcatggctggcagagacagcaggagacagaggctgatttaaggctagggctgaagatcatgtgtccggccagacttaccacaggctgccatgggccccagagtttcacaacatttaaagtctatctccccggtgcccaaacacatcgattcaaggaaacctccctgagaccgagaggcccaaaaaggcgcaaggctcatttctgcctgtcctcaggagccagggaggcacgcacaatcccgtaagacaagcactctgatccctggaaggtgtcagagaaacagcaaggggctgggttctcactcaaatggtcagctcttgtcgcttctcccaggctggacaaggcagcaacgcagaggaattcctggggaatccaggcaggaaaaggaagtagctgggggaagggcaggagaaataagtctcgcaagggaggattaagagcaggagccaagatgatgtcacaggacaagcatgggcactggagccagagagatgggcgccaattccagctttaccgcttcctgtgtggcttcgaccgattacttaacctctctgagcttcagctactacatctgcagaaagaagggaataaacagaaccatctctaaagttcttctagcactggcactctggattcttagccagggacttctgtacctctgatgggcataacttcttaaacttctaactatccattccagaaagactataatccagtgggctatcctgtttccttttacccactgggtctctgcagtaagcagggcaaatatgagatgggattaaatggatgctgactaacatggccccccacgttgggggactcaccggaaatcttcctgaagccctcagaggccccagcccccgactgcctctcctccttccctccttttctccttccctcacaacactaattgggagggactgcattcaattcctgcccattctcggtgagcatccctggctcccatgcacacgcaggtggggaggggagagccagcactgtccagagcctcccaagcccacggagccaatgggctccaagcagatgcccccaggccctgtacagatgggcctggttcagcagcttttcaaagtcaacagagtaaggttttcaaatcctaaaaggcttctcaagcctcttctaatctgtctgccattttgttttgtctgctcagcgcaagtcaaggggaacttgacatttggaatactaactgcaaataatcccacaccaaggacagggctttggcgtgctgcagcatcagcatgtggctcacaaggatgctggggacactcgagctatatgcagagggtcccagaaggcacacgttaggtcaggcccctcagccacgtgcgtggtaaccaccctgaatagccagctccccaaggacagggctgagcccaattcactggcttcctcaacatcatgcccagggtgtgacagaggggaggtcccgcgcagaatctactctggatggaggaatgcacacagaggtggagggggaaagcatgtgcaactggtatcttgacagctctcaacgtcagcctctgccccaagccaaccaagcaaagtgcgctgccgcaggtgagacacactgcttctctgggcttccgctgtcttctcttccttccactttgtgacagttactggctccccagttgaccttcacagtggaatcggccagcaacctcttcactctggccacacacctccacccaccccaacggttcacagggcacacaggcaggcctcatgaccatcccagcctcacacacactcaggtggcacagtgcatgagccaggccaggacctggtgttgcagaagctggtttaacccttgctttgcaataacccaccctggcctgccctctcaaggaagaggcgcagggatcttagggcaggctttgtgctgctgaggctgttctcgctccagtctctgacttcaagcagcaaaaggttggctgaaccaaagcattttgttttcctcaagcttttttttttttttttttttttttttttttgagatggagtctcagtctgttgcccaggctggagtgcagtggcaccatctccgctcactgcaacctccctccgtctcccgggttccagcgattcccttgcctcatgagtagctgggactacaggcatccaccaccacacccgactaatttttgtatttttagtagagacagagtttcaccatgttggccaggctggtcttgaactcctgacctcaggtgatcacctgccttggcctcccaaagggctgggatgataggcgtgggccaccatgcccggcctcctcaaactttttgaagacagtgagttttttgggcataaaaaataaaatctggctgagcatggtggctcacgtctgtaaccccaaaactctgggaggccaaggcagggggatcacttgagcccagtagttcaagaccaacctggacaacataatgagacccccatctctatcttttaatttatttttgaaaaataatgagaataaagtcccaggccgactgagaaataaaatgagatataatgattgtaaccatccatgacatcatgtgtgtatattacactcaacagcaactaaaccggaagtgcttctccagtttgtgaagccagcttctgcactcactgcctgctccaggaagttgcctgtgactgcccctgtggtccaggtgtccctctcctgtgttcacagcctcggtgcccctactgcaatggggctgcatagccggcacctacggcagggcgggctgatatgcttgccttgcatatgctaaagcgaatgtttatttttccatttccccaactagactgtaaaatccttgagggacaataccttattctactttactttgcaaatacctgggaaaagatctagcatgtatctcacactgaaaaaccatctgttgaataaataaccaaagtgatgagcacatggctgcccgcctatgcttcccgccctctcactcccgacccctaaccccactttctccacccgctagaagcattctgaagagaatggaaaatctcagccaactattcagggtaactgtccggtcactctgcgtccatttgcctttacggcaatatatatactaaagggtatgagctcaagtttccatacatacccaggcagccaagggagttctctcttcccagccgaggctaaacagggacccaaccacaagcatccagtaattctgaatatgacgtgaacaacgtaaaaatagctcctgtatctctttgcccccacccttctccccaacaacacaaagggcagaagagagtgacacccctaacaaacagccccagcctcctacatctggaccagctgctgtgagccaacagggtattctaaattatactttaattaccataatttttcacaggtacctgaaaccagatcatgacgacggtgcaagaaatccccaaataggatgcacgaggtccaagttaaagctagtcttctaaacacacaccttttctcacatgccttttatttcatgtagcactttacagtctgcagagtgctttcatgggccttctctctcccacaggctctggattaagacaacatggttcaattccagcctccaaagtatcctgccctctccagagacccttcacctatcaccatttggtgcaatctgtaacagaaaaaaaaagaaaaagaaaaagaataggaaatgggggagaagggggtcttatcttatcccatgggttactaggaatgttaaggattaaatggaaagcatagttaagatttttaaagagaaagcacttattgaggataattgatgctggacagatagcagattcttggcagacacacattctcagtgtggatgtgtctatacagctaatggttagaagcgtgagctctgaaattaatctgcttagatttgaatcctgtctgcaacattttagctatggggccttgggcctcagtttcatcaaccagaaaacaggaatgatagcagtaattacttcacaggctcttgcggagttcatgaaataaatgcgagtaaaatactagcctagccctagcacatagtaaccactaaaaaaaaaaacatcattgcaggagaggggaatctctagtgccttaagaaaggggaaagatcagccgggcatggtggctcacacctataatcctagcactttgggaggctgaggcaggtagttcacctgaggtcaggagttcgagaccagcctggccaagatggcgaaaccccatctctactaaaaatacaaaaattagccgggcatgttggcgggcgcctgtaattccagctacttgggaggctgagggtaggagaattgcttgaaccaaaggggcggaggttgcagtgagctgagatcgtgccacttcactccagcacgggcaaaaaagcaaaactccatcaaagaaagaaagaaaagaaagaacgaaaggggaaaggcggaaaggtcaaacataaacttcagcatcatatactaatgctggaagggagggtggggtaggagcaggaccccatgcttctctggctctacttctttcttaacacacctttcttcccccacctagaggataagcgccttcaaggaaggcatttgctttttggtaagctctcaggtccctgacatgtgacttggcataaaactttggttcagtcaatatttacaaaattaattgaacaaattaattttatctctcttgcctctgtgcattccagatatcaaaaagaaacaccctgcacaaagaaagtcctctaaaggtagcttgtctcttttcggctgcagtaatatttgcaaagggagtcggtatccccgcatatgccaaagtgccaacccaccaatgtggtgtttgctgccattgagagccagaggtgcttccttgtagaggctcaggggttctgctctccagagatgtgagcagcttcaagcccacccatctccccaagttgtgggcatatgcctgtccaggggtggcagggagggagggacaaaagggccaagtggctcccgtgaaaccccaaaagcaagtccacgcacagcaaggagaaatgagtacacactttatttttagccacgcatgatggaaagttactctgggaatggtgcaaattttgcttcatcaccctcggtacctttccaggatcctcagtggcttcccagggaaatgactgataaggggacaaaggaatttctgaggttctttcagaggtggagaggcaggagacagaaacgacgtaaaacaaggttggggagaaaaaatggactccatgaacacccaggacactcccataccagcccagagggctgcaggctcctacaagtaggtacagccccactggctaagaggaggcagaaggtccccaccagagccaatccaagaaacaaggctgtcattccactccaccctgctggaaagcagggcagtggaaagaaccaggctatggaatcaggaacatctgaatttcaatcccacctctgctgtgttttgagaccagcaacttaagttcctcaagcctccattccctcctctgtaaatcggtgctgccaaactgagtcgctctccaggccagtgaaacaatgtctgcatagtaagccggctggcacctggtgctggattaactctctttccgcaattaaactgaggctcaagtagaggtctcccaaggccctactgttgtgtggtcttggcaaagtgctttctgttctctaggctccacgtctttccacctaccaagacaacatgttggcagagacctttcaaggtccctgcctgttctgggatgctgctaagcaccctggccttgtggactgctggccagacgtctcccctttaatgtgttgggggctccactctgaagccatatcctgacctcacagtgggcccataccttgagaaaccttaaaaaattacagtgatttctgattataatgtttatttccttgccttcacccaaactgcatccatgggccaaagagaatagatgccgacctgccatccattcattccacaaggatttactgagctcccatggtagtaagtgctgtgctgggcaaggatgaccaagggcaaaagtgaacaggacagtaaagaggatagcccagtccttaccttcccagagcttaattgctacctgccgtaaaatatgttaattcctttattatggttgtggaggaaacatgtaccctaaaacttaaagtataatgattgaaaaaaaaaaaaagaagtcctgggagccaagtgggtacatgacaggaggcctgacccagccagcgggccggacagggtccctaggaagtaccctgtaggctgaggtctgaaaaatgagcaggtactaacctggagagcagggagagagagagggggagagaagcaccttccacgcagaaggaacagcatgtgcaaaggccagtacctggcacttctgagaaaccaaaagaagcccaatgtggctggagggcaaagagggaggaggctggagggcaaagttgtccaagtcagggctacgaaggcaggctttcaaaatgcggactgacaccacactgtgtaaggccacgcgcagagggatttcctggaatgtctggatctgggcaaagtttccctgcggagagcaccaggagaggtactgatggcccaaggcacaggaaagcagcgcagcccaggctgcagagtccaggcatccaggtctggaactggaaggtacttcgcaaagtgccctcctcaaatgccctttccattttccaaagggtttgctccactcctgcccccacgcccacttgtttcacttcttatttttatttgtttttaaaccagggccttcttacggtcaggttaatgcatttttaaaaagaaagccctgaatgtgtggccctccctccctgggaggagatgggtggatcaatagccctcttagctcttcctctaccaccagcagtgaccagagcagtgggtggggccagggcaggtgtgggctctctgcaaagtgggcctgagagccaggcatttatgccttccctccccaccccctcccattcccaggcaaggcctcccacaccctgtccttcaccacctaccgtggtaaagcccaggaacaaaagggacagactgggggaaggcagagaacactgggcaatctaaaaacccaagttcaatctctgctgctcagcctcttagcagccttgaaaccttggacaagaaagaagctaacctccctgaacctcagtattcttaagtaaaacgtggggatctgtgtaaaaattatgtgaggtcatgcggaaaggcacctggcacaccctgggcaggacccttccccgagtctcccacaccccagccctctggatccactctgttatcacagacccttctgctgcctcccctcccagtgagctgacacgctttgagcttcctcaagggaaaacgctccccgatgccgacagatggggagtcctaaaatacagcgtatggatcatgtttcgtgactagcaaaacacgccagccgggacactttgagaacccggccggttttcaggaacaggattttacacatttcccaggattggcggatctgcgctcgcctccacccgcctgcgagctccatagcccggatcctgtaccagggggatacttaggacaggtggggggaagaggggaggctgtgccctaaccctctgccgcttttcatattgctactaccatttatgtattgaacacgtgatacattcctcgctgcgtgtcaggtgtttggcatgtgttctgaagccaccctgcctaggtccccatcctggatctaactgtacggccctggacaagtcacttcatctctctgagcttcactttgctcatctgtgaacaggggtggtagtaccttcccctcatggggccagggtggggactgggtgaacaacatcagagctcagtagacatgaactgctgctataatcaaaccacacggtgactatcactgtagctatcctactgaaggtaaaacggacactaagaggccatgccagctgtccaggccacccagtggcaggggagcaggtctgcctctgaaggggatcagggatgggcttcagagggtttgcaaaccccaacccctggccttatggcgcacaattatttgaatacatgtgaatgtgcagtgttcagagaggagggcaatgaatttcagtctcccaggtatctacggccccataaaggttacaaaccatggcttcatataactatatctacttgacacacataaggtcaccctggcacagcagtcctgaactctaggatctggagcaaggattacaccccaccccgtctacccaaaggaaagacattggttcttggcaacatcaatcacaaaaagctttggaccaggagaaggggctaggagagccactagcagggaagtgtgttaacacaggttccggaattttagaagaggacatgcaactcaagaaactgaggaagagtagtctgtacttccatgggatccaagaagacccgaaggagaaaaagaagagatggtgggaagctcagtacctggcaactgaggtagcacctgggggtgcggggcatgatggccaagaggtgcccctgattagacacctgggctcagtcactccagtggactgacattaccctactggacttgagcttgtaagggcagagaaacgttgaggaaaaaaaaagtcacaccaagacatgaatcaggatatgaacaatattaatctttgagaagtggaattaccagagttttgtttacgtttattatctaatttccttcacagtgaacatatatcatatacatccactggaaagaagacacaaaaccaatctacttacaaagacagctatgcactgcacacagtcttggcataataaatacttgtgcttctgcccaaagtaggctcttgaagcccccttttgagaatgaatgattcaagccactcccagaaaaggtatcattttgggaatagagaatggggtgattcgaatatgttcaagacacttctgtgggtgattcatttaggggcataaagatgggctctgcttccccgtgatgactgctggggcagctaatcccatcacctcttaacacactcggtgtcgtcagtacaggcaaggccttgtaaagagaggaaagaattgggggaaacatccgatcaatctttttttctgtttttgtgggtgggaagaaaggagcaaagagatgagagatagcaacagagaacaggttctcaggttgggtggttcacacttgtaatcccaatgctttgggaggccaaagcaggaggatcacttcagctcaggagttcgagaccagcctaggcaatacagcaagacattgtctcaaattaaaaagaaagaaattaacacaacaaggtctcccactgcttgagcgcgtcgctggcagacagtgcccattagtccacgtgcgtacagctgtaaattgcatttggtgcgtgtggtttttcctcacagcactgaggagacgtataattcagacttcctatttatattacacttgtttcctccaatacaatggctacaaatgctttctactccactcctgtcatctgtgcggaaattctcctgatacacggggagactagaaagttacaagagttctcgtgcgtggccagcaggctcagtctcagttctctctgctcggatgggaaacttctgcaagggaagaaaaagggctgaacccagccgttagaaactaacttacacttggcttcttcatgcttatccactgcagaaacacaggagcccccataaaaaacatccttattgacactacgcaatatttgcccttccaataaaacagttcccagctaccaaggcagcctggaagagaggacaccaagagccgcactctaaaaaccacccgagtctcagccctcccatccagggaaaagaccaaggcactggaagaacctctaagcccatggtcccagctcctttccccacaccttccttcagagagaaggaagagtaatctcacctgagccagctggcctcaaaagtaatagggcagaaaagaaaagccttccgcatttcaaaggccctctctgaagtgcttgcatgaacatctccttttaagatttcctttaaaatccttggtttccacagaagtaactagcgtctcaccccaaacgccaagcaaagtctctgtgcctgaccaagccctgaccatggcacagagcagattcctaacagaagattactgtactgaggctgggcgcggtggcttacacctgtaatcctggaggctgaggcgggcagattgcctgagctcaggagtttgagaccagcctgggcaacacggtgaaaccctgtctctaccaaaatacaaaaaattaggctgggcacggtggctcacgcctgtaattccagcactttgggaggccgacgcgggtggatcacttgaggtcaggagttcgagaccagcctggccaacatggtgaaaccccgtctccacaaaaatacaaaaaaaaaaaaacaaaacaaaaacaattagccaagtgtggcagcacacgcctgtactcccatctactcaggaggctgagacaggagaatcgcttgaactcaagaggcagaggttgcagtgagctgagatcgtgccattgcactccagccgtgtgacagagtaagacttcatctcaaaaaaaaaaaaaattagccaggcgcggcaccatgtgcttgtagtaccatctactcaggaggctaaggcaggagaattgcttgaacctgggaggcagaagttgcagtgagcctagatcgggccactgcactccagcctgggtgacacagctagactccatctccaaaaaaaaaaaaaaaattactgtactgactaaagttacagagtagattaagatctttaggtccccttgtaacaggaatttgaattttgatttggggcctggcactgtcaccctatgctgggggttgaattgtgtacctccaaaagatatgctcaactcctacccccagtacctgtgaatgggctcttatttagaaatacagtctcctggctaggcgcggtggctcacacctgtaatcccaacactttgggaggccaaggcgggtggatcacgaggtcaggagatcgagaccatcctgactgacacggtgaaaccccatctctactaaaaatacaaaaaaattggccgggcatggtcgtgggcacctgtagtcccagctacttgggaggctgaggcaggagaatggcgtgaacccgggaggcggagcttgcagtgagccgagattgcaccactgcactctagcctgggcaatagagtgagactccatctcaaggaaaaaaaaaaaaaaatagaaatacagtctcctatggcagccttgggggattgggtccaggcccttactccccaaccccacctcacagataccaaaatcctcggatgcttgagtcctttacataaaatggcagagtgcacacacatcctcccatatacattttaaaatttttttcagacactgcaccaggctggagtgcagtggagtgatcacagctcactgcatccttggactcctgggatcaagcaatcctcctgcctcagcctcccaagtaactgggactgcaggcatacaccaccacacccagctaatttatttatttaatttttacatagagatggggtctcactatgttaaccaagccagtcttgaattcctgacttcaagcaaccctcccaccttggcctcccaaagtactggggttagaggtgtgagccaccgtgcccagccctcctatatactttaaatcatctctgggttacttataatatctaatacaatataaatactaggtaaatagttgttaggctgttttttaatttgtcccctttttaaaaaaaaaaaaaaaagatggggtcttgctatattgcccaggctggtcttgaactactagcctcaaacaatcctcccaccttagcctcccacagtgctgggattacaggcattagtcactacaccaggcctgtattctttttgttggtttgtttcccctgaatatttttgattactgaatccgcaaatgctggctgaacctgcagatgtggaaggccgattctacatccttttgcaagtatcacttagcaaaaatgaggtgatattggattagggtgggtcctgatgcaatgactggtatccatatgaaatgaggggaatataaaatgagatgcacagggaggtgccatgtgatggcagaggcagagattggagtcctaggggccaaggaatgccaaggattgcagcaacgctggaagataagagaaaggcatgggcagatgctcctctagaaccttcagagggcatggccctgcgggcaccttcctcgtgaactttcagcctccagaacattgagactaagtttctgttgtttaaagccacctagtttgtggtactttgttactgcgtctagaaaactaacaggtctggaaatcattcactccaaggctctcaacactctcagccacccaatcacccacccctttcctcactgtgtgcactgttgccacttcaggattatatgactccgtgcaaccaaccacgaccttctgcaaacaccatccggagaggtcagagtccccatatccatctggggacagagacacaaagtcatctttatcgggtggcggactctgcccctcagtccgccaactgagaaccgccaaggaaagtctgaggtaacccacaaggtttgggaaatagaaggcatggggggcgggggggggggggcgggtgaggacaggtggaaattagcagagagtgggcagaaagaaagagaaaaaggaaaaggttcaaaaaggagcctgcgggtcaagaggacacacaagcaacaacaggaagtagacatcctcctgccttgccccctcagccagtcacatgcttctaactttctccctcacacacctgaggtctgcctgggacagcctccaacagcctgccaaacaggtgacacccagagcactggctacccacacagctgccgcacttcaagctcccacagtgagaataccagcccacttccgtccaggggttgggctttatttgttttggatttccaataccggggacttgctggggccaagtcaatactggaaggccaaggagatggctgggcagatagatgtggtgcaaggttctacacgctgcctcacctgtgccagcttagggtctgtggtcatggggcagcggggcagatgcatcccactcacttccccaccatagatacagctcagatggaggcaccaatgtgcctggaagagcaaggccaaggccttggaagtgagttcacagggctgcggaagtgagtggcctctaaatctcacctcctctccttgctctggcactcacctacactcaaggcaagtcacaaaattaggccggtaaagcctgggagaggtagcctagtgtcttgttgagagccagaaccaggctaaaaacccagcccgatgaccagcaagctgctgctcttcacccattcgacaagaaacaggtaagcacctacccattatgtgttctcagcagcctcgtctgcaaagataagatgacaattacctgtctgaacaaagctcttctgaggatggaacatgattaacaaatataaaacacccagcataatgttgggcacatcaaaaagagccactatggaggagagattagaattattagggtcatatcttccaacccagagcttgagacccaaccaggtctctgtaccatccaccagcatgtcagctccacaaggtaggcagggatattcctctgctgttccctgcggcattcccagcacctacagcggtgcctggcacacagtaggcacccaaatgtttgtttgttatgtgagcaaaacaactgccgggcatccaatgcccttaaggttagatgcagaaatatcaaaactgcatgatacactgaccatcttggggacagaagagcatactatgaagttatgaaacaagcagccttggcccatatcctgggaacaaaaggctactggttccccccaaatgaagccaaaatcaaagaggagaccagcacagagctccctcaggcttcagccttgaaaaggcatgttggcttttacaggaagcaggtaagggtttagccatgccaccttagtttcgctcatgaaatgatggctgggggtcacaagaggtgggtatccaatgaggaaacagtgtggatgggccaaaaaaaaaaaaaatcaaaatcattattttacagatatctttttcaagaaatgcctcccgcttcagctgggattcatagccatttcatcttttaactttcctctcctctcctcatttccattttaggttcaaccttacctggcgagtgtcctggaatacataacacaaattgctggcaatctggagcccctggtacatctcccacctggggtccctttagcctctgctgttggctgtcatttgaacccttctgccccaaattaaaccgctctaaaccccaaccctgggtacttaaccagaaatgcctctaccatttccacctctattggctgtgcctcacctgccacgccaacctgggactatgaaaacccaccaagatatattaagtaggagcatccacgtgaaaaggcatctcagcagagtgacagtgtgaagatctgggaagctgaagccttcaccgctgcttccttttaggtggtgacctgagaacaggttgcttacactttctgagccccaactgtgccatccataaaaatgggcaaaataataatagtgcctcccaacagggttgctgtagagacaaaacacaagagcagcccctgaatgcttctttttgaaagtgcggaacaagcgctgttactaggaactctagtctcctttctcatccgtggaagaggtacaagctagaaaactgtgccaagcacaaggcagccctgcaaagcagaagtagtcctgtttttctcaagtgattaacaggtccaagaaaggctgtggtgagatttacgagggccacagccaagagagatttatacgcgtatggccttcagatggttttctaagacatgtgcacaacccgggtttggctgaggagctcagcagcaagtaattttctaattgattcattagcactccaatcaactactactttagacacaaaggccttgcttgggtctgaatgtctcagcctgggaagctgagctgaataaaccattcttgccctgggggcagcagcagcccagggacaggcaggagaacccacaccatgaccatccaaaaatcatatcaacgtgtaaataaactcaagagtctggacacagaaatagaacccgcacagcttctcagatgcttttttttttgagacagggtctcattctgtcaccaatgctggagtgcagtggtgcaatcatagcctcaacctcctggactcagcaatcctccaacctcagcctcctgagtaggtgagactacaggcacgtgccgccaagcccagctaatctttttgtattttttgtagagatgggggtctcgctatgttgcccaggctggtctcgaactcctagctcaagcaatctgcccacctcggcctcccaaagtgctggcataacaagtgtgagccaccgtgcccagccttaaatgctattttttataatgagaattttctgaccagaagaagatgatgtgaaaaaagtaaagtaaaagtaggaaaacagcctgaaaagaaatactcgaaaagttagcacaaagttagtcctggtggtgggtgactttcttttcttccttcctcctacttttcaaaatgaacgagtacagaacacataacttcttctgttctctcaggtataaaatggcagcaattataccccattcccaaggttaccggaaggatgaaattagattatgtatgaaacaggcagagcctgaagagccgggggtgccagaaaggctgacccaccatatcagtgactcacgggcccacctacctcctgggccaaaattcaagttatgctcaggaaggttataaatgactccagtcacttatgaattgttgaggccacaaatgctaaaagtcacagatctcaagagtaatgttatgataatctaaatataaatgaaactttaacaacaatcttccttcatcttttcatgttcctctggcgtgtgggatattcacctaagacagggttcctcaacaggccaagctagcagggatgaacctctagcagattactcccacggagtgacctcgctgggcctttatgggagcccctgttttgggaccggcttgctgcctgtacaccagctgtagaaacatccccagtgccatctgggaaggactcctgactcgatctggcccagctcagcacgctgcctatctatccatccacccacccatccaaacatctgtatgtttattctccagaaggagctcctggtgagctaaagagcagtgtgaactccagcaaaccaacaggcttccacagcatggaaggcaaaacacatgaagacccccgatcttggccaggcctggtggcgcatgcctgtagtcccagctacttgggaggtcgaggcaggaggatcccttgaagccaggagtttaagacctaactgggcaatatagtgagaccctatctctacaaaacaaacaacaacaacaaccaaaccccacccccgccccccaaaaaaaacagtcccctcagtctgaagagccttgggctagacacggctcagggtacataaaaggaccaaaagcctaaaacttcggaagcagcacaaggtgccttaggaagcttgatagaactgattcaagtcctacttcacctagcagggaattaccttgttatcctactaagtggcaatctccagagaggccaaatggatccaaacttcttggctgactggtaaggtggcttcttcaagtgacttctccataaaacacccctgaggaaccttctgtcagaaacggtccccactgggtcatcccacttcctatgaggcttcatctcagcttcaaaccccttcctcccctgccttcacctcccagcctccagaagagaaagtcatccatatggggtcttactatagtaatgttaatggaacaaggcaaggggagggcgggatggccgtcatctcatgagcctcaccttgcaggatgtgcagcaggaagaagctgcgtcttgccgtttgaccatgcgagcatctagcgtgatcagcactgtgctcactgccatcatcaatgctaacagaaacgtgcagacaacacaaaacctcagaactcccatctcaatcaactgctcggaaacttcaatctgagagtaaactgtcatgtttttcccactctaaaacaggatgactaatgacagaggaacctcaacacaatccatggggctcaagccagatccctctcaacagagcacaaaagccacccagtcccaaaaaatgtgagccgacgccgggcccctcaacggattctgaatggcaaacccgagaactgcaggagagacaggaggcagtaggtgacgcggggaggcggcccgaccggacagcgccgtgtcctcagaccgtcatgccatccccttggtttcctcgcctgcacgggggctccagctgcaggcgctccctggacaggtccccacacacccctgccacagggaggacaactctcagagggccccagccagttttagagctggatacacaagtttgttttatttattttgcatctaacaaggccctgacactctaattggaatagggcagacccattctttccgtcgaaatcaggcccattgcgaggggaaaaactgcaggccaaaatccaagctgaaagggtaaactggaagatcacctctactttcagatcctacaggttccagaaaatcttcagctcaacacccccgctcctgccctgtgacttacacacatgtggccaggccatcctcagaagcttcagccttaaagatttttccctttgctcctctgagatgtatccactctgaaaaaccctgtgcaccctctatgctggccccaccaagtcaagatttctcccagaaggggaatgggagtgttttcaagtatccaggtgacccaggtgcattgtcagatcccaattctggccaccctctcacatgctccatggaagtcagagaaaaacaggcagggtcagaggctgctctcgagggctggcctgccccatcctactcatgctgcagcccagggcaaggggagtggcattcagcaaaccctgtggaactacactgaatggggcaaaattcacacaagccagataaaccctaaagccaccttctataccaagaaaccagtctgaggtccagcaatgcatagactctgctgagatctctctttccatccagacatgggctgagggactgagagggactgcagatgatcaggtcagcaccttcattctacagatgaggaggagactgcagcacagaggggactgactccccaaatcatacagggactagaaaccgaactggacccagatccagggctgtcagtgactgaccactcccccggctcagcaagagcactcctacatcccaatgctgcaccaggatgcccaacaaaagatgggactcccatttcactatctgcaacctgatcttatctagaaagcctggagccagcgcataccactgtctgcagactctacagccttacaaggctgcctgtctgctctgctttctgcagcatcagtgcacctcccagcccctcaaactcctacccatcaaaaccacatgccagcctttcccaggcacctgccacatgcagggcaggtggacagaccagcaatgacacggtacagtgaggcaagtctttccacccaatcccacaaaacataagccaatgctgggaccctcaatggactctgagggtcaccccactgaacggcaaacccgagaactacaggagagacacgaggcagtgggtgaagtggggaggtggccctgctggatcctagagccccaggagggtacacactaccactcttgtcatgtggttctcggcgttcacatctaacgtgggagcaaggaacttccacaaagacctgctgggcctctaacacacagacctctcccccaggagcttacaaccgagatggggagggggagtgagccacctgaagtcccagtaagtactctaagctcctctccagcccactccccgctccctcacaaatcccaggaacactaacctctccaggggaaagaaattcaaaaaacaagaaacccaggaagccaaccaatcggagatccctgtgaacctgggcctaatgtaacacacaactctgtgttaagacacggtgccttagggaggagtggacttcagaacacatcatctgtacatgccatctacccagcctgtggacttcccagtaattacagccaagagcaaaggggtagaaaagagaaaggtgaatgaaaaatcatgaatgcctcatgcctttccaaggccagaagactgcttactgccctcgacacaaggtccctctaaaaggaaggggagggtgaggctgggttgtttcctcctcctctcctgctcttgctttgaaggtccctcacacaatgggaggctctcaggccaggacaacggtgtgacctgccccttctctgcaatgcctgccacatgcggcgtccaacaaacgtctgatgagagaatgaatgagaccaggcactctctgtcctgttcctctctgtgctgggcacacagcagacatgaggctactgtgctcaactaagccgaatttctggacaatatctatctggagataaatacaagaggagggcaccaaccacagacattacagggagatctcccccaaatttattttacttatttattttttgagacagggtctcactctgtcgcccaggctggagtacagtggcacaatcttggctcactgtaacctctgccttctggttcaagcgattctcccgcctcaacttcccaagtagctgggagtacaggcacgtgccaccatgcgtgactaatttttgtatttttagtagaaacagggtttcaccatgttggccaggctggtctggaactcctggcctcaagtgatccacccggctcagcctcccgaagtgctgggattacaggtgttgagccaccgcgtccagcctctcccccaaattcagagagctcccctgcctcccaaatttaaggaggcttcttggaaaactaaaggagttatcttaaagtcctcctaaaaagccagtccctctttacgtgaggtggtgtttcaagaaggcggctattgtatgcaggagggcaaacccctgcgtacatccctctatccacacctcccgctttgtgcgaggggacacgatcccacgtgagggctcctggaacccagctccctctcctccgcccaccctgcctggccagaccccattaacgcagtgctcgtgccatcaacactgttgttttggaatgtgccagtaattctagtggcaggaacagcaagctttaagctcagcagagaaaccagctggagaggcagcctcatgaaataatgaaatgccaaaccaacccctacatcttctccagtctctcaggtcacctaccagattagaaggcctgttgctacggcaaccatatcttgcaagtgccggctgaacttccccataatttttaaccctttaactagctcggagagggtagcgtgcagatgagcccaaatcccggggagctggcctgctctaggtgcgtttttacaaattaaagcaagaaaaaagaaaaccagcagccagggggaggggtgaaagtccacagttgaacaaacagacacggtgcaaaggaaacgccgcacacttccacctttccttcccgccagcgccccaccaaacaacctgatcggccacggcgcagcaaacttttcacgcacctggcaactcccaagcgcaggagctgcaaaggagatgggaataaacaatggcaaaatggaactgtgcctgcccctcccggccaggccccgtgcccttgtgctacagaacagcgcgggcccttctgtgggaagcagaaggcggccgggagctaggcggcggggacagatggccacgcaggcactggcactttccagttgtctgatgggcgccgtctgccaaacaagccccccaccgcctcgcagccgctcccaccccaaacacagagcttaggagctgcaaagggagccgacatccaaagggggccaagcacgggtgccccaggagccgcttctccctccagcattctacccacatatctacaagtcatcgggtgtccactcgccttctctccatttcaggaagtcttcctccacccgccccacctgctttgtgctcagcaaccagcgttcaagagatcttcaaagaataaatgtagggactttcctcagcctcttggttttgacaagacagacttcataaaatcacacagacgcagagaaaggcctgacacagtctcaccgctgggggtagagcccctcacctcactccacatcttctgggtggagggaacagggctcacaggggtaacagaggcctatctggtttccccagagaatcaaggaaaggcccctaggaagggagggagggaagacaggaagagaggtctgagtccccagtgagaggagacagaaggccaaaggggctaggaggggaagggagaaaaggaaaaaggcagtgcgagtgaggaaggcagccaggcaacctgggacgctaattaaaggctttgcagcaatcgtgactgcctaacacagtggcccagggtgggcactcgacaaatgaggccaccctgctacacacagatccacacccccactcctgacaaaaagctaggggctcacttacaaagtcaggcaggcaggagaaggaaggtaggtcaatgtgggggtgggcagtgcttcagtaagttttttgggggctgggggtagggtgtaccataagggtgctagcactatttgtgaagaaaagagagaaaattcaaccctgcacatccttgccacctcatcctcctgctccccagccagccccaccacctccacctctcccccatccacaggggacccatggggtgaaatccagtccagtgaattaaagtcctaatgtcctaagctgcgcacagcagtgcacacctgtagtcccagctattcaggaggctgaggccagaggatcacttgagcccaggagttccaggccagcctggttaacatagcaagaccttttctctcacaaaataaatgaagtcctaatgtcttctttgccaagtaataagacacaccacaaatggcctggcacccagggagcagggatgatttttgctagcatgttcacctgcctcccagtctttccacatgcacagcagtcatcaggttccagaggacccatcaaaggtggactctccaaagtaaaggaagatggacaaacagcacttccacacctacactataccatccaggcatgagggtgcagtgttcttacagaagggtctccttccttaatccactcgtgggcagggctgagacagcacctcaatagccctctgcagcatctgggacaggacaggagctctaagaacattttcgagctaaaaaggaaggagctttttccattttaacccaccagatgggcaggctgccaccaagcttatcttcattgggcacttaactatgtgccaggcactgcacatacaaaatgaagactaacacgcctgcctaacctcaaggagtacctcttaactggcaactcaatgccatactctgaccgggctccatttctaccttgtgtgcaacagaccctcagtatttagatacggtggactcttgggggcttatcaggtgttcccctgaagctgaaccagcccacccagctcaggaggccaggagggcaagggcagagtctcagggcttctgtgcaaatcccagtgccggctgactggatgaccaactggaagcttcgtgagcaactccacaactgctaaactacagaccatttctccagggttgcagctcacaccttgctccagggcttccagctgcttgacaggagaaggggagatggcataacctccatcccctgggcctcagtatcccctgctggtaaagtgaggaggatgcccagtctgacctctgaagacatccgaacgaacaacactgggagaccagtaccatcctagctggacagcgctgtggggacgatggatgcaagagaggattgcaagtggggagggcatcccagcagtgtgtccccacctacgctctcaacgacacagggaaattccgcccacagctctgaataatcaaagaaataacatttaggtaaggttggggattaagctaaacctcacttaagaggcagggatgttggcatttgggagcaggaaacaggcctgggaacgcagttaatacctaccacagagcaaagcggatcaccgccagctcctgactcaagagcgtcttccacccgccacacttctccctctgccaactccaggcgcttcaaaggggccaggccaaaaagtgggggttggaggtcagttgtggaagtcacattatcagaagaacattggcaaaccagaagccagggagatgccttccaaaacagaacagaggctattttaaacgtaaacccactggtggaggtggggagagttttatgggaagaacagagacatatatgagttgctataattaccctcccctcaaaaaaaaaaaaaaaaaaaaaagctgtcataggaagaagtcttcccagttggtgatggtaatacctggaacacagattatagctgctctgtctaaaacagaaatgggctaccctgtctggtagtgagttccccatcactgaaggtaaagcagaggctgcagaagaaaccagggccagggagactctcatagtcagaagggattttagaggttatcgactgataaaatgctaatgggaaaataactcaaagcccttcacgctttaaaacagtctttcctttaaaaaagcacctaggattcctacagaggacatggaaaggttttgcatgccctcactgacctacagagagctttttataaacataaggtttccctggcatccttggccagactccacctactcttcttcccggctgtagaggtcactgtgtttttgtggcaaaagctgcaggtggtgacagaaatgctggataagtaagaaaagctgttatgtaaaaactccaatgtttagggcacttccgtggagcaaagaatcagaaaatacgtttcagagagcagaaatggagcaggtgagcattcatcatttcaggagggtgcgatgccatcttggtaccccacagcaacaccactggcctgacaggctgaggataaatggggaccaccgtgaccagttaacactcacctaccttgaagaaatgttcagatcatgggttgataatcaccaaggagtcaaaccatgacctcccaccactactgggtgtgtgactcaaccgccaacaccttcagagtcttgttcacttgcaaaattcttaggacctagaacagtacctgacatataccatgtgctcaaagaaataaaaagaatacatattaaaaacaaataagccaaccaagtatcttttctctcggttttggaatcaattacataacttctcttcctctgctgattcacctatctccttcagttcaacccaaaaaacattatactaaaattactttgcattccctgagtccacagagggacaaaagagctgtctagaagcttagggaggaagaggaaagttagagcacagaaatatggaaacctccacttgagctccccgaagatcagaatgtttgtcttttgttcattgctttatcatgtgttctaatactggcacacgataggcactcaacaaatacctaaaagaattagcaaacaaattctctgtccaatcttggcaatcacttcactctctaaaacatctcttctcaactacagaataacagcgctggaaggggctcaggggtccccagccagttctaatgtatctgaaagcctgtgacccaggtaaactggcctgggaatggctttgatcacagaaagcctgcatgggtccccccaagtgtttccaccaaagaaactaggaggcagtgtggtgccataaaaaaaagaacccaaatttaaagcccaaaatgtttaggtaacagctttgcttaggacacatgaacttggggaagttactgaacctcctcgagtctcaatttcctcacctgcaaaatgggggaccatgccccaggtcatagcctggattgtaagataatacatgtggccaggcacagtggctcactcctgtaatcccaacattttgggaggctgaggcaggaggaccacttgaggccgggagtttgagaccagcctggacaacatagtaagaccttgtctctacttaaaaaaaaaaaaaaaaaatctgccagatgtggcaaggggtacatgcctgtagtcccagctacgttggaggctgaggtgggaggactgcttgagcccaggaggttgaggctgcagtgagctatgactgtaccactgcattccagcctgggaaacaaaatgagaccctgtctcaaaaaaaagaactaactaagataatgcatgtaaaagcagtttgcatagagagtgagcctccacaatccctcactcacagagggacctacttcatttccagctctaaaccttacaattacttctaccctagaagggagatgctaattcaggacaaaggataatcaagaccagttcacaagataacgttttatgaaaattcacatcctgtaacctggcctgtgctaactataaagaggtaaattttcataaaacctaattcatctagagttttttgctcccttctcaggaaattaaacagatagaggtttaaagcagaaatggggaaacgtggaaaaccgaacaaccctaaaaagaaaagagcccttccgaagctgcagatgaaccccacacgcactcccgctgagtgtgggataagcagagaaacactgcccccaatagagcaaggccctcccaggctgaacggaattcacagagcctcttggataactctggtcctgagcagggggcctcagagaggaggtgcggaacctgttctcgcagaacgtgggatatccccttgcgctccccaaagcccggcagcgagctgaacaagcaaggccaccatcagtggtatctatcaacagagcatctacaagcagcagacagatgtgacaaccaaaatcaagacaagtggcctttccagacatgccagatacactcaacctccccaccaccacgatgatactactggtcaatgtggattctcatttaatggcaaaagccctaatttttaactgtccctgactgggaggtgttgtcatcgtccttccgccatgggttcagttctcccttcctcactgaaagagggtgcaaccacagaaagctctcccagaaagagactggaggcgtaattttaaaagttcaggaaggagaggtattaaagacctggcaaagatttcttgggtggtttaaggcaaaattcagaatttgtatcttttcattcccagcctgccatcttaattatcttcatgcccatctttaccatcatggtaaggacaagcgtaggagaccacaaataaacacacccacacaaacatctcagcaagaaagatctctcccttttctcagtattcattcatctcctcatgctagacccagagctcccaagagcgagctcagtaaccctgccagcagtggaccatcctggcagcaagcagctgctcaactaagagcaaatctccacatgcccaatatgtggcatcagccagcatcctttgagacagagcagtccccagggtctctctctccacaaaccatcctctcttccccaagaaagggcctggcaaagagtgaagggcccccaggggttgctttgtggaaagactgacttagtgagcaaatgggatcagaggtacccaggtcaaatcctctttatggccacagatagtctacttggtgagtaaggacccagaaggcggaagcctctacccgacctgggctcctccgggcagcccctacataggcgcaagatattagaccaggaaggaacactcagtggtatatcccccaccctataagctcccggccttgaaagcatctgaaaatagcaggcccccaaatctaacctttttcttagaccaggcagatggttttattcatgtaagttctagtttaccttcttaagctgtctaaacatttgtctgagcatctgagccacacgctagactgccctggggattagtcctgctttcagtggtgggctgttgttgttgttttacccctcgttttctctcccagataacggcgaggacaggcatttataagagctgggtgctgcccaggagttgcaatctgactggatggaggcctgggagatgaactgtctcacggggggcggggcagagggatacttagacactgttgtcttactaagactccatatttacacagggagtcttggaaagagggtgcagtcctcccagcctccatcagtgtggatagaatgctgtctagaggtcattcctgggatgaaaggcaccaggcattaagaagcccactctagcacagcccctgaacagctggatactgtttgctgagtcacatctcagtttccaagggaaaatgacagacactgctcatcacagccacatgaactttcaatccagaactgcaaacctcctaaccacacagtgccttgtttcaccaatctgggaaatggggacaagggtaccctctccctaccagccatctcaaaagggaagacccacacagctctcagcaatggtgtgaatcatgagtatttcttcacctggagaaaaagtacttagcacaattcaaaagtatttagcacaattcaaaattatgacagatgactatgctaccaaatcagcaatctgatgccacatcggacagttataaattagacaagtcaacaaatttacccttcatttatactctacgccccttactctcacaccaaccacaatcttctctggccctcaaagaaatagactgaaaaataagttatatgggagggagaacaacactattacccctgaaaccaccccctgcaccatcatttttttaatgtaaaaataaaagtcccccaaaaacaaaacaaaacaaaaaaccaaattttaaaaagcaaccattgtttattttctttccaccataaaggtatactgcagaagaaatgtatagggaaaggtatattgttttgtggtagagactttccttaatcggacttaaaataggatttaccaaatcttacaactcttcaggaacagggtgatttgcatagagctaggcacacctggctccctagagaggcctggacaggccacctccccagcaaccagaggggaaacaaagggggcagaccagattcatggcaaggccaggcctcaggagggttcaggtgttggtccctaattcaaagaagaacttcttcctttacagactagcctagtgtatgagaagacatcatggcagccaaagagaacactctagagcttaggttggcaaaccagtaaggcccaagggccttacttataccacctgtatttgtaaataaagttttattgggacacaaccacacccattcatttctgtcctgtctatggctgatttctatgctacaatggcagagctgagtagttgcaagagagactgcacaacccacaaagcctgaaatatttactctctggtcctttatagaaaaagttggccaaaccctactctagtgtcaagtacattccatcacaaaggctgccgtaatagacaggttccaaagaataaagacagctagttcagcacctctactttgtaaatgcttactgagacccagagaaggggagatgacctgccagagccagtctgctagaaggactgaggtcccacctgcctcccaacctagcactctgtttaacaaagaggaaggggtgaggcttctcaaaacaaaacaccagcagcaggggaaaatataaatagaatatcaagtcccacaaataaacattaatgcttggctcaagcttaacatgagaaatgtgaaaaatggggaggggaagaagagcacatgggatggtctaagcaaactaatatcccaagggcagcctatcttcagccctttctaaatacccattccacacacccaaaagcacgtgtgctaatgatcaatcctgcctctctccctgcccagactatggccactcctcctctcagcaatgatggtgaacttggcagtatcgaacccaaacagcctttctctccccattacctgcaacgtcagcttttctgcttctcacacaactctgcccgtgaatagtccaaactagcggggtttgtgctacattttaacatttcaataattaagacctctcccaaaaggaatgcccagcacttcccccaaaacagctgtggaaaatcaggctgagagggaaatgcagatggagaggccccaggcctgcacagaggggcaggagggagggaagaggggctgagaaggagggtcagcaacaagacaaaggcgccgaagagctttttttgcacccgcaccaggaaaacaccagacaatgtgaatggtgcatggagatgaagcaacatcccaaagttaaaattaattagctgccgtattgacagaggctccattgtgccatgcggtgaagcaatctaagagcgagggcatcacacacaatgtcgaaaggcccttggcagccacaggtacgacagggtgaggacatgctctatcgtgtcaccaacctggttccctgaagaaaggtgtgcgtgtgtgtgtgtgtgttggaaggctagtggttaagaagtgtcagtgttaagactttcttaaattaatttcaaaaatgcagtaaccaaaacattgacagtaatactctactatttgagagcctaagtgaaaggcaacaagtggggcgcagaaaagcacgaagctgcctatgagctactaagtggcctgagcaggttaggagctggcacgatgtgagggaaggcacatgccctcccactcaagtcacagaactgggtgggcgtggcccaaccatcagatattggtgatcctaggtactcccttgtctgccgcagtcaccctacccagctccgtcatgaacggccataccccctcacctggaaagcctgccttctccctggatctgccaacagcttctgcacaccctgcaccttgctcacactggttcctgtgcttctctggcccacttctttccttgaaatctggtgggctgcacaacctaactgttaagagcactgactctagaagaactagtttgcctatgctcaaatcctgtctcagccacttactagctgtataaacttgggcaggttccttaacctctctctgcctaagtttactcatctgggaaactaatcgcagttctgacctcacggagttactgatatgggctaaattagtttacacagaccactcagaacactgcctggcacaaaggcagggctgaattagtatcattaaggtccccacccctccttggagggtactttttccagaaagtcttccttaattccctctgtgagttaactgctccccagtggagcctggagctccagctgctgctaacacccctctgatggcatttatagcttatctttactcatgcctattttcatcattgttgcccacacgactctgaaggcagagtactaactatacccattcctgcagcatggaggcggagtccccagtccctttcctgagtacctggtacagtatatttgcaccatatactgggccattacatagttacctctcaacagtcctaagatactctaggactatcaccccaagtatacagatgaggaatgtgatgcttgatctctctaggataagcaacttacccaaagttacagactagtatgctgctattaaattctggtttgctgaaattaaagtaaactaggggccttcattcagaactgaaatggctttcagggctgaatcaagacaggtatcaattcatgtgaacacacagaaaaaggtctagaaggacatcctccaactagttatacctggtaccaggatgcacaggaggacagtgaagggcagggagttttgcttcacttcttattttatatacctctatattttagcaatttttaacaaaagaagtacttaggtattacttgaataattaaaaataaatggcttagtataaagaatcatgttaaacttacctcctacaaaagactttgaaaccattctgattgaattctaataaaactttagaagcgttcaatcttcctggaccgaaagcttggtaagaagtggctttggattcagacaaacctggcttccagtctcagtacttccccctcccatttacaactgagtgacactgttcatggcactaagcctctcagagcctccgaatccctcgtgctggaaagggaactgtgctattatttaccctgcgggttctcatggggatcacctgaagtagcatgcaaagatctgatacagtgccacgcataccagaggccagaagtagggctgcctctttcctttgctgctggagtctgagctggtttttaagggttaatcctagtctacctccataagccagttcttttccaaaatgatctacttgggcaaaagataggtgcgggggagaatgccaccaatcgctcttgcccataaacccccgccctgatactcaccttctgagaataccagccatcgttttggagtcaggcatgatccaggcaataaaagcagagacagaaaccttcttgcgaacaaggtccctgatgccccattgtctctgtagtccaatctgtgcctctcatgcaaggtttcagggacgtaaaaagcattcagacaaatgggtctccactactgagctcttacacagggaaaagcatctgaatctgtcaattaatatgtattaagtccctacagggcccactgctcaagcagtgttggaagaatgagtggagaaaggacgaggggcagagtcccagcactctggtgccagactagccagataaggcagcacggcaagctacatgaggtccttctctgatgtcccagagactggttacctgggccaaaggctgcctctgcggcgggtccccacctttgctaggagcaacactaggaagtaaaactcaaatcactcttaagcaatgtgctggcaattctgatggatttttgtttctaaagtgtgctctgtgtaccactggaccaacaactttacacataagaataccattgtgtttatgtgcacaaacatttagccataaggatgttcatcacattactatttacattatgagaaagctgaaaagaatcttaatgcaaaagaattcttaactggaaaactggaaacaagcaatagtaaggaactggtgaattatgccacatccaagaagcataacatatactcatttaaaaagatagaaaacctaggccgggcacagtggctcacacctgtaatcccaacactttgggagacccaggagggtggaacacttgaggtcaggagttcgagaccagcctggccaacatggtgaaaccctgtctctactaaaaatacaaaagttagccatggtggtgcgcacctgtagtcccagctactcaggaggctgaggcagaaaaatggcatgaacccgggaggcggagcttgcagtgagccaagatcacgccactgcactccagcagaacgagactccatctcaaaaaaaaaaaaaaaaaaaagaaaaccttaatgacatggagggacccatgggagcccttcacctaacatcaaaataggtgcttaatgaagaaaaacaggggctctcaaggacagagatgctatgctgcagccagggagaagggacttgttcgtggattgccaactggacccatagttccccacatttagggaaaaaaaaaaaatcagaaaccaactcacaactcattacctgcctgaagcatttctgaaaccattttaggattatttaaccagataaggtcttgcaataaacaggtgtgagaattactgtctttttttaaatccatctactccacttctgagatctgcaatgcaccctagtacactagaaactctgagaagccctacactaaagaagctgcttcactctttccactccccacaaagagctggctatagaccctttattgaaatgtgcctgaacatctcactgaagagctgggaaagctgatagactaaaaagcaccctggatatggcagggaggcctgggggcccccgtggctctcacttactagggaatcttcaggcaagtcgtctctctattctagacacaacttctccaactgggagctgactaaatcagaggtacctagatctgtgctctcttcaaaggtaaaacccttgggggcatgaggggaggtgtaaaggtgggaaacccagtgagcagaattcacagcaccacactcccctaaaacaagtagatggctccatttttgttttattatttgcacttccacgtaagacttcatttaaagaaaagctctttctgctaaaacgaaaaaaagtaagtcagaaaccactgaaacctatgtcctgtgtggtccttccaaactgcgaccgttgattttctttaaatctgcattgcacatgggaaaaagtcctcttgagtcggggggggggcccaagccaggctccctgggaaaggcgagggtttgaggtgaacttattcccgcagaggctccacgggattggggggacgggggtgggggggcacaaactgggaggcctgcctatgcaggaaggcagggagctagggtgaccattgctgggggagatgagagggactgtgcagctaggtggatggataaaaaggcatcttgaaaaccaaggtcaagaatatccacgtggaggctgacagcaagaaatcggctaatgtttgaagagttatgtgatcaaaaaaaaagagaaccactagttaggtgaccgtggcagacggtttctgtgtctccacgtgaaggaaagactggaggtgaagaagtcctgcagtcgtctgttcttgtggtctggctatacaagggcagatgcaaaattcaaggttcaacttgaatgagaacttcaaactcaacctccacctcaaacctggtgtacgaagacgctcagaacagaatcagatactcagactcaccaaccagtctgaggacgctcagaacagaatcagatactcagactcaccaaccagtctgagaacgtgaccctgtccctttggttgagatgggattcccaagattagtaccctcgacggtatcctgggcacaacattgctccatttttttttaccctgctgcctctctcgggatccccatgtcccatgaagctttgtgtgatatgaaaaaccatccttgcaacatcccaagagaaatcaaaatgtggagtagaactcaagatgcctggaagagaagttttcctcctctaagcttccttcaactgggagggttccatcatgtctccacaattagcttgtcccaaccctccgtcctcttcagggtcaccacctggcactccaatgcaagcaaaccttcttcagtcaatcaccatgcacctccctaagatcctccagggccttcctggaagctggtggctggctgtcaagcaggtacagggcttccaaatggaattcatttaccgtctgcatccaactttcacttatctggaaatccaaacgaccaggaaacaacatcactggccaacttccagcctggtctgtgactccgatgacaacaaactcaccttgcatggcgatgctattcgattgataatggctgactagaaggctgtgttctgaaaataattctgaacccgggttggcagaaaaagagttaccgtgatcaacttgcaatgtctgacacgagcaagggaggaatgccggagtatgtgccaagcatttaccatctgtcctgtgcaccatcactagccttcagattggatttttactctttgcttcatcatatactggacacgtgactttagaaagtcactaaagccacctgcgtttttatcaacaaaacggggtaataagccttgtctgtcactgccccaggactgctagagggtgccaatgagctcacatacaggagattgttctacaaagtgtccagtgcaggggattattatatgtaagggattacagttcttctccacaagagtggccctcaggcactacatgttcctgaagaggcttccaaatcaacaaagaatgagcatgcgtgtggtggctgtgagtggtggcagccctcagcatggctcagctcaattttagacttgggaacggttcccccgtcatacaagatcaagggatcccagtgtctttggtgttcttcctgatgttcttagcactgtgccgtaagcacacatggtcctgagacccaaatgctgtaataccccagggctcagtgattgaaaagacagggccaaccccctctccagtggcggctggatgggagaggagcaacaagactgctgccagaagaccacccaagggggggtatgctgaagggccacgagaaaggtctccaaacaccccaaagctacagacacttgttccactgcattattttcatagccatatcaggtcgccctgcaggcaaacactattctcagataggagctgcatgttctcacaagactaagttgctcagagttaagattaggtttagagcgcattaactccagcaccgaggaacactccattgtggactgagtagacactaccatgagctcaagcgcccaagtggaagaaagcgtgtgtggatgccatgtgtgcatgaacatgtcacaccttacatgatgacttgcttcagaaggctggctctggggaaggcttgggcgattttaagccttgtttgccaacacatagggagtgcctgctggggccttcctctactgtgacacgggcacaggaatgggagagagacacacccagtttggtgtttcagtgtgtctgcaatgatggtgcctctggatgcactctccacccccaagctaccgcctcttctaaagtgaggctaaaatcacccataggactgatgagaggaccatcagttaacaatcatcaatatcgagagagaagacacaataataaaaatgacaactgcgtacagggactgtgcatgtgccggtgctgcactgggcaccgtgcccacgttttatctaatcctgccaaagctgacaggctcctggcctcaaaaacgaagacagtcgggcaggggtgggggagtggctaccttaagattaaacacctttctaccctgcaaccaccacctggtacaggaaccgagggaagggcctcccacaacatgaggcactctctgagcacatctcatacagccaactccacccgagaacctcatcctttcacggacatgggttatactcactttacagataaggaaactgagttggaagggactcaccaactctcccaaaccactagttaatgagtatctccaacaaccagacctgggttcctgtcaggcaaggcaggctaggcatgtgcctggtctcccgagcctgactctaaaggtttccagactgagtcccacatgccgtgtaagccctgacaaattacttcccttctctgtggctcagttctccaactgcaaaatggggtaatacctgccttgcagggttggtctggaggattaaactacctcatgttgaaagcactgagaacaggggctggcacagactgagagcccaataaatgtcaggcactatcagtgttcactggccataatcctccaagacaaagatctgcacctgcctggaatgccccttcccctccactttctttctcactccttgaggcccagcagcaacaccccctccaggaagccttcccagcccctaaagcagccagcgactcccctctctgggctcccttcaaactctgcctgtgttccccatgagcactgaccaccacctaccttgtcaattagtctgtctgccgttccagacaacaatcaacacaatcctggctcaagtctgcatccccctagtgccatacctgtggcaggatctaggctacactcaataaatggtgaccacgtgactggaaacccacccactgcaggtttccgacgctcttccacccacaatcctttcctgagggctcaggagcatcaggcatggggctgagcactgcacacctgtattgctagtgtatacctgtaccctgtcccctcttttatgaatggataaactgaggccccaggggccaggcaattaacccagggccacacagctggagaacggtagggccaggacaagggcaaagcctccctgactccagcagaccctatgcctagtcctcctctttttctacaatcttcttccttttctattcttttgttgggaggcagggggagatgtttttgtaaaaaatgcaatgtctttatataatttccccatggctgggaatgatgaagagcaaaccaacgggctgtgcacgcgtgactctgtgtgcctgggccctcttcctggtgtcacccgcataacctcctggcacagacactcagctgccacctgacagcattgcttcaccttcttccctcttcccctccagggcccccagaaccaacaggggaagttggttgctaatggcaacagtcttgggagcaaggtgagacctaccagcccaccactgacggctgaagggaaattttcaacagcctctggggcccctttctgtcaatcaagcggcctcttccctgtctgggactcggtttcctcttctataaaaagcgagtgccacccttcatgattctagttacagagttgagaagggttacacgaatccagccaatctgggcctctggggctgccctggatggatttagaagggtcagcaaagagttgttttgaaaaaaacagcaacaggctgggcgcagtggctcacatctgtaaccccaacattttgggaagctgaggcgggtggattgcttgagaccaggagttcaagaccagactagacaacatggtgaaaccccatctctataaaaaaaaatacaaaaattagccatatgtggcggcgcatgcctgtagtcccagctacttgggaggctgatgggggaggattgcttgagcccgggaggtggaagctgcagggagccgagattgcaccactgcactccagcctgggtgacagagtaagaccctgtttcaagaaaaaaaaaaaaaaaaacaggaatgcctctcggcacaccagctcagaattgcccccaactccctactcacacccaggggctgcttgaggaaagtgtctgagctgagtgccctgggctgaccgtgggagacatgagttgtttcccatggtgtgcacgtctggaccaccagagctgcggtcagtgtgaagttcatcccgttatccccactagactctttcctgctggacaggaaaggcaggttattacagaggcttctccagagccgtgcacaaggacatcatgggaagaggtgactaaagggctcaaagagcccaatgggcactggctggaagcctgtctttgagaatggcaaagtagcccagggcagctttcttaggagaagttagggcttacactgagccttggaaggcaggctgggcaggtaagacgcaggtgcgcgggaatgtgtgcggaggcaggtggccggcagcccacggcgtgttggggatccagagactgggtagccaggaggcctgcagcctgcagccctggttcctgccgctactcacaaggagcacaggctccgggaagacgactctgagcaaacatcccaggtcatcccacaccacctttgtcattaatctcttcagtaagccccaaaagggcatcacactttcttgaggccctgctggccctgctccttcccatctaaaagttcttgacctgtccaagcctttccaggagaactgacaccaaacacctcacattctccaggatgaaatttgttcacaaaccaccctcaactatcctataatggatgcttacattatccccatttcacagaagccaaggtgaagaagcaagtcaatcagtgaagcctgttcaggtggaacaagctgtccccatccctttctccctccatcccccaccccacctggcaggggacagaatgcaaagcaaatccatgctaaccacacacaaccctgaccccaagaacccagacagagtgtaaaatgcagaccccacctaatccaacgtgagatatcagggctatcaacgtgagctaactgacttccagagcatgaacttgcttaaaaacattctttagttttcatttcatgaaaaggtcatacagccgaagcacaagcaccactcaggtgggcaggaggccaggggccagagagggggaggggacgagagcatcccgtgggaagatgcacaacaccccaccccgtcactgtgggagtcttggctcccaatctgtaaccttatcctggggcaagccaaaaaaggcagtagaggaggctgggccaggatatgcccctggccctgcacatgctacccgtcttctccactagctgtccacagggcctgcttctgtctctgtgtccccaggtgttgggcaggaccccgtggtcagagcctggagggctccgcagcacaacagccatcatcagacagcctgacagtgctgaaaagtcaccaccatgggactgacagggaaactaaggatcagatagaaaagcccacacgtggatgacaaaccacctaggggaatttattcattcctacttgggggggatcacactgcatgcatgcatgcatgcatgcattcaatttatttatttagcaaagatgtgtggtggaccagccagactggggtctgccagaggactctgctctgagctctttcccacaggccagtccacaggcacctccacctcatccacattctgaggcctgcttgaagctgctacagtatactcctgctgccagccactttcacaccagcagctgactgtgactccagtgcttcttcaagagtgtcaagttgtgggcccaggagacaggatccagaaaaaccattcatgagaggcgcccccagccagtccccctccagaagcctccagtcgcctggtggaaaggatggtgaggggcgagcacctcagagttcacatagaagccatctatgtaaagtaacagcctttaaagggtgacccacagccagagccttcctctggactggactttatcttgacgctacaggcggctgcggtggccctgcctgccacagggccctggcggtggcaaaccctgcctgcagggaagcaaaggcaaggccagcccagtgccatccgctgcccaggggggccacaaggtggtgctgaccaggctctgggaggaaagggaggggaaggaggagagcagggaagaggaaggagagggataagtaggagaggtagagggatacagggcagggagggagggggaggaaagagcctttgtgctggcttcccccactccacagtacccaggagcaacaatcagttatgcaaacagggacccctcccccaagcccagccatccactcctggaccccctcctcctcccttagtctctggtctcccctccaccctgttcactcgtgtgcgtgcatgcgtgggtgtgtgtgtgtgtgtgtttgtctcacacacctctaagaggtatagtggccctgaggccttgcccattcaggaaaaaacctgcccccaccctacccctttcctcaagttctttagtccacacaattccacttttaggcatgttaccactgccaacactgccagcctctaaacccactacccatttcttgctttggccaccagcaatggtgagtcaaggaatggtgctcccaacctgaagacgcagcccttacagctccaccaagtaacaagacacgctgcctgctctgacttcattttgctaattctctcaatgaaatgcaataatgtgaaggaaaaactcgtctttggggcagggccttcaacatatggtcagcctggactccttcaaaccacacagattaaaatctcagccaggtgacaacttctaggaggggggctttcaccctccttttcttcttcatgagatagacttttgattgtttcagtttcaaattacatcaaacatctaaattgggaatcccagctcctccaccaccagcgcatcaaaggtagatattcaaagcagtacttatttacaaacggcgatgcaaatctgtcccgacaacctgggcacccttgacagacacttctgccactgcccatcccaggagtttctgtcccaactgaggcctaggggtgtggctaccatctgtcaccctgtgaccaagtcatgaccatgacaatgatgactcacacacaaagagcctggcccctctgttacaagtccaggtaagtttttaccagctttgaaataaaaagcattaaatgacaaagcttttctacagaatgagagagaggtaaggccctctctcacctccaggacacacagtcctcagtcaagggcatttaaaacattccactccggaaatgccagagggctggcaaagacactacggttaaaggcaagcaatcaataaatggggtgagggtgccacaggcctcatcgccattactgaaagcatacccctttcccctggaatggtttccccactccaaaacccaaaactgaaacccacggtgctcctccctttccccacaaggtctgcctccaggccctgcctgataagccctcaaggttactccgtaaacccgaagggcaggagtgctccaacagcccaacctcagtgtgctgagtgctgagtgtatacaggccactgggcacacacactgaatcctgagaagtgagctctaggcattgttgtctgcttcttctagatgaggatactgaggttgcagaaaagagcagggtcacacaggtggcttgaggtaggacgccagcagccaggctcttaacactcaggaagggtggtgcctccctacccatccccccagcatcatagcagggatctcagatctgctggagcatttccagcgacagacacctataagacacatttttacaaagccactgtttaaatgttctaatggattcctgtggcttgggacaaaattcccagaggaagcatcatacacaaagctgaaaaataatatatgtcaaacaacttggagtgttggtgatacgtcctagaaaggtgggttagaagataaaaactggctttgatgacagcatttaagacactgataacaaaaacgcatatgaagacctagaataaaatatatcatgtaaatttagggtggaacatagtatctctaaatttacatgttatctgctatattattttaaacatgtatgggtaaataaattagatattttaagtaaggaaaaatacttccagcaataatgaagccgtgccgattcaccacaattctgctcggcctcaacacagcacaaatccacaccaagtctacggaacctctacaggccccggtcccctgcactctcctgacgtgcaggccacacaaccccaaaaagcagatgccctcggacctctggccatcagcttagaaacaaggtgccagagttcccatttttataacaaatgaactgaatccagcccaactttcccatattctcatcaactttctttcatggatagattttccccaacttacagtttttccttctgatttttgtttaaccccctagttatcgctaatccttgcttaaagaggattaagacaatcatgtaacaaatatgggtgcttcgctacccagaggtgtgggtggggctctgttacagtttgcgcgtccatatttctgggccactgcacaaagaactccaaaccactcagagcaggacaaagaggggctgtggtggagaacccagggccctttaccagggaaaggggtgtaaggccaggtctcctggcctcagccacagcccccaatccctctggctggggcagcaacaccccctccaaagctgctccctcggaagggactgccaacagtcaacgccaaacttcaaaattaactgccaccattgggggctgggacggcggtttggttccttttagtccaaggcgctgacagccaggcctgcccctactagctccttctgttgtttcgaggggagtgaggcccggggctgagttaagtttcactggtgagtggccggcgggcacaaaggaaggaaccgctgggggaggggaggccgcagagctggagggctgggacaaaggggacaagagacaaagggacaggaaaagagagcccgctttatcctcctccgaggaaggaactccccatttagtcaaatatttcactcacacagctctgggcaagaaatgccccaccgaacattttccgaggtggcttcaggtgtctcccacaccctccccacccaggccagacacaagacgctggctctcctggccccgccaccgcctggccaggtccccgccccaacccacttgttcatagtcagccaggttgcttttgatggcttcctccctccagccccgatctgccaccctgaagagagacaaagaattatttatttggagaaaagaaaaaccctcaaagtgtcagccagtaacagacatgacacttgctacgcaggagcgacatgcgggttttctagtctgcaggagggccttcgccagcagcacacctcggccaccctgggtgccctcagatgctgtgaagccctacctgtgtggcctttttctgttttctctttccttaaaaccactgcataccacacctggaggttgtgagaattaacctgtaatgaaggtgagtggccagcaccaggacggggacgtctgcaataaacatggcaaaatctgaaaagcaggtgaggtcgaccaggctcccaggctcccaggctgagacaacagaaccctcagggctgtcttcactgagacgcttgatttgttttgttttgattttggttggaatttgatttgagggagacatgatcccaccacattttacatgaacaaagcaaatctgacatccacgcccaggaccaagccaagaaagaggcggtacaatggtgcggccaggaggctggctggctgtcaccatcggcagggacagtaggagaaagccaagagccacagtgacccttccacagaccacagtcctccctactgccacccactccttgcccgagccaaagtcctgctttctctggacatcactccattcgcccaaatacctaggcccctaccatgtgccaggcaaagcacaaggcggtatcgtccctgcccttcctgcaagaacacggcgcatcaagtccttcccacccgccgttctaaaacacgaggctttcactctgtgcctcacactgggagcgcactcattttttggggctgggaaaggggcactcctggtctcacagtggggacaatggggctggaggagggcctctgttagcggaaagagcctgtacacccaggggtgagagggctctctggtcagagaggaaaatggaatgtggccaatctcgccagggaaaggctgctccaggctcctccctctcctagggtctgggctgggcgcccaagttggtggcggcctcggctcccacaccaggtcatgggcagaccctccccgcagagcagcggacgccactgttccagggggattgactcgctctgtggtctggacaggctaagtcacacaccccctcctttttccttcccctccccatggttcctcctcacccccatgcccaaatgcttgagtcttgattacaccctggacagtaccccagcacctgacctgccaaataattagacccagaagcaggccacaatcggctttggatcagaaccagtgtctctgctgcgtgcagtgacagcttctgtcctcgtggaaagaacgccgtgccgacacatgctccgagttaaaaacattttcaaaaagaaaacgggagggggaaagaagccatctgtatctcaagtctgcaagacagctctggccagggccagcttcggcttcctgagaagctacggcccatcgtggtcccagcccaggaccccggctctcacctacggaggggtattccagacaaactcgctgactcaccggaaaaggtggcattgtggctgacacctgtgcctcagaggtgaccacagcctggttgtaatgccccacccccaaccatggggttgggggtgttggtaaagcctagaagaattaagtcaagtctgacagagtgtgggcacctgaaagcttccttaaagccagtatattaggcagggcatgatggctcacacctgtaatcctagcactttgggaggctgaagcgggacaactgcttaaggccggaagtttgagaccagccgggaaaaacacagcaagaccccctctacaaaaaaaaaaaatctgacaattagctgggcatggtggtacaagcctgtaattccagctactcagaggctgaagcaggaggagtttgaggctgcactccagcctgggtgacaaggtaagaccccaatacttttaaaaaagagagagaggctggaagtggtgactcacgcctgtaatcccagcactctgggaggccgaggctggtggatcatgaggtcaggtgaggaagaccatcctggccaacatggtgaaattccgtctctactaaaaatacaaaaattagccgggcgtggtggcgtgcgcctgcagtcccagctactcaggaggctgaggcaagacaatcacttaaactcgggaggcagaggttgcagtgagctgatatcgtgacactgtactccagcctgggcgacagagtgatacaccatctcaaaaaaaaaaaaaaaaaaaaaaaaagagagagagagcatgtcagtagagtcttcattcttttagtttatgtccttgtagatttgtgtttccaataaccaatttttaacacatttttgctagaataacagccttataaggacatttttgtttcagctacatctccagtttgtgctctcaccaaggtgatcaccactttctccaaactctcacccccacctcggtggggcaccttgccgaggccctcaaatgacttggctcaaccaagtccacacccacccacgctgggaccacaaaggtatcatttaccaccactttacagaggaggaagcaaaactcaggtgagtccaagcaacaagtccaaaaatgacagagctggccagcgcagtgagacagggtgctggggcaagcccagggaagggtgaccccacaatcccctgaggggatgctgggaagcattcctgtgccttcctaggggacaagtcagctggaaccaacaggatatatcttatattttaagatgtgcagttaggctgggcatggtggctcatgcctgcaatccaagcactttgggaggccgaggtgggtggatcatctgaagtcaggagttcgagatcagcctggccaacatggtgaaaccccatcgctactaaaaatacaaaaattagctgagcatggtggcaggcacctgtaatcccagcttctctggaggcttaggaaggaaaattgcttgaacccaggaggcagaggctgcagtgagccgagactgtgccactgcactccagcctgggcaatagagcgagactctgtctcaaaaaataaataagtaaaaaatacagatgtgcagtaagcattttatttttatttcttattttttacagacagggtctcactatgttgcccaggctggtcttgaactcctaggctcaagcgatcctcccaccttggcctcccaaagtgctagaattacagatgttacccactgcacccagccagttagcattttgaaaacacataaccccagataaaggggaggaaaatagtctatgaggtctgtgagggcaaaagatttgctggtgtctttgcttccgtagccaaacggcagaggcatcaaatatttgatgaatggaagactagacagattagatgaatatctgataaagacaaatatctttgatgacctatgggtggatttttggataaaatatcttcctaaactgatactattaggacaattttagcagaaagtagttgtttaaaggcagtaagcatttcaggcccttggaaaagcctggatggcaggcttagaaataaagaagtcccagccaggcacagtggctcatgcctataatcccagcactttaggagactgaggcaggtggatcacctgaagtcgggagttcgagaccagcctgaccaacttggagaaaccccttatctactaaaaatacaaaattagctgggcatggtggcgcctgcctgcaatcccagctacccaggaggctaaggcaggagaatcacttgaacccaggaggcggaggctgcggtgagccgagatcgtgccattgcactccagcctgggcaacaagagcgaaactccatgacaaaaaaaaaaaaaaaagaagagagagagagaaagaaagaaagaaaagaaagaaagaaagagaaggaaggaaggaaagaaagaaaagaaagaaaagaaagaagccccagctgggcacagtggctcatgcctgtaatcccagcactttgggaggccgaggtgggcggattgtctgagctcaggagtttgagaccggcctgggcaacacagtaaaaccccatctctattagaatacaaaaaaaaaattagccgggcgtggtggcgtgagcctgtagtcccagctactcgggaggctgaggcaggagaatttcttgaacccggcaggcggaggttgtagtgagccaagatcgcaccactgcactccagcctgggtgacagagcgagactccgtctctaaaaggaaaaaaaaaaagaaagaaaaaagaaataaagaagtccctgtactacagtgtggctagaccctccctgaagaacagataagagccattcacaattagaagcaaccctgcacacagagaccacagctccaagccctaagccacccacactggaatcttgtttatccttggctaagcaaacacaagtcttcttagataatgcaaaggtcaactgtagacttgtatgacctgataaaatcgccaccaaccctgaattacagggtgttcaataataaaatatttctacagagctatgagggagagagagaaatcagaagtgggctattttccatcatcctccattaacaccccactaagacacaggctgagtgatggagttctggattccaggatcacatccctgtccacccactccccagccccctttataaaaagcaagaaccggccgggcacggtggctcacgcctgtaatcccagcactttgggaggccgaggcgggcggatcacgaggtcaggagatcgagaccatcccagctaacacagcaaaaccccatctctactaaaagtacaaaaaattagccgggcatggtggcaggcgcctgtagtcccagctacttgggaggctgaggcaggagaatggcatgaacccaggaggcggagcttgcagtgagcagagatcgtgccactgcactccagcctgggcaacagtgcaagactccatctcaaaaaaaaaaaaaaaaaaaagcaagaactgggcaggagaacagtcacggggcttctagcccgagaggcctcagaagttgtcaaaaggctgggttaactgaacagagagcattttcccacacacctctgaggacacttcacatctgaagctccatcgatgtgtcaaagacctacttcagaaaagaaaggcaaacaccaaggccagggctcgaactgagcagacgaacttggacttgttctaagggcgttaagacttcagggaaccattcaaatgcacagactgcacagaggggccctgggaggtgggcagcctcctgatcctccctgatcactctttcagccaacaaatgttgagtggggatccaccaagcgtcagggcctcagtttacaagacccaccatgggctctgcccccagaggctcaaagattattagaagcatcttagaattatgtgatgtctaaactgagacatgaaaaataaacagggttccctgagaggagaaagaatggcagcaagtgctccaagctgggagaacagcctgtgcaaaggccccaaggcagagagctggcccttctctaactacagcccaggaatctcaggcttcacattccaccctaacagaaaaatacacagatgtctttttaatgttaggtccccaaataatttttatttcaaaacacagaaatattccgttaagtccctctaaattttttttttccaacatacaaggcccatcaccttctcacctctccccattgaccacctttccatttctgcagcagttttccaagagcagtagcttctaattcctgaacagctcacatgggcctccagttgtcgacacaccctgtctcctctctggctaatggtggccccagctgcctgtccacgtctccagagtaggcctgggcagggacagggaaggacatacttcctaaccaaaagaaaagagcaaaccgcaggccaggaaggaagtaggaagtcatcctgagcgcagatccctagatgaggcctgagcacagcccctgatggcaggcagtgggcagtccctccccagatggactagggaagctggcacttaggaagagaaagatcgtttggggacagggagcaggatgaaacacatccctggcccttctcaaggacatggcttgtgctggggacatataaacactcctaacctaaaagcatttggctcccttagctgtctttgtcctcacccctgctccccaccaaaaacagacttcaggaagaaaatgaatcaagttttacaagcttccctatttacccagggctacaaatctatcagtggggaagcttttaaaatgttctctctcctagcactgtcccttcccttctatctaccactgcccccaaccccaaacacacacacacacaacctcttatgggtttctttaaccttggctatggatcctgagtctgaaggaggaattccaaattcagaacataccccagtccaccattcataaatacttcctgcttttcattccactcctcttacttattcgtgcttctaaacgtgccccagaatcactccctaagcacagataccttcctttcagcctctcattctttcattcctgaaatatcttctaacatgctctgcttcattatctcaaagcagtactgcaggctgagtacaatccccattttacagataaggacactgaggctcagaggttaatcaactggcacaggttacactgtggatgggggcgctcttgtggggattagaacccaggctgcttaaccttcaaaagctctcgttctctgcaccttggttccccagtaccccatattcatcagacacaaaaagtaaagtcgcttcctttttcaaagaaaaatgacccattctggatcacccacagctttaaatattgcatgttgaaagctaaaggccattttaactgatgcttcaaaaagtatcatggaagactcagcccacaagaaaaccatccagaaagtagagactgtgttaacatgcagtgtggggttcagtgcagttctagaggcacagatgtttagggtggctctccctcaagacagggatgctgctgtccagtgggcagtcaggggcctagggttacagcttcaacccctcgctccccacagaaggaggggtttcctttgtgcaaggaaaagcaagggctgggtggccttcctgcagtggcccatgagcctattcttaggattgacatccttcagatacattttatccttcagataaaatgccccacgggcacagcaccttatggagcggtccacatcatcaactcccaggagctggggaggatggggagatgggatggtccctctggccaatgaggggatccacactgtactggggcccttggctggaagcagctcaggtgttctcacccccagttccaaggttgctcatatcccgtattccagtgtcagcaggggaagcaacgacacagcatccgccagaaaaacaaagtgggaagaaggatttgccccatcttcaaacccatctaccctaattgtgctaaattctctggctagcttcaatccacaatgtataaactgatcctactttttttttttttttttttttaagagatggagtttcactatgttgtcacaggcatgatcatagctcactgcagcctccaactcctgggctcaagcaatcctcctgcctctacctcctgagtagctggactataggcgcacaccacctcacccagttgaactggctctactttccgatcccatcttcctcccaagcaagaggcctctctcctgtcatccccagctacttactactcaacaggagtcccctccttcttgcctgtcagcacccaccccgagtacattctccccctgaccctccacaccggggcacctcattccctgctctcagctttcctcaggcagtcagcaaaacttttattccatgaagtaagaacatccgttccatccgtctgtcttcctgggatgccagtgtatgagaagacacttcatacaacactgggtatgattactcacacgtgctagtgtcccaaagcgcccactgggcttccttcgcaggggattcctccctggatcgtttactattgcttatagtttccagggcactggccagaaaaaagcctgaagttgagagaatcggggagacccttaaaaagaactcaatgattcgactgcttaaagctgaaatccaacctctccttgacagcaaaaacgaagctgccaaaaaccaagccatgcctcttcaagaaaggaaggatttccaactaaccctttcaactaaatccaacgtgggctctttgctgaaatccctcctactctacagaagggccttctcggattatttttcttcaaaaaaacatcatttacacattgagtgtctttactttccaaaccattcagaattagggaaagaggggaaaaacacgtctgtttctatttgaaactgtcaaaattagcattcagtaattaaaaatcacaccctttctcttaataacctaaccagcatgatacaatcaggttgtgccaactctttaatctaattgactaattacagattttaatttagtcagttaccgaacaactgttgacaatttgttttcattagggacagaacagaataaatatttaggcttccagtcacaaagactcctgcgatcggctctccaccatgaccccaacttcagagtgagcttcagctctatcaatatcctcagacacaggtacccttgctgcactcgagtcgcttcttagcaaggccccgagccagaacaagccttcccaaaagtccctcttaaggcaaaagccttacatacaagcaacggcctccattcccaaagtacaggcaattcccaaattcacacacgtcactcaagaagtggcaaacacttaaatgttgtgaagaaaaataaattcaacactacatgtcactggcttttaagcaacaaaataagttaacagtcaaaataggtttatctgcattcatctcaccgagaagcaaactgtcactgacatttttttttaagacacacgtttacaggtttctactgaaatgatccaattctttcaaagtgcatttttccccaaggtccccatctcccaaagtcatccaaaagtttgtcaaagtagcagcatggctcaaaggtagagtggggctctgggttcaaatcccagctctactatctaatgacttcataacaacgggctcatgccttcacttctctgagccctggcttcctcatcggagaaatgaggtcataacagcccctatcttatagagtgttaccgggattaaatgccatgcccacacacagtgcctggcctggggtaaatgcagtaaatggtggtcactgctgtttcagaaactgctgttgtatccctcactgtccccatgctacaaattaggaaagaaagaaatcatctgtcaaaggttaccaagctattaagtgggaaagcttggtggagaaggatgatttccggactcgctgtccagtgatccatctgctgcaggtaatgccagctcagaaccgcagggaatatgggacccctgccttgggatatatctgtaaggagaggaggctctgcagatgggagctgttcacacaggctcttacaccctcagtgtgtctaccctccaagctgcactgccctaacagagaagccttgcatgcacagccaggagagcaggggtggatgggcctaaagagagctcagccatctccggagagaactctgcattctaaccttcctcagtcctgggggaaacacgagggatgtccctctacagaggtcaaccctggccatgccaggacaaagtgagaaggcaccactgctaggtgggtcctgcctaaggattctaaccaggtttctggaaaacttcactgggggctcttgaggcattgctaatattgtttaagttctagaagaatcgggtctgcctcaattgaaatggaactgaaatttccaatgtttttctgttgactagaattctgttctaccaacctggtgtgctcacgttggttcccctgagctgatgagaaagtctcatcagcagctatatagttctcattttccacatttcttcattaaaattaatggtgactcaatgcatgcaatctctttgtaaataaaatattttcaagcctggagtccacagggggtggtaggagatttaataaaagggagccttttgagtgaagagatagcaaaccttttctttaagtcacataggtcccaaagccaagatgttttcttcctggacgaggtcattaaaaaccagcccaatccctctacccacagagaagcaccgcaccagtcaggaaccctatgagcccaggccaggcttcagctggctcatctccgtcaggacccacctggtcctgccagcctcagcatcaaaccactccaggctgggcagggggtcatcaattaatgagacagaaaagatgccaaatctgggccaggcacagtggcttacacctgtaatcccagcactttgggaggccgaggcaggagactgcttgaggccaggagtttgagaccagcctgggcaacatggcaaaccctgtctctaccaaaaaaaaataaaaaaataaaaaaacagaaaagttagctgggcatggtggcacatgcctgtagtcccagttacttgggaaggctgagccaggagaatcacctgagcctggggaagctgaggctgcagtgagccgagatcatgctactgcactccagcctgggcaacacagcaagaccctgtctcaaaaaaaaaaattttttttttttaaattaagaagacaaacctattaagtctaccttgcccatgactgaatccctctaagtgcctcatttccttctctacaaaataggaataacagaacttaactcacagggctgttttgagtatgacaatagacaaaacctaaagcacttacaacagtgcctggcatacggttagcactcaataattgtttgctattgttatcagttcttccgtcacgaaatgggaggaatgcctgtcccctacattgtccaacagggagatacctaagaatgccttttaagggtctgaacacatagtaagtgctcaataagcactggtttgctttgttaaatagaaaactcattattactaagccataatgctgtcgtttagaaatttatccctcaccaagaactcaccaccccaactcccaatggtcaacctcccatgaagactgtcactctctaaaatcccagggacccgcggcaaacatcctgatttcctcctagtctcttctcttccagctctctctgaagaagacgctgccagcaaaataacaccaaagaaagtatgtggcgacagtcaactagatttaagttcattttctgtagcttggggtcagaatcgactgaagcactctgatgatcaagttttctgcaattccctattccacgcattagctcgctgacagaaattcactgcggtatttaaagtggcagccatcacaactaactcaaattgtattggcttccccgatgctgaaatgctctgctgaaaccatcaattggccaattcggagataacgtggtggctgaaattccctgtcatgctgtaaaatccccttttgaagcggctcaccagcgcggagatcgtggagagccctgcccggagctgcgggccagggccgccgcccgtaacacaagcgggctccgagtgggatctggccggcaggcgggcagcgctgccaagaggaagagcctccagagagaggagaacattttctactggaagccgtctaaaagccggcgagcagagaccggcagtgcgcacacgcccggcaccaggcctgcccactgggccatctgccccctcagcaccggctggatggccaaaggccacaggaagctctcagcctctcccaaagaaagctgcaaaattcctaaaggatggcacagacacagacacgggcgccagcctcttaggtggaggttttctcaagtcagtggtggccccaggcttgctgtgtcaccagcctcagtgtccccatctggaaactgagtgtctccttcttcttgcacatctgaaacagccttctcaaaggggaccacaactcacaaagcattttcacgtgctctcacccaacttccaaaaagctggaggggcagaaaaaagccggccactgtttcctatcattttgcagacaccagacaacttacccaaggccatctgaaagaatcagatcttgtaccttggtcatccaagtccaaatcccatgtacagcccacaacactgcatctaatggcaaagcccggcaggcagcgggcaataactgcccaccaaccatctgccatttccatccggtctataaagctacgctctgcccctctcagagctcaaagcgctgcagcagtatcccagaatgtgggagaggcctgctcccccctctccactgcctcctctctcaaacagccttttgtgactgggaaagaaggatcagaggaaaacctcaggcagcggccccagggagcagttgtgcttcttaaggtcagaggactgtgaaacagaagtgaaatgtcaggcgcttcacccaaacacacaaagagcaggggacacaaaacctgccctggaagctgtgcaaacagctgtcaccaggaggggacagggaatttgggaggctgggtcaacctcggtcagacaggatgccttacgacctattctcactactgccactgcctaagccctgttcagacgcaagctccacggggggcaaggaaccccctccacccacccacctcaatcacagacaggcagaaggagctgccccacagccagccagcagggacaggctgcaaactcctccagctttgcctagagagccacatggactccgctattaagaagagtgtccctgcgctctcaggccctctcctcccgcgcccactccagagtggtccaggccacagtcccaccccctccaatgggagctgttacttactctgccttcaacaagcatctgttgggattttctgtgtgttcaatgcactaagactatggcagcaaaccacagagacaacggtaccaagtgcccgccaggcaccactctgaaagcacaacatgtggtggggaaacaatttcccgagaactctctaaggtatggatcatttccttctagtacagatctggaaactgaggctcagcaattgcttgtctcttgacccaagtcacttaacttgtaggaactaagattcagtctcagctgtctctgggctagtggccttctgactttgcgttgagcccccaaaaaaggcaaatactacaacacaaacccagggcacacatacttttatatgcacacataaatcactgaaaacagacatttccagaaacaatatttgtgtttactctgtgtaatacggttgtttcttttttggtaattaccagtcatgacccactaagttggtttcatgatgtattaatgggtcacagctcacagtttacaaacagtgcttcaccacgtgccccttgtccatcttcattaaaacgagtacttagcacagttgatgcctgggcaggaatcaaatccttctcacttctcaaggctcagagccttgctcacagaccccagaatgcattcaagacctgcaataggccccaggaatggggtggcagaaagggcaagtaaagttcctcccctcaaggagctttcattccagaaaggggaaggaagagacacaaccttaactgaaataactctccttccaggcagctggtaacaaacgactaggagagttacagagttagttcctggggaaaaaacagaagagggatgtcttcccataggagtcgtcctggcaggcctggtggaggcagccacattccaggctagcattggctctacagaagaataattggcaggggaggaaaaaaccctctcaggtggtatggtaccaagcgggaatcatggtgaagaggccaaagtggctggagaaagcacctgttccagattcctagaaaatgagaagtcactaggagagaagaaaatggacagtgatggggcaacttcaggccaggcacaggccagaagcatctgtgcgtccactgttttctcatcctcacaagcaccagggctggtttggaagcggcatatgtgacttgctcctccaatcactggggcagggagaacataatgtgacttgcccccacaatcccccaggggtacctgaaacccagggatccagagagctgatcaacagggaagctagcccatgatggttcacgcttcacaggcacacacctctcaccccaacgtcattctgctggccccttattatcaatcactgagaacactgcccatcaggaagccagaactcagaccaggccggaggtgaggtaagaaaaatgacagcacaggccgggtgtagtggctcacacctataatcccagcactttgagaggccctgacagtagaatcctttgaagccagaaattcaagaccagcctaggcaacaaagcaagaccacgtctctacaaaacattaaaaataaaattaaaaaagaaaaatgacagcacacatttatgcagaacttgcactgtgctaggcactattatatattgtgtgtatatgtgtaaacttaatctttatgaccttataaaggcatactttatttttttatttttttgagactgagtctcgctctattgcctaggctggagtgcagtgatgcaaccttggctcactgcaacctccacctcccgggttcaaactattctcctgcctcagcctccagagtagctgggactacaggcgcccaccaccacgtctggctaatttttctattcttagtaaagacagagtttcatcatgttggccaggctggtttctaattcctgacctcaagtgattcgcctgcctcggcctcccaaagtgttgggattacaggagttagccactgcgcccggcctggtatactttattaaccccattttccacccgaggaagttgaggctcagaggttacttaaggtgtccatgtttgcacagctcgtaactgcaacaaggcaaaggaaagaaagcatcctggactattgattaggcttgcaggcaggtttgagttctactggaaacttcacgcagggcacctttccctctgcgcatgtttctttagctacttgaaagaacactaggtgacctccagttccatcacctgcaatcctgctatttatatctatgataaatatatatttcgttacaacacaggggtgggactgtttacctccccccactgcccccccaactccatactgactgtatcttggtctcttagaaaaacaagatcattccacacaattctttttaagcccacatctcatcctggactgcatctgtctcttcaactagacagtaagcatagtaggagcttggtaacctcaaaatacggtagtgtcttattctcctggtctgggggccgactgatcaaggcctcagggtcaccccaggaagtcaaaagaaaaagaagccaatgtggccagaaccagcttcccatggacctgccatggctgacacttcccttctcaagctcactgtctccttaagactcctttttttttttttttttttttttttgagacggagtctggctctgtcccccatgctggagtgcaatggcgccatctcggctcactgcaacctccgcctcctgggttcacaccattctcctgcctcagcctcccaagtagctgggactacaggcgcctgccactatgcccagctattttttttgtatttttaatagagatggggtttcaccatgttagccaggatggtctcgatctcctgaactcgtgatccgccagcctcggcctcccaaagtgctgggattacaggcgtgagccaccgcgcccggctaagactcctttttttttttttattgtatgtgggaatcgcctttgtgggatttccacatacaataaaaggggattcccttatacaataaaaaaaaatcaggcacagtctgagcacctgccagggcaggatacataccaaagagaacagtgcaagactcctcatttcatccctgttaacaatgacacaggatttcacagcacaaccaactttccctggacagctttccatgcctctctcaaggccgtccccatggtgggctgtgccaggacaacccttgagcctattttacagtaaagagatggaccttgagaaatgaaggccccccacagctaacaaggacatgaagctgaaatgcaaatctagattcctactgatgccaagctgcatgccctctgggccttaccatttagccatgcagtggccatatgcaggagtgggacaggaccattctgcccaatacagataaggtgcacagacatctcagagacgccatttatcagtaccagtctgtgacaggactgccagctctgccccttgagggggtgcaggggtgagacatgacagcagggacgggcggtgggggggtttagaatcaatcctccctggatattgacggatgactgtactatattacttaaccctcacaaccactatgcaaaggaatcagcattcccccattctacagatgggaaaactgaggctcccggccaggaaatgaggatccctgacgatttccagccaagaaatgacaaagtggagactagaattcacatgggagtccaagccaccagtcacaacccaaatcctttaaaatccagaggattcaaaacccagggaaagaaatacacaacacagacacaaacactgctaaaactcaccttgccaaggctacaaaaaaccccgttaccggccaggcgcggtggctcacgcctgcaatcccagcactttgggaggctgaggcagtcagatcacaatgtcaggagttcgagaccagcctggccaagatggcgaaaccctgtctctactaaaaatacaaaaaattagctgggtgtggtggcacgcgcctgtaatcccagctactcaggaggctgaggcaggagaatcacttgaacccgggaggcggaggctgcagtgagccaagatcgcgccatggcactccagcctgggtgacagagtgagactccatctcagaaaaaaaaaaaaaaaaaaaaaaaaaacaaccccattaccccagcgaatcaaaaacaaacagtcatgattgtctatttgctctaagagctcccagcaacatgtattaaagaagtttatgtgaatagtctaatgcacttgtgccgtggtcagaattattaccaagctaaaaaagattaatttttctaaatactctaaaccctcagacactattataaaggctacagctagtgccacatttctgttatcttggctgacagatccccaagtacacacacctccctgccacttctccctgttaaggcttaaacacacacacactcacatacagaggcagggaagtcatgggaagggggccaggcacccttgactagggttccccactcgagaccctgcctccctcacaaaatagagacgacctaaggaactgtggggagagctgggtatctcccagctccctctgagtgctggctggcacagagctaactcttggtccaagtttgcaaatgcttagctaacaaagatggcattatgcgaaagactggtgcacactgctgctctgggagttcaaatgaagtgaccactgccaaaaattttgtttgggtccccaccactccccccgccccacctcccgccttgaaataaagggcaaggatttgcaatttggggtcttgccgccacttgaaacccattaaggtggctgcactgctcgggtgctggcaaaatgcaactccagtttctcatttaatgtttaattagctaccgatggaggagtctggcagcctctggggttaagaggaattgcagaaaacagggcgggagcttaaagaggggctgcaacccaaagcctatgctccaaggggaatgggggagaggggaaaaagaagtgtgtatgttttgtgtttttaatctgccacacaagggtgccaagggtcagagccaaaggcaacgccgtgaacttgccaggacctctgggcagatagctagcctggcttatcacagggcagcacactcccccagctctttgcagcccagctgcaggccttctccacctattccagcctgcactgccaccctcttgtccccctcccccgaaagggttctggcaggcatggacactccctgcctggcaggaacctcagctcagcacatccaaggagagccctctcaaatatcactttgctatttcaaacccaccaaggacgctggacccctgccacacagccacaaatacctcagtgcctgcccacgcccatgactctggggcactttcctactttaaccaaccctcctcaaggcaaagtctcccctctgctgagggaggagtcagcagtcttgttggggtgggagagcagagtcttgctggagtgggaggacagggccagggagccagcctcactgaggtggagcacacaacagccaagatgaaagggaactcaggtcttcagagaaaggaaactgaggcaagcaaggaaaattcatcaaggtcatggaactccatgtccatttcactccccaagttcttcactgggaatcagagaggcctggggttggagcagctgtccatgagcctcctgaaaccatgcacaaagtcccctttatgagggctttctggaaatactgtccatagcttttatcacattttccctgccaaaagttaagagccgttgcaccacaacaaacccccttcccagagttcaggtctcgcctctgccagtgactccacaattcaccttgcgggggcttccgttcaattctgttaagttcatttcttcagtgaacatgtcggggggcaccaaccagcatacccggtgccaggtatgcttcaggtcaactgcaaatacctcccctctgttttgcagggattctttatcaagtaagtgtcaataaaagctgagaggcagaactagaaagatagaggatttctagtctcagctctgccaacacctggctgcctgcccttggacaagccacctaaactctagggttcagtttcctcatctgtaaaatgggagtgagattttgtaacaaaacccaaccgacgaggcagctgcaaagcccagccacaatcacacacatgaaaacatgttataaaaaagtacagcaggtatgtgtagtgtaagaatccattgctattctctagtctctttggctcaaaggccactcatttcttggccttccaaattccactcatttcttgacatcaaaaggaaaacacaaaattagctaccacatggagaaaaaggattgcttgttgtttgagaaggcaccaaagacacttccctgcaggtccaccctggagaaagtcaaagcggagaaggtggccaggacacctctgggcacacagttagagacactcatgcagctgaaagtgtccactctacaaaaggtcaggacccagacaacagtgtctaagagaacccaaagagatgccccaatgggatcccatgggcttttgtcaacactctgagatgcactgctctggcctgagggtaacagcaaggaaattacaatgggaccgtgaccctcctcccgtgaccctcctcccatgacccgggggacctcttctgatttaatgcaaaccaatttatcagaaaagtccactccagatgtgagttcccccaatgctcccgttgcccctgtaagcacttcctacccaccgaagatgggtctggtatccaggctgcacaaactccccacaccctgagaatctttggatctccttgatagaaaacagaaggtcagtcaacagacacttatttacactctacttgattttctaaaaagtagttaaggcaactagttaattgacttcaaaatcaccttgttcgagagcacccgcaacaattatgtctctaaaagaacaccattcaagactcactcacccgcaagtgacttactcattcttacctaactccttcatacaatcagcacgtgtgcctgctacatggaaggtactgtgggagctacagagatgaatagttcacggtctccaccatggaaaaaattaataggctgtcgcccgaaagacaaccctaagtgagaagttaggtggaatagtgccaacaaatggtacttgccatgggcctgcagggccaagccaggtggtgttagaaacacccattccagagtcagtcatgactccatgtgtgtgcattctaactaccacttcccagctgggaattaaccactgtgtgcctcagctgcttcatctgcaaaatggagtgaacaacaagccttctctcatcgggtctctggcaggatatgagggactgaacctacagcagttagcagagtggcctggcacacggaaagctgccaacagaggctttgtataggtggtttttatagatatggagatgaaggcgtgatcacagaatgcagaaaactatctcataagtcctccaagaaggaggtcttaaaagatgaataggatttgaatgggtaagagaggaatgcattccaggcaagaggaaggagtcagcaagaagctactgcaatcattctagcaagaaggaatgaaggttaactagactgtagccacaagaagggagagactagatgaagactggagaaagacaaaaagaaaagtgggctccttttcctaattttctgaagttcttcttagttttccacttgcttctctgctgtcacccctccaactcaatgctaccccttaacgccttcataatccccattcatcactccatccctcctcccacaggctctgactctcaggccacatgataccaggtggagcccaattcaaaaaaaaaggtttttacaccccacacatatgaagtgtaggcctcaattagggtgacctcatctcttagtagcatcttctaaatgtcaacgccaacctcagtgatctctatacatttctactgccattcctcagcaaattactgaaagcaaacccatgtgcaaactttcatggccgccatattgtttcaggatggaagacgacaccacaagttgccaaagactctcaaatttgtagagcaccgaacttggttaaaatcattaacttctctgaaaggtacaggcaaaaaatagcatagatatgctacatcaagagagtgaaagacccacccacccatccccagattctaaaatgaaactatttacatagcagtcaaaaactagcaacagtgttggctgttcacaggtttaggaaaaaaaccatgcaagatttttactaggtagaaaggtcaaattcatcaactatttttatatggctgtgtacctcttagcctccctgaacatccaggtcaggaaaccttatcatcaccatgggattttcccagaagaaccacatcataagtgaaccggtggtgacctctccctttcactaccatgcaagtttaccagaccagaagtaccattcatcagcttctctttttcagccctgaagagggaacaagaactgctcaatttcctcagcgttacattccaagagcattaacttttcattcacaacaaaactgcatcacattgaatattctcaaaaccagtaggccaccacctgagtctctaactcctcacattacaggagaaattttcaccatgaagacattggtgatcatgggatttgaccacttgtgaaataaccagatgggtctggtctcttagccaatttccacctccacatgcagggaactcagatggctgggccaagcaggtgggacccaatgacgttcaagaaaccaactcccaaggacccatggtttcccaggatcattcctacccactgcacacagaagagcaagaccattagatcacctgctatatggacatgcttaactgtctacagggctagcaagaagaactgaacagaggctatggaagaccttcagacacgtcctcttccatctccccaagacagatcctaacccatttcatcagatcatcaagtgtgactgcaacccaggtttgaaacccatgtttgtttttcctgaaggggactgctatgggagatgaatagatggcagacaaccctctcgtaataatttcataaatcttaagaaactcatccaggtagaaagtgagtaacagggtagaaagaactacaatctgatgttaactagcttcacaagaatattttggccacaagattatgaactagctgaggatctcagagtacaaatcgtcttagcagatacagtatgagcccacccacaccaaacacacacacacacacacacacacacccataatttgaaagatcgctctctggaaagtagagcaagagagtccattccaccaaattctcactcaactccaaaacgcaagtttcctattggcttttgtttgttacaatttcttcttaaaccaacactaaagaggcttagtcccctctcagctaactgtccactcttaacataagtctcacagttctgagtcctgtacaacaccatttaattctccggatagatatctacacaattttgcacaattacaacattatgaaacaccgttcaccaagttagaacactgctggagaaaggtaccattgggagggctgcagagaggtgggcaggggaacagaaagaaacgcaagaagcaaataaagaccactgcgaactggctgtgtttgcttttcgtactagagaagttagagctatccaaccctataattattgctaggattaaaaatatgttactcacataatcatgaaaggcttttgcttcacttgaatgttcacaagtgtctctcctttcaggagctgcacagtaaaggtcccaaaatacactgcgaggaggaaaataaaataaggtcaggttactaattattacttgtgtacacaagggcaagtgcacgatgcatggcgctaacagtactaggtctcccaaaggctcaatcccaccttatcagctctcattgggcaaacagcctagaaaacaaaacacgtccaacttcttctggcaagccagccattagtaatggcagtaatagttcttatatatcaaatacctactacatgccggatgcttcacacccgtattacttgtgtctaccatatactgtaaggtaggcaattttctctccactttacacagggggcaactgaagctccaaggggttagtagaacctactcatggatgccctaggaggatgaacgcaaatgtggacgagaatccatactgttctaatctgtttcctttttaccacccaaaccaaaatggctgcatatcctaaaaaaggttcaagtgccaaagtcagaacacaactatgattcatatatgccgcgatttggaagactctggcaataggaactttacaggctcttaatcccagagcccgcacctccacccttcccacctcacccccactcccacccaagccctccctcaaggaattcttatgcaagaaccactcctccctccatgcaccaaaaaacacaaatcagttaggcaaaggacaggtcatggacaaccaagtatccagtcctttcacattgcagtagagggccctcttcacagaagcacctgtcagcaaagggaaagaaggaagcaggcctagaaatgcctgcctcaccccccactaaagattttgtatggtcactccgacattctgtattaaaatgagaacagacatacaagtcctatgtcaaccaataaagccctattcaaacacggagttgtcagtgatattaacaagggacctaagaaactctccaaatcaggagcccgaggcccagggacagaacaagcttaaagggtaaagtgggcaccaaaaccaaagtcctactcctggtccactgctcttgtcctcgtcacaaacagccagctctgcaagtcatcagacaagcatctcactcaaggtgtgaataatgcagcctgcccctcaccagacaagctccactgcttcctcccgctggagaaagcctgggtcatttgctcagtgtcaaatcgcacaaaccaacttctaccaaacagggccacagccactcaaagccaccaccgcccgggcctaacacaacagactctacgttcctgcggctgagataaggatggagaagtttcaggagattctggatataacaggaaaatcaggacttctactagctgcagaggggggctggagaacattcctttctgtcttctggaactgtacacatctgcttacctcctccacacgttaaaggtttctaacactacaaattccccggccccttcactcataagcctaagtaaccttcaatcataaacctaagtttctacaagatccaagccgatcagagccgccaaccccatccacacactccctccaaaaacagccacagaaagcctatcacccactcctacaggtggaatccttccgccacacaaatgcctccaagaccggcagttccgaggttggcagaagtaattaaaaactcattttctctgcacaagttagaacagacacttcatcctcctgctgttctaagagacttaaaacagtaacctgagctggcagataaacccgctaagatcccaacgacaggagacaggacacaccgttttgctgaactccatcaaaatatcaaaagccactctgctttcttttctttttcaaaaggatgtcaaagactccaccagtcagtcccacaaaacacccgggtcatatacctagggcaactggctccggctgaccctgagctccctcctggctgtcatatacccaacacagagaccagacctgcggtggccccacacccaaaggacacagaggcctggttagagagtcacagagagtgggagcccctaactgcagacactgcgaggtcgactctgaccagttaaggttctgcgtaaaacaacactttgtggttttagtgggggaggggggcggggagctcccagaggaaaggaaggaccagtcagtctgaatcagtatctttaaaggaagtggcagccctttcttgctctttctcagggtgcctggaaaaagccccggtagatgtcctctcttaaggttgtgagctcccgaggagaaaaaggaagggacaggctagttgtaaaacagacctggtatcccctccacgccgccccacccccactcctctaattaaagcaacatgcagaattgacaaaaatcctccaatgttttttcaaaccccctgcctagagccccagagtgaaatgtaaaagtaaggagtttctaccccaacaccacagatggttttgtcgtttttccccccaaaactttaggtaacatcctcttccgcccttctcctccttggccagctgggccggagtgcctcgaggtgccccgctctgtgcaacgcagagggccacagggcggagggcctgctccaagcctcccttctttgttcacttggacccagggctcacaacaaaacaaacacacatgcaaaactatcacacaaacttaccaccaccacgagtgcaaaaacccaggcggttctcccaacgtgatgtttttttcccatcgaatctggaaaggtaagagcagaagcagcttagaggagcagagacggggtgggctgggggcttcccagagccaaaaggctaggaagaccaactaacaataaatgccaaaaggtgataaaaattcaaaatggtggccacagtggctgctcctgaaaacaaaggctctaagaatagtggggggggggggtgtcaagaaattggatgctggggggagtcccactcacctccgataagaaggtctgtgcagatttctgtgctcctacgtgcagtaaatattcgtagacgtataaagctaacctggaaagtggacagggggcaaagagagagagggaaaggcgtcagatcccaccggcgctctccaggaccttgccagcaggctttgagccctgtctgcgccgtcccattgtggccccgaccagaggtaagcagctagctcaccccaaacagggccgccaggtgcgaacagttagggggtggggaccagggaacgcgttacctcaagcggtgagggatggagagcagcccccaaacttgaacttccaagtggcgtcgcgggcaaacccacctaggttcctcaaactcgcaagccactcgaccccacagccaccttgcctttcccgacccactgctcgctacgctctcgccagctttggaggtccgaggagactcggccctggactccgggtgcttggcgcgctctggagagggcagcaaagcgccaccctcgtcacctccccccaaacaactgtgccccaagcctggggccaagccggcaccaccgtcgctgcccagcccggcgtccgaggacgcggagccggtgacgaagccgaggacagggaagggagagcgctcccggccgaacaaagcccccggcacgcactcctcacgccgcgggcggacaaaaggaggcttcggggctgcagaagccacgcgccccctgcccgcacccggtgggcaaagtgcggccaccgcggggagcgcccggctggggagaacgtcgaggctcgctggcgggacctcgcccaccactcaccgcgggcccccgcgctcgacccgcgccacggccaccaagtaccccctccggcggctccccccaccgccccttccccgatcccccaacctccgccggctcccaacaatgggctctcccacgccgcccgccgcggcctcggggaaggggccaggcaggcggcgcctggacccggggacccgagggcgcagcagcctccggcccccgcccgcccgcccacctgcctcccaccgcccgcccgcccgcagcccggcggcggcgcggccgccacttgcaaaatagggcttacttttcccgagcctgcccatccgagggcaccgccgagcctttgcctttggcaaacatggtttgcagggaagagggcgccgagcctcgccgccgccgccgccgccgccgctaccgctccggctctcccgagctgcccctcgctcccggccccctccccggcgctcgctcgctctctcgctcgctggcgctctcctcgccgcgctcccctccctcccccccaggcgctggctccgcgctctttccagctgtcaaagcgtcagccccggccgcggccccatcgccctggaactccttccgcgccggctcggcctgggggtgccgccgccgccgcccgcacggccgcccgctctccgctcgctcgcgcgcccgcccggctccgcctgcgccgccctctgcgcctccagcaccgctgccgccgccgccgccgccgccgccgctggtctacttggagctcaaccgaacgtggctacccgggcgagggagcgaggcgggcggcaacgtcccgcgatggatggccgcctcggccaatcggcgcacgcgggggcgggcccgggccggctgggagggacgccctgacagcgccggccgcggcagtccccgctgcggccgcctccgcggagccgctgcctgctcctgcaggcgaactgggggcgtccgggggcgcgagcctctctttctgtcgccggggcggtgggcgacgtggatcgggctgggggcaccctggtctcctcgccccagcgaggagggggatctgacccgcgctccccgcggcgtggaccactggggggctaggggggcgctgcggcagcgtccgatgggagggggcgcagacccccaagcggtcgccgctcgctccctcccgccccgtccctctcccttatctgcccctcagctcccccccgccgcggcccgcaccagcccagcccttatctcgccctccgctcttggttgtcctccccctaggctccgaccccgaccccctccccagactccagcccggcccccagcccgccccgcccccgggcctccctctcgcccagtctggcttccgagcgccgggcccggggctccacgctgagagctgggcggctcgagccggcgccgaggcgcgcggctgctcctttactagatcattaaaatactttggaaaaccccaaagtggagccgcgcgaaaatggcccttggcgtgctttggggagccgggggggaggggggctggggacaggggacttgaattaagaggagggagagtgatttctcccaaatttccaaggtttgccagtcttggcaagttagcccctcggcttctgcacgggaaagggtgccactcggagatggggggcgtcacctgggcggcccgcgacgcggaatgctcgccacagaaatctgcaaacttcaaataaatggagctaaattggggagtgaggggacgagagtcaggcgtagggggaggggaagcttccattgtcagtgacccaggtgtacaatgggaaattgaggggggggctggcagagtgacccagctatttgctgctgactcctttctgcccacgccgagaacccagaagacacactgcgtgcccctcattagggactcttaagaccagataccggcgaaataggggaaggctcccccattttcagactgtttttagagagcggatctctttaaatgtgataaaacactgtcggcactgtctctttaaaagagtcaagcagaaaaagctgtgtaagcgctgattggctgcctgtttggatacatctttaggggagccttgaaactgttagcctaggttgattttttttttttttttttttttttttttaactgcgctgttccaataaacaagtaacgcccctccccctaacatgcctcgcaccaaacaattaaaggataggtcagtgtcctggggaaaacacgtttcaagtaggaaaactcagaactagatttcaacaaaataaacaataattccctaccattaaagtttgcttattttgatctgtagaagagagaaaaggggcttttaaaagaaatgccccgcagcaaaagaatctgcattggttcaggaaggagactctgggtgcatttttggaataatgttctactcaatgtaacaacctccctaaattagagtacagccaggccctgcggacacctctggactcactctgctcccttccaggacccagcgctcacaggggaaaggggcagaaaaaaggaacgctgagacctagtttatgggcgtctgtgcgctagtccctattttaaaggttgtttcgtgaatgagggaagcatggaggttgggagttggaatacaaggataggggagagaaggaaataattacagttattttttcccctaggcggtttaatttaatagggctaacttaaggtaccttagagcccacactaattaaattggcctgctcatacccttgccctggacttccttctattttgaatgggctaggaatggccagggatggcttgtcaacagactgactcacaagaagcctgactcatcttgtgtctgcaaggcccacaaattaggagtatcggtttggtcctggctaaaaaaaggaagacactgcccttctccggccctgctatgacccaggactcaaccagattggccatgcccttatcaacttcatggctgcaacacaagcatatctatttgagcatcagtttcttcacctgtcaaatggcaaagggaggttagaagatatacagtatctcttgataatctgatgtgctacaatgttaaaatttccctcctatatttttctctccctaccaccaccctggaaaaaggactagcacctcctttccaaacatgtggcaagaagagaggggtagggttcagagatcctgtgccaggcactctgtggtcagccctttgctggaacttgacacaacaaagctgcacgatggttggtagatcccttgttggagctaaaagagatggtgagagggcccgggcagagagagcagggagagtgtcttagccacccctcacccctgctggctagaagattgctgaggggttccctggaagcaggaccactcagcagccctaagtaggtgtgtggctgctggcacaattatccaaaatgtggtcagatcagaagcaagtccaaacacccatgaacagcattcaaggccccagtctacctttcccctctggatccccccaggccacatctttgggcctgaagtctgtcttcctggaatgcttcctgcctcagttcccttcttctaccatcctttaaggctaacatcccctccctccagtgccatctcctccacaaaaacctccctgcttctcactcctggagtgaaacctgtccttctgtccctccaatcttatctcgttttgctggcaccattcattctccccattgttgtagccacttgtttactgtctgtctcccccaccagactgggagggtaggatctcagtttgagttatctgtgtatctccagcacacagcgcaggctcaatacctgtgtatgttaacactcagtgcaggcaccaggagcccccagggaccgagagagagagggaaaactcaccccagccccaaagtactgggcccagtagggagataaggaatggataccaccaacaatagggttagataaggccactccctcggctcagccacaccctcctaaactacagacacctggaactctgtactttcagtttccagaatggctatgccatttcacacatccaccctgactcatattctctctgtctctctgtcccccatctttctcttgcctccctcccttcctttttttcttttccttctttcttttaggacctgcttattgaacgcctgctatataccatacgctgttctaggccttgggagataaaccagacaaaaatccttaccccgtggaacttacactgtagtgaagtcccctgcccaaagccccctccggtgacagactcccactaacacttctcagatccagcctgggcaggcagcatctccttcagagagccttcccagatcccccctctgaactcccagttcggggcaggtgtgccctctgtgtccccactgcatgggtgtggttcaggggtgcattttccccatgggaatatgactccttagggtcagggaatgatcatcattttctggggtaccctcagtgcccagtaacatggtgaaaggaacagaaggacagatgaactgggtgaccagatgttgcaggacatgcaagtgaggtgggagtgaagacggagaggtgaattccaagcttaggctagaagggccgctccttcctctcttggctgccagcaactggggcagcaggaatcctgggttctggcaccagatggttggggtccaggcctccagaaggaggtggttaaaggaaaagggactttaggcccatgaactcaacccaggagactgtgcttgccaaggatgccagaagaccttgttccctttccctggttcaaagctctctttcagtgctcctcacagctgctaggaggatggatgcaagctcccgctgggggctgtttcagtggaagctgagtatgcagcccacttctgcacccggcacgctcagtcctagaattgcacggggatacctctgatcaaaaccttcgggccggtcagctctggttttagcagaagtttccctgagggatcgggggcctccacagggggaatacaaaatccaacacgcaaagacctggcttcactgccttgctggcagactttgggcaagtgaccttcccctctgagcctcaccgtcctctctgtgcaatgagtatgttaatgcctatgccaaaggcaggctgggaggacaaagagaggtaagtgatggggaatcgcctactaggctattagtcagtgttggctgagcccaaggttctgatgatggagagtagccgcttgggatgggtgtttgggggctcaggggagacagtaattggggaaatgtttcgaaaattgaaaaagatgattactcatggccagcaaacagagaggtgctaagaaagaagtggatttaaatttaaaatcaaatgtgttttgaaatgtcttccaacggacacatacttctcctgagccaatttgtcatagcaaaacaggcttcaagtatggaatgggttagtatagaatcggttagttcaatttgaaagcacccatgtgctcagccttgttttgttttgtttttttcctacctatttccttcataagaatttaagcatttgagctaggcacggtggctcacacctgtaatctcagcactttgggctgccaaggcaggcagatcatgaggtcaagagttcgagaccagcccggccaacatggtgaaaccccgtctctactaagaatagaaaaattagccgggcatggtggcatgtgcctgtaatctcagctactcgggtggctggggcaggagaatcgcttgaacccaggaggcgggggttgcagtgagccgagctcgcaccactgcactccatcatgagcgacagaacaatactctgtcttgaaaaaaaaaaaaagaatttaagtactctgacaggccatggtggctcatgcctgtaatcccagcactttgggagtccgcggcgggaggatcacttgagccagggacgctgggaagtacaagaaagcagaaggctgccgggcgcggtggttcacgcctgtaatcccggcacttgtggaggccgaggcaggcagatcgcgaggtcaggaaatcgagaccatcctggctaacacagtgaaaccccgtctctactaaaaatacaaaaaattagctgggcatggtggcgggcgcctgcagtcccagctactcaggaggctgaggcaggagaaaggcatgaacacaggaggcggagcttgcagtgagccgagatggcgtcactgcactccagcctgggggacagagcgagactccgtctcaaaaaaaaaaaaaaaaaagcagaaggcaaggccctatcctggtagctggggagaggaacctgacacccaccactcccccaactccacctcaccagactcaccagagtgccctagcctctgagttctctcagcctgggaccagcatggctctattttcattcacttgccaaaactttgctcttgctggtcactcttctccaaggtaaaggcttcactcccacctcatttcctccaggtcaaatcaccagagcccctcccaaaggaacctctttagaatgacagctgccctcggccaggcgtggtggcctgtgcctgtagtcccagctactcaggaggctgaggcagaagaatcgcttgaacccaggaggtggagattgcagtgagccgagatcatgccactgcactccagccagggcgacagaacgaaactctgtctcaaaaaaatttaaaaataaataaattaaataaataataaaggaatgcagttctgatacagtctatagcatggatgaacgttgaagacattatgctaaatgaaatcagccagacccaaaaggacaaatactctacgattccggtcatatgaagtacctagaatagtcaaattcagagagacagagtagaaaggtggttgccagagcctggggaaggagggagtggggagttagcgtttaatgataatagagcttcagtttgggaagatgaaaaagatctggaaatggatgatgattccattggttacacaataatgtgaatacactcaatgccactgaagtgtacgctataaaagagttacaatggtaaattttgttatatatattttactgcaatatttttttttgagacagagtcttgctgtgtcgctccgtttggagtgcagtggcgcgatctcagctcactgcagcctctgtctcacgagttccagtgattctcttgcctcagcctcctgggtagctgggattacaggtgcacgccaccacgcccagctaatttttgtatttttagtagagacagagtttcaacatgttagccaggctggtctcaaaactcctgacctcgtgatccacccacctcagcctcccaaagtgctgggattacaggtgtgagccaccgcgcctggcctgcaattttttaaaaaactaaaaagagatgggtgatgacccaagcatcacatgtgggaaagacttacggacatggtgcagaatggcgcagcacacccctgtctgagcatcagaggttcccatgctcctgaaaccctctcctcacacagcttcagggctccactctctcctggttttccctcttcctctcgggctattcttcctgttatcctttaacggattcttttttctccagcctcctctaaaaattttattagtcaaactattgctgatacagtgttacctaacacacagcccccaaatctcagtggcttataataaaagccatttatttctcactcacaggtctgcagtcaactgggcagctctgcttcagggtacagcttgagtctgtcccatgggtctctcattctggggcacaggctgaagggcagaggatgtctgtcatgttctttccagagtaaaaggagctccagaggccaggccaactcacgcaagcctcacatccgctcccaagtcacatggccaagcccagcatcaatggggcaggaagggggagtgaatgtttgctgaacagtagtaaaatctaggacagatgggcttctctcaggctctgtcctggaccttctctctctctttgggcaagttcacatggcactaattgcatctgaacttcaatgacaatgactcctgaatccatcccactggcgcagaccctttttcttagccccaaagccatgtgtgttcagttacagagcatttccatctgcctgtctctctggtgcctcaaagtccatgtgtccagagctggcctcattatttctccccatccaattcctgtagtcaatctccatttctgtacccggcaccaacaccgttctatcaggtgaggagagcacacagaaggtgccgtgtttaccagatccagctggccaagcttggcactggctgggagtgagaaagaggagaagcagagaccggccccatggtgtgtggtagagatggttgggtccagccctgaattgttgcacagcccctaactggtctccctgccttcagaacactccccttcaccctcccttccccagccagagggatgtgtttaaggcacaggtctgaccatgtcacgctcctgcttaaaaccctttggggaatcgccattttatccaaaatgaagcccaaattctgcagcaaaaagattcaaggtccttcatgatctgaccctatctcccttcacagcccgttgcttgttggggattgtcctggatgtgggggatggatgtgtgaacaagagagctgtggtccctgcttcctggaggtttgtcacctgtggggaagcagatgactccattagtacctacaagatccaacgtgacaagggtggtgatggaacacataggcccccgtgggcacagtgcaggggcgctaggctgccccagggtgtcaaggaaggcagctggaggaggtgaccttccttcctctggctgtaatgggaatggatgagtgctctcagggggaagctagggacaggctcctaggtttaccagcagggctgatgcaggaggagccagtgaaggagaccaaggaggactgttcagagccgcagaggaggaggcagccccgggaagacagcgcttccaggagagagtggccgagcaacggagagcatgaacacggcttttggaaagagctctgtgaagggcacagttggccggtgtagagcagtattactattttttttaagacggagtctccctctgtttcccaagctgtagtgcagtggcgcgatctcggctcactgtaacctctgccttccgggttcaagcagttctcctgtctcagccccccgcgtagctgggactacaggcacctgccaccacgcccagctgatttttgttatttttagtagagatggggtttcatgatgttaatcaggctggtctcaaactcctgacctcaggtgatccacccacctcagcctcccaaagtgctgggattacaggcgtgagccaccacgcccggccacgtagagcagttttaggggagtgatgaggctggagccagaccccggcagtggaggagtggaagggaggcagaggagagagaatgccgtggaggagtgggagggagagaggagacagcaagtgtggataactcttggggtaagagacagccagcacccacaggtaagagtgttgctgtgttttgctggaaagtgggagacactagaacctgcacaaatgctgattgcagggagtccatgcagagggcaaggctggaggaactagatggaggttgagggtgaagctagcatggagtccctaagaagagggaggagagtggcctcagtagggttggaaaagtgccttcacctctctgggcacacagacatggagggactcagcctgcaccatcgaggcgctcacagtctaggagatgaggctgtccaggggaaacaggcttggagctgtggctttaaaggatgagtaggagtttgctaggcaggccagcagaggtaaagggatcccagaccatgggaacagcatggacaaaggcacagaggcatgagacagccaacatattagagcaatggtgggttcagggggtgcacatggggctcaggaggaagtggtgatagatgaggctggaaggtgaccaggaagctcttgcagcttcatgtaggaattcatgagcatctgtgaactcaggacccagcctggacacctgtggatgctgagggatgccaagaacaggttcctgttaacctctgtgttgcccggtacttggcttacatgtgtgccgaataaatgaaggatccatgttttgtggcaaagcataacagagtaatttcatcctgaggatgagtgtgctggaaatggcaaggtttcttcatctgagccactcattccattccatccgcgtacccgacaccgcatgggtggggatacagagatcagcactagatgcccaaagagtgctcagtaaaggttggttattccctctgtggagccctgtgttcaaaacttcccatctagccacccctcctacaggggctccagccctgcttccttcccccgtcagcccgtgctgggggttgagaggactccagagacatgcggatgacacatggagtgtgccagtcagcggccctctcaccctagcaatctggggcacccggagcagagctcgcaggcttgttctgtgattctgattcctgtttccacggaaacagacatcggcaaacgtcaaagtcccagctttcaaatacaggtctcttccaaaacttactctcacatgat

SEQ ID NO: 1322 - DNA, 78438 bp, Homo sapiens
cggcgggttttaataagaatcagattatgcaaggccgaaaagcctgccttgctctgttatttggtcagcgagtccccagccttgagtttttatctcggcaggaagacaaaacagactcacatgaagcagccagaagatcaagtgcaaaacagtgaatcagcaagggcaaatgatatggttgcagttgaatacaaaagcccggaggcggctcgggttcaaggcctatcagaggcagatgttcagaggatcttgagaccaggaagggacctcaaagcgtcagaggctgatgagcagttaggcagccaacagggctcaagcggcgcagggacatggcttgtatgggcgggcacacaagtaaacacacaggctctctccagcacacaggaccaaggcatcatgctgccagaggggctggtgtttgccactttgtcagagtagggctgtggattttgtgccttgcttgggaagctctcagggatggcaggatggcaggctcctaagtgacagcaggggggaagcttgaggcacagtgggtggtccttactctccatcccctgcctgagaaccaggaagcctcattcagagattagcccctttactgcaggtggtagcccaggtgcagccaacctgcttcagggtctcagggcctgctgtggacccccatggtcctgggagagactccttagaaacagcagaatcacgaacatggtgaaacccatctctactaaaaaacagaaaaattagccaggtgtggtggtgggctcctataatcccacctacttgggaggctgaagcaggagaatcccttgaacccgggaggcggaggttgccgtgagccaccgcactttggcctgggtgacagagcaagactccctctcagaaaaaaaaattaaaaaaatagaaacagccggggagtggagggtgtggtcagaaagcctcagggacctgcttcagccttcagggagttcagatgaggcacaatgaagccactggcctccactcagccattcttccctgcagctcttttttttttttttttttttgagacaatctcgctccatcacccaggctggagtgcagtggcacaatctcgactcactgcaacctctgcctcctgggttcaagtgattctcctgcctcagcctcctgagtagctgggactacaggggtgcgcccccatgcccagctaatttttgtatttttagtagagacggggtttcaccatgttggccaggctggtctccaactcctggcctcaggtgatccacccatctcggcctcccaaagtgctgggattccaggcgtgagccaccgcgcccagcccctgcaatacgtcaacagtccctagattcaggcaacatggagttgcagccaaggaactttgaggtagtgaccaatgcagggaggtctgacagagaatcagcaggatccatttcatggccaccacacatctgactgactccttcttgggctaagcaaatacttttgtgggcagtgacactggcagctgctggggtcttggcaggaggttggatggaggtcttctcccagagcagtgtccagcttgcaggaatgctccctgcgtctcagttgtgcccattccaggtccaggggaaagaagtgacccgcttcccctctgaaagcagatgtggtcccaacaagcaaacacggtctccatctccagcaccacaactgccacggagcagagggaggcctccctgtggagcagcccttccctgtggcctcagcccatgccctcctgcccagcccccagtggtgctgctggagggtctgactccacgggctcccgctgaccttgccgttccttcccctcatctcgtagcgcctggcccctggaggaaggtgggtaggaatttgacaccggataaataaatgtttgaggggcaagagagatgggacagagttcacccaacaggacagacgaggctggcagtcacagcagagggcaggcactcaggtctggagaggcagggcatggagacagggacccacactctggaaggtttctcgactcccccgaggggctggccagttctgtcttccttctgcccactctgtggggaggagcctctctgggatagcgtcccctcactcctctcccagcctcgtttatcttcaccacagtacagaagggggcccctctccaggcctcaccacttaacttttcttgtacatggaaagacaagcctctgctagaggcctggcaagggttccccttcagagccagccagtgctctgctgctgtaatctccagggaccctgccggccacggcccccatgcagctccctccctcaatccaaccctctttgggcttatcaccctcaaggtctagagtgcaccagggttggctgctctgccaagtcctgttgagactccaaaagcatagtctgtctttattagggtgaccttcatatcagactcccaggtaactcaagatgatagctttgcaatatagtgcctccttttattcctatttgtgagtttctccgctttcctcactagactgagagggtcttgagggtaggagctttgttttagttatctctctatccctggcccctaagacactacctggctcagcaaaccaacctttgagacaaagcaacattataacactacattcatatagcagatcatttcatgacccacattctccttcctttttacgaagaaatgggctcaggatgtcttgtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggaccagcccctctacctcatgctttcttcctgctatctcgtaagagcccaacatccttctgtcctgagcaagccacaagctgcagccctgccttgacaaaatggcaaatgccagcccctctggcagcatgacaccttggtcctgtgtgctgcagagtgcctcatgtgttgaactgtgtgccctcagaagcatgccatgcccccgctctgctggagcagtggcagatgtcacccttcctagataaatcctggacggctccacgactggcttttagccctcaacacttggcctacattctttctggcttggttggagaaggaaagaagcagttggaggcatgactgctattgttccttggcttctctccatttgtctcaaactttcctaatagagcaaaattgctgagtggtctctatttaccaacatgaaacagaaaaataccatctcaggctccatattccatgtccctgttgaatacagatccccgaactgagaaataagaaacaactacatacgaagtaatacttgaaaatgtttctcttgtaatacttccatatccaaagcatttgaatatatttattttattgatgtaggtctgccaactcttccttctcaggaaggactgtttttattccaaacatgtatatataaggttaaaatgtattttttaaaataagataattattgatagttgtttttaaaatagccttgcttagcaaaataaatgttggcaaccctaagtttgttctattataatattattgaaattacattgaattctgaaatccatgtcaacttgaagttaccaagttttaaccactgttagaaaataagcaggaatgaaatctgtttcaagcgtttcaatttcaatacaatttaataaacaggctttgagcatctacccccacccccttttggtttttttgcaagcacctggaggcagagctcatgtggagcttacaatttagtaggaacacaggcattaattacaaagtaattacaatgctgatgagtgtgttgaagtggagggggctatggggcttcagccccaaaaagctaaacctgcaggctaaaactttaaaaaaatatatttaattggcaaataaaaatagtatacatttatggtgtacaacatgttttgttatatgtatacactgtggaatcactaaatcgggctaattaacatatgcattatgtcacatatttatcattttgtaatggtgagaacatttaaaatctctgtgagcaattttcaagtatacagtacattgctttttttgtttttttgaaacagagtctcactgtgtcacccaggctggagggcagtggcgcagtctcgactcactgcaacctccacctcctgggttcaagcgattcagcctcccaagtagctgagattacaggcgcacaccaccacacctggctaattttgtagttttatagtagagacggggtttcaccatgttggacaagctggtctagaactcctgacctcaagtgatctgtctgcctcagcttcccaaagtgctgggattacaggcgtaggccaccaccccccgcccagtacattgttattaactattgtcaccatgtggcacaatagatctctggaacttcttcctcccatccaactgaaagtttgcattctctgaccatctccccattccaacaggcaaccaccattctactctctgcttctgtgagttccactttgttaggttctacacacgagatcacgcagcgtttgtcttcttgtgctctaggctggatcttggttatcagcccaatgacaagcagagtaaaggcccggaagttagggagaccagggctcagtgtggctggcactgagagctgagcttctagcgtgggcccacacatacatttaagactgtagccaattttcctttcagaaccacgatgaagaaatgaaagccaaggccaagaaaatctttaatgttctgttcctcccctgcttgggaagtagagtggtctgaaggctccaacacagaatctgtgccataaccaagtcttatctggggcaagttacataactgctcatgaaataggagtgataacaatgcttcccccagacggtttttctgagggttaaataagaattttgtgggacatagtaatcactcagtaaatgttctggtctgagagtgaccaaaaggatggaactagagatatttgggcaagatatttgctatggcctgaacgtctgtgttcccctaaaattcatatgtggaaatcctaacacccaaggcaatcgtggggcctttgggaggtgattaggccatgagggtggggggcccccattaatgggattagtgcctcataaaagagatcccagagtcacccctaggcccttcctctcactgtgaggttacagtgagaagatgaccttgtatgaaccaggaagcaggctgctggcatcttcatcttagactttctagcctacagaactgtgagagatttctgtagtttataagccatccagtctacattttgtataacagaccaaacaaatattaaaaataacttcgtgattagaagtgctacaaaatgctagactacgcatggaaccaagagtttctatttatttactttttgagacagtctcactctgttgccaggctggagtgcagtggctcaatctcggctcactgcaacctccgcctcccgggttcaagtgattctcctgcctcagcctcctgagtagctgggattacaggcacccactaccacgcccagttaatttttgtgtttttagtagagatggggtttcaccatgttggccaggctggtctcgaaattccgacttctggtgatccacccacctcggcctcccaaagtgctgagattacgggcatgagccaacactcctggccaaccaagaggtttcaaggaaaaaagccgtaaacttttggtggttaactgactgtggtcctaaacagaggcaggggctgtgtgcaatgacttctcaggatctctttcagcctacaggttcctggaatgcatttcagctaacactacaagagtgatgtcccttgctactgagaaccctgggaacagctcagctccatggtccagccatataaatctgataaaaataggagctgaaataccatcctggagttgctatttttaaaatcatctgagatgctggatggggtatatttcttcctcaaacacatcttgctgtttcctcctcttggtgggcaggatgctaacgtggcacatgatacaggagctgttccacgctgctgctcacacccactcctgccagagaggggccgcagggccagggcttcccagatctagatgcacctgctcctccctctgctcctgaggcccctctggttgccccagcacagaggtgtcctgccacttccaccaagcagaaacacaggagagtttgggaggcaaaggaaatgggaatggaggcagcactgatggcttggaaggggactaagacctgttgttcctctggttgccttggtcccactttggcacagttaacatccaaaagaaacagtccccatgggccaaagccctgcttatcccatcctactgcctcttgctgagccgctcatcatgtgttgtagttgcaccaaaggggggcctggggccaaaaaagcacatggagaggagagaggagagaagaggagaaggaaagatggaaagacaagaaaagagagagagagaggaaggaaggaaagaaggaaggaagaaaaaaaaagaaagaaaaagaaagaagaggagaaggaaagatggaaagacaagaaaagagagagaaaggaaggaaggaaagaaggaagaaaggaaagaaaagagaagaggagaaggaaagatggaaagacaagaaaagagagagagaaaggaacgaaggaaagaaggaaggaagaaaggaaagaaagaaaaagagaagagaaggaaagatggaaagacaagaagagagagagagaaagcaaggaaggaaagaaggaagaaaaagaaagaaaaagagaagaggagaaggaaagatggaaagacaagaaaagagagagaaaggaaggaaggaaagaaggaaggaagaaaggaaagaaaaagaaagaagaggagaaagaaagatggaaagacaagaaaaagagagagaaaggaaggaaggaaagaaggaaggaagaaaggaaagaaagaaaaagaaagaagaggagaaggaaagatggaaagacaagaagagagagaaaggaaggaaggaaagaaggaaggaagaaaagaaagaaagaaaaagagagaagagaagaggagaaaggcaccagaattgcttccctcctgccccaaagatgacatggcttctaggcagtgagctaagcttgtggccatgctgttaagaaactggagggaaaagatcatcatgagtaagcacattgtggcctaacctgaggggagcagaattacggttagcttctgggcacctagtaaccaggcttgggataagctgggggagaggcctgaatacagcttataggttagaaaaggcacgccacctgcatagtaacagcacacacttatatatagcaggttatgctttcagaccaaattcgcatccattgcctgatttaatgccaacaatagccctttgaataagcagttatttcctttcccctccccccaccccagtaagaaaactaaagctatttagtggcagagacaagagttggaactcaggtctccaggaacaaatgctggttcttaagttccattttctggtagagtgacatttacgtgattcacggcaagaactgcaaactgtgcttagatctagttcatcaaatggccaagtttagaggctgggctgacgcttggatcagttctgtcagattcacttagttatgaagggcagctgcttactccctttgggccagtcttcccatctgtagaacaaggaggctcttccctcttcctcgacttgcccgaggcagggacttagtcattgtgttctttatacccagcttaattccaggcctggagatggcatgcaataaatagttgttgaatggctcacgcctgtaatcccaacactttgggaggccgaggcgggcggatcataaggtcaagagatcgagaccatcctggccagcatggtgaaacctcgtctctactaaaaatacaaaaattagctgggcatggtggcacgcgcctgtagtcccagctactcgggaggctgaggcaggagaatcacttgaacccgggaggcagaggttgcagtgagccaagatcacgccagtgcactccagcctggcgacagagcgagactctgtctcaaaataataaataaataaataaataaataaataaataaatagttgttgaatgcatgtctgactgattaagccaaaggcaccatattcaaacaaaatcagacactggtgcaatgccaaacagcttctgcccgtgcaaggaatgatttagcatggagcacagtcacctgcagaggaacaacttggaggcagactctccttactcagctcacttggagcagagcttcctgagttgggggttcttgacagataagccctccagcttcagcagaagcaggcttggagctgccacttctctgaacccccttgcacttactgtcagtcactcacaccttgcacttattcacatcctatcctgcctcgttcttgaatggagtccatggtgagccttctctgtgccgctggatggtaagcttcctggggacagggaatgggtctgatagtttccttggagcccctggcgctcccggcactgggctgttgatacgtggggctccggaaacactgtgctgacctgtgaaagggactggcctaaggggctgtggattgtcctgtagggtgacttctgaactgttcttcagcctgggcagttcccaggtttatttggggggatgcctgggtccaaagaaccagggtcaggggcccaggggtttcttcctggagacaggatgcctggcgccttcaataacggaaaggaaactgagaaactttctgaggccaagataaagagtatgcaagtgaggggtgcagagagagcagtttaggggcagcaggccccaaccgaagcagaggaagggcccacgtctgggcccaggggactgactggctgccttgcgtgcatggggcacgggaagcataggctcccggaacaggaccctgccccagtttccccagtgagggaaggacaccgttccccgtgggatagagcactgcaccctttcttgattctcattgttcccgggagcgagcgccttggctgcgctgggcatacccaccctggcgccattcacaggcagtgcctgccctggccctgtgctcaccccatcaggcctcctcttccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagcagttgtgatgtcctgtgtcctttcaggtgggggaaggcatgggacagggtgtggcagtgggcaggcttgttagaccagagcagggcatggtcactcaggaaataatgacttattgagtccagtgttgggtgcccggtcatgcattatcaccctggcatagcaggagagtgagtggtgctcacagcacccgtctgcaggcacccagcctggcacccggcaccctgggttactgcccagaggagggaggggctggaggatgccagacgagagtgccagagtcctctcccaccttccttcctctcttccccaccattcttcagttacccaaatctcatgcttgggaggtatgtgttttaaggacaggggtggggtcagacaaagaaagccaagtttcccttctcagattaagtgggaaccagaaaatggagtttatggaaggtcttgccagcggcccaggctgccaggatgggatgggcaggcctggagggcagtgtggaagggatttggcaaggcctaacagccagttgctgggccaggggatgaaacggcttctttcctaggtctttagcatcctaacaatcctgccgtttgcctgtctctcccgccttcgttctccatcttcccagatcctgcttagctgccaactgggcttcctgccaccccacagctgttcctttacatctggagccaggagggagagttggaactccccacttggggaatggaactggcagctgtattcctggctttctcggaaagagttgcggccttgaggttttgagacaagccaggctgggacaggacagataaagaggggcagcagtttgggaggaacagaggaagatgacatggttctccacagagcgttggaatggccttgtggacacccacttcatcccccagaatggccccaaggaccctcccagggaacagaagggctgctctctcagcagcctggctgctttgccaggggagaggggggttctgagagcgagtagagccccagcatctgcagccccaagcccactcccctccacacgggcaaactttgtcttgaaggctgtgtcctggggagcgagcttgcagacagcaggggttgtgagcgtgtggggatctcaactctgctcaccccgatgcgtccccagctgccgctcatgtggagatgcaagggagtgtccgttttcccatccggggccattgagaatggctgtctgcatacatgatccagctggcctggactgaggccactgcctgttactgaacgtgcctaaactcaagctagaatccggcacacaggggtgggtcagacccgtctaaactccacacacgcacacatgtagatatgggagcattttacattcttggtgggttgtttgtgattctgtgtgcggacagtccttcctgctcacatactgagaagactgtgaatgcggggtgtgtgtatacccaaatagaccattgtttgcttgggggggtggggatagctttctccagggtgcccaacatcctacgcagattgaggcaatactggccaagggtcggagctgagaatggggctttgatgtggggctgttggatggggttctttggttttctgggaaagggactttcagtcttcaattagcccaaccaacgggaatgaactgcctgccagcctgcctgggactgattaaaccataccctggaaatgaggaggggaaagagcacagtagggcacgtgcttgagggcaagtcaggagatctgggttctccaccagcctctgtcgcctttttctgtaagaacgtgggccagtcatttctctgcaacaaaagggtgggtccagctaaggagaaccgcttgtctcagaattacctagggagacttgggaatagagattcctgggtctcacccaggctgctggggacagcaggatcatcgcacgggcctcttgactctacggcctgcgtgtaaagcctgcgctaagccccagtgtccttcagcggcgtcaattaggcgcacgcgcagtttcctctccggaggggcgggcagggcaggggagggaggagctactgatgtagctcgccccgccctggcgtcagggccgtgcaagcgttgtccgcatgggcgccgcgccgaccctcgcggccgtgggaacccgcccggaatctcgcagggcctgtcgcgcttcgtccaggttgacggcctcctccccgcgcttttcgggatgctggccccggcgccccgcctcaggcgaggccggcccctccctggcaagcggctcaaggcttggcgacggctcaggggaggctgggcggactagggggccgcgcccctccgaactctcgctgggcctcggtcatgccacctgctttgggttcatcgcagaggctggggtgaaactgccttaggttgcgagggagtggaagagctctgtcccatcgaatttagatcctggaagtccacagaggggaaactgaggcccggaggagagaagggactccccgcttcgtcaccttgctgggcaggataagagtcaaggtctctagtgcgggaacacttataaatgttactctgtgttcacatcacatggtgtgccttaattttggatgccaaggattttatttacattttccaaggacacaaatgcattccgttgctttcctccagaggctgcctagcctacgaggagtttgagcttggaacaggtttttgtgggagacagtaaggtgcgatgcacaccaaatagggacagttggaccgtgagttcaactccctgctctgtcgtttagccgagtaaacctctgcttctccatctgcaaagcagtgatcatgcatgtctctctcacaatgaggttttaaagacctaatgggaaaatgatcataaaaacattttgtagagtgtaaagtatgatatcaatattaattggaaagctgccttgcatcgtggaaaatgccagagggtatgaaacaggttaggtacatttgtagggccaaatacttggccaggtagtgagtaacatggctggttacagaaaagtctttgtcttcaaatcacccacaaggtaggtaggggaaggtaagacatcagtgaaatgactgcaacacaggctttgcataatcaaacgatgaatagtgtttaaactgctttatattggtggttttctttttctttctttcttttttttttttttttgagacagagtttcactcttgtcacccaggcaagagtacaatggcaggatctcagttcactgcaacctccgacccccgggttcaatggattctcctgcctcagcctcccgagtagctgggattacaggcgcctgccaccacgcccagctaatttttgtatttttagtagagatggggtttcatcatgttgaccaggctggtctcaaactcctgacctcaggtgatccacctgcctcggcctcccaaagtgttgggattacgggcgtgagccaccgcgctcggctattagcggttttcaagttgaagtcggacacctttagggattcttggggaaagagatttcttgggagacattatccatttcaatggtacctagcatgccacagtagattcctaaacaaaggttgagaagtataacctgagtttgtcagctctattctaatctctccaacctttttgaagtcttcattatagcttcggaaaactgttagtttccaacattcccataattctgtactagatgtggttccaagaaatcagacctttctgacttaaaagtttaaggaggggtatgcgcgtggtgtgcgtgtgggtgtgtgtctgtctgtagttatagctggttttcctgtccagttcaatctcattgagtttatctctcttgttagagatttttgggatcctgtgcccaataaataagaagagatgaaccttgagtctcattagatgacagatttttgagaagctcaaatgtatgggaaggctccacttcttcacttaaagggactgcagatggtgtgaagcaggtgggagagaccccagtgctaagagggttattacaacagggcttggcaagaatttttcagggaaaaatgaactttgggaggcgggtgctgttttttgccccattttgggttcccagggaaaggtaacaatttaaacacacaccacctgaacagagacatagcttcctctcaagagccttggaaggctgggagagtggtgttgggtggagagaatgagagcaggctcagatgttgaaacaaccctaggggattggagttggaattgctgaactgagctagtccagagccatctatcattctgagtcttcccaaaacactatttacacagatcaccaactttcacacttaaggagtgtctccccgtttctcttcttactaagcatggagctggtggagtctggttggagatagccttcaggtctgtgctctttttctcagtgaatttatgttgcactgatggagcccttgcatggcaggagagctagataaacttttaatttctgttaaaagtcaaataggaagctcttatctgaaaattctgcttaaatccttgtctgcatcactttatctctacttgccttcttcttttagtatttctctgaagtgcaatgcccattaatgtcacaaatgtacttcctagtccttgggcagcagagcctggccctttattttccttgcaaaggaggtgaaagtggtaacttgaacttagtccacctggactttgtctcatagaaagtgatcttcaggccggggccagtggctcacacctgtaatcccagcactttgggaggccaaggcgagtggatcacctgaggtcaggagttcgagaccagcctggccagcatggtgaaacccccatctctactaaaaatacaaaaaaattaactggccatggtggtgggcacctgtaatcccagctactcgggaggctgaggcaggagaatcgtttgaacccgggaagtggaggttgcagtgagacgagatcgtgccattgcactccagcctgggcaatagggcgagagtctgtctcaaaaaaaaaaaaaaaaaaaaaaaaaaagaaagtgatcttcagagggatgaatcccttcctatattcagcttctatccagaatagtactttttctcttgcataactgggtatagatttcagataagctccatttagttaaactccagttatttccaggaacatctggactccctgagacctcactagccttctttttgagcattaatagtttagattcaccataaagaagacagttacaaagaaccattttttgaatgttttcagcattccaagatattgccaagggccgtaaggttaaggaacagcggaaagaaatgctatttcttgtctggtattctccaatcagggaactcaaggaagctctctactcaggggatgaggctgtctcagccccgtgggtgggctaagtggactgtttccgagaaaagcactgggaacatggagtggcaggcagatattggcagaggcataaatataaccagggatgtagatgacaatttgatgacgtatcttgtgaatggtgtatattcacagaaggccttttaaagatggaggctgtgggagtaggaagacttatagggcttgtagtaatgaaagctttcagtgtatgtcaaagaacttgctgttagcgaggacgggaggagggccaaggaagaatggcggttagagagggaaagaattaatggttttgcggcaaacatggacttggccaggaaaacaattccttatttctagaaagaagaggagcttttaaattttttaaaatttttctcagtttatgacctggttaggaacactgaaacataaggagttggggaaaggatggttggaggctcactggaaatgagaggcggctatcagtgaatgagctctttatcagtgactcccagagactgctgctaattttgatttgaaagctgcaaattgctggtatgtggttacagttcctaagaacaacttagataagagattttcaaaagccgttttgaaaggggaagtgaaatttaagatttagttgtcattggtctacatctaagtgtttgtttctttagatgtgcacaccaaggagcatttaaaataaaaatctatttgcaaattaagatagtctttatttacatttttatatttttatttcaataaaaagtgtgttttatagagaaagctcccagagaagaaactaatctcaagactcccttttgtctttttttttttttttttctggtgccaggacaaaccgcacacataatacctgggaagaactaatcaaacgtgtgtgtgtgtgtgtgtgtgtgtgtgtgtgtgtatgtaccttgtgccttcggttctgattccataatagcaaatgacccaagcagcacatactcctctccaaccaggaagtgagaaatggaattttggttgactcctttctcttgttctaagaaatctcccaaggactgcaccatgtttgttttcatttccctggctcctttccattctggaaacttaaaatcggcttcatggcctcttgctttatagaatttgttcaaaaaggcttcgtcagaaatggatttgatgtgacatttttgctcttcacgtgaaagtacttcctattccctgaaagtggaagaggtggtggaaataaccctggccttggccgactgatcttgaacctgagaattagagactgggcctccgtccagtgactctgagccagtaatgaagtttaaagctatcggaagactggctgccgtccttggtagaggtgggggtgatttgatacacagaagagctttgtttcccagggctttgtggtctttccgggtcatttggggacttagggtggaggacgccagtcttgccttcctaatggagctgtgcttgtcctcgcccggcctgccccagagcgcatgctagcacagtcttgccttcctaatggagctgtgcttgtcctcgcccggcctgccccagagcgcatgctagcagatggcctttaccatcagccacttccagcgacattctaggatgaatgtgtgtataaagctcatgtttgtcactcgttagcgcttgacgctgggcaagttttctggcttctttaagcctcaacccacatctgtaaaatggtgatacttcgtagaattgtgagcattaaataagattacaaatgtagagcactcattttatttaatgtgaaatcacctatgggggaattcggggcttcccactgcctttgtttttcagcacctcccttcaccagcttttctgcacccccactcatttgtgagaaatagatagtgctggagacagctgagggatgtactcagctcagttcaggcttctcaatgccccagagtcctccagatccccctcattttttccctccatgctcttgtctctcacaaagatcatccttgtgacctcctatcccttgggctattctttgctgcattgggcattggacagtgctaagagggttgggcaccgtgcagcctagtgtttgcagctgccccggtgcgctctgctcagtccatattcttaccctgggtgtgccgagggacaggacaaagggcttattttatagaacatatttcttccccattcttctcgtttataattttggtttccaggaaagaatggaagaatgggcacctccaccctattagtgcacactctgtgtgtgtgtgtgtgtgtgtgtgtgtgtgtgtgtgtgtgtagcaggagcaaggggcagggtcagctgtgctgaggactaggaggtaaatggtctacgcatatccaaggtgggaagaccaagagaaataagagaagtaaatgaacagatcctctaaagtcatcttttccttattccagcacaccaaggcattgtgcatatggtcttggatccttattctctgttagccaatggaaaacatatatggaaagaaagcaagcaagcttgctgagattaacctagagagggcaggggccagcatcctgatgtctatgctaggccagcatggtaccagcagcagaatgtgggctgtggacatacacttaacatttctgatcagtttttactccctcaggcttaggggctacaaaggaagatagccaggtttctgggaaatttcgaagcacttggaaatatgatcgaagcagaaaattcctctgagtggaggagctgtgtaggctgtgtatagaatctgtggattgggaccatccaaggaatcagtgtctggaaagaagcacaaactggtgtgatgaaggttcccatgatgggtaagaactaccagggaaggttggagaagaaaggtttaaaactgacaaggaacctccaagccaccttagggacaatttgggttctttaaagttccatttgaatcccactccctcaacgagcactctaacttgcccctgtttatccaccccatctgccatgaccacatcaaacttacccacaagcgaggcccttcttagaacactatttgagttgtatattaaaatgttagggtgcctggtggtctagactctttccagcgggtcttgttctctgaacctctagaggagggaactttgccttcagaatattgctgagaggaagggtccagaatggcctggccagtatctagtgtgaccactctgcctctgagctatatttggctgagtcaggtggctggtgagtcccacacgtcctctggattgaatccacccacaggggagaggagtcagcctgtaggtttaattgccaccacaatcagagctatcaactgcctttattgtctaggaagattgaatcaaaggagggcagagaaccttgggttcccaacgcattctatgagctcttgggttcttcctgtggctttgtaggaacaaaagaacagaacaaacatgttggagtagtgtccctaacatttatttcaggtggtgactaggagggttgaggtgtagatatacttcctctcttctcgtggagccttactgaagacaggatcgccgttcttgtgtttatcagctgagaagggcagtctcgccatcttaaagacctgccctccagccccttcaaacgccacacttcccaggaagcactctctccataagtgttcagagaaccctgaccagagaagctcccgcacttcttatatgaactccgattgtgctgagggggaggggaggagtacacaaagcaggaggtgggtggggaggctggggtcacacagcccaggaggggcacacccggcgaggtgctccgtcagcacaggctccctcctccctccctccccccagtacaccaggctctgaccggaccggtcccaccgcagagttcagcggcatcaagtccaaggacagaactgcaagagtatggacacaaaacaccaaacaaattgggggtgggctcccggccagcctggtgagagagaggctcctttagccaaggccatttctggcttgtcagcctccagggtatgggctatgagcagcagtggggagccggggtttctggggcagctcagtgctgggaagacgtcatccccttctccccagggctgtatgggagcacaggcacaggggtaggtagagcttctggtcagcgaggggtagagcccacagagagaccagagagtggaccgcagtttcatgaaagcagagttatagctgccacttgtgcctgtgggcagagcaggtggtagaggggcctccaggaaagggccggggacacgggtgtccagcactaagcacagcgcactcagccgcagcctctgtctgtctccccacccgcccacctctggcacacagcacctggggacccagatttgtgcttgatcagagcttcgaaggaaggcagtggcagaggcgctgggaggctgtcctggaagtggccaattctggtgtcctctgcaaagtacccctcgtccctggacaaccagaacgtgccctgacctcttccctggcccgtccccacccgcggtgtgtgatccttagacgtgagtctgcatccgccgctgcaggggtcgactggggtcagagttctgggacg

SEQ ID NO: 1323 - DNA, 31206 bp, Homo sapiens
ttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaatgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgcttgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcgtggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccaagccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtttaaaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgttaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtactgttcaaaacaaaagtacaattcttgtaatagcatttttaaaaatttttttttgccaagaccatcaatttctcaaaaaaaatggcattttaataaaataagtctacataaagttcccttaagtcctgcctacacaggatatttagatatactatacagaaacaatgtctagtccctgcagaagagatgaaaatggttacttcatctcaatttacagtggcccaatgttattttatcccatgcgtataactgctcgtatcactgtgagactacaagcagcaaataaatgggaagaaaacctacttttacttaacaaaatcggtataactttacaattttagaaagtggctcttactttttgattaagatcagctcatcatcacaaattctctcctgtaccacttcttctgcctgtcccaacattgcagcttcaaaagtttcttcaccttccaaattggccagggttgacagaatagttgctaataagagagttacaaaggatctgtgaatattgctctttcatgattttaatatccttggactcagtagcatttgtggtaaaagtgctatattacaagtttagaatttagttaggcagcacacggtaactccttttatcctaagatggaactgtcattttagaaatgaacaaattcagttcacaaatttccaacaaaatttctccagttacatgaaaaatggctctataaatgtgttggtagcacaaagcattaagagaatataaatgtttttgagctgttttctgtcaatattccaatgtaaaaagacctttgataggatcagggataataaaagtattttatgtgacagccagcacaagacatacctccagaagctttggcaatgcgtttaaggtccctttttaaaactcttctaactgccatagcaccagcctccacaaaatacttcagacacatatcatcaattccaccagtggttagaataacattggcaccagttgccaggatcttctgaattctctccttggtgatatctgattctctgcaaagtatttttgtaacctgagttaccttctgtgatttttaaaaataatttaacttccattaagtatttatcacaagataatcatagatcaaattgtattatcctttgttatctctgaccagaatttaaattagtccaattcatggaaaatttgaaggaattaaaaattaccacttagctctccccaacccaaatttgaattactaattgagaactatggttaaacagggaacacaggtcctgccttcaaggatctagtggggagagggattaccaatcacactccagggcaagtgtcactaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatacaaaaaattagttgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggcagaaccagaaaagtgaaaaaccttgcaggttacaccaaacaatctagatactaagcttaatatctctaagcaagactagtatatcatctgtgttttcaaaaggattccctgattatcaatgtggaaactgcactgaatggctgaagacaagaagataataacatgagatataagctgaaagacaacctaaacagaaaagtcaaattttatggcttgggtgactcctggagtaaaataaataacaagagttttgggggcaggatgggaaatgagagtttagttgaggacaagattaagtttgaagtctctgctgttactcaggtgaagctcccaggaggcagtcacttacatcatggaaaccataaactatgggagatccagatttgaagagtcaatatgagtgaagccatgtgaatagatcattcgaagaatttttaaagtaaaatgaattacagatcaacctcaaaagcagcttgtctactaaacaagtactgtgtgctacacactgttatataaactcatggtaaaaactgtaataagccccaggaagaaaaaatacaggaagttacaacagaatataatttagattgaagaagaaagaaaagcttctctaagagactagcttgggtgtgtttctacaacagtctaggcaagaaaatgaaaagtaggtaaatttaatttggaggtagaaatcaagcggtcttggtgacagattaggagaaaaagtgttggtaaaaaggaggagttaaggacatttcctagttttctgcctgtgtgaaggactccccatcactaaaatggtcaaaagcagatttgcggtattatcacaagttcagttttagacatgttcactttgagatgcttgaaaagcattctactagatagaggtatgtgtgtttggagcttagagaaacagctgaaagagtctctggcatagagagataatacatgaagtcatgggaacaaaggggctatcctggagagtattatgacatggtccagacaaagcagcatcacaaagccttccatccccgaaagcatttcaagaaggacataatcaaagggttgctaaaggtcaagtaagaggaaggctgaaaatgtcttccgaatttcacgctagagaccttaacatgcagtccctcaaatggagaacagggctgaaaagggatgagaagaaaagcaccagagaagttttgtgtagtaaaccactcatgacatctgcctgtaaagatgtacgatagggagtacctatagcacaaggatgtatgaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaacacccgtgcagactgatttaaaagatgacagcacatttcttactcttggcaaagctttcttgtaggtctaactactgtttaaactattttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattagctcttctggcatgccaaccactaatatcacctgcacctccagtatctagcaaacagtaggttacagtcaatactatactgctgagttctgtactgctttgaggaaattagattcctgtcttttacatctttaatattaatagactcatacaatcaaaattccacaaaaaggccgattttcatataggttgtataaccccaaatccctctaaaaacaccaccaggctaatttttctggaagtaaaatagtttgacttggctaaaaatgttaaagtcctccaagacactcacacttaaaaggccaaaaataatctctcaacatacctctgtctaatttggtccagtttttcagggtctgtaatgaccacctgtacaccaagcttcatttttgttttttgcaggctgaagtcaaggcaagcaatttttgcatttacgattctcttgggcatgcctacaattgaacataagattaagttaatacgtctatccttaaaagcataataaagagtacctataatcgattgtatgtaaacacacaaatttagactaattcattgcattttatcttagaaaaattttatggcattaaatgcacgtaatttcttttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctcagcctcccaagtagctgggactacaggcaggtgccaccatgcccagctaatttttgtattttttagtagagatgaggtttcaccatattggacaggctgctctcaaactcctgccctcgtgatccacctgactcagcctcccaaagtgctgggattacaggcatgagccaccgcgcccagccaaaagaaaagctagttttaatctgtagcaatctcattctataaaccaaatcccaaaccttaccctgggatcccaccacacagttgagtgcatagccactgatgagcatactctccatttgacttctcccatgggctttcaaaatattaacagagttgactggatagcgtggctggcctcttatgtctgtgtatttaatagcaagtacagcatctactaccatgttagcaaagaaatcaccatttctacgccaaaagttaaggacagtaacaggtttggaatggacaaagggtacacacgtgaaaaatcaagggtaatttcaagggacttccttttagtaatctaatctattaaagcagcaagcattacttgtcaccaaaatgttacaacattatcactatctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacacacgcacccactcccgagacagggtcttgctatgttgcccacattggactggcactcctgggttcaattaatactcctacctcagcctccttagtagctgggactacaggcacataccaccatgcccatctcaaagtcttatgctttaaaaagtctaaattttatctgacaaccacaaggatacattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatatccgttcagccatttcatataggaggaggacatgaaaaaaccctccctcttcagatcatggcaagtttaatctatcccataagcatagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttacttgcaagcaagtcgatagccactaataactgatgtgggatgaattttctgtttgactaattcatctgcattttttaggagttctgctgcaataataacctgttgagaaaacattcactggtctgagtgtgccggatattcaacatgtgcaatacatatggaatgacactaaaatggccatatattattaaccaaaatggtagtgatgaaatgaattaactggttattagaaacctgggcgtgaagggagaagaacgctacaaaacactccaagtcctccacgttactcataaattcttggaaactgccactttaagcaaaacaatggacagcaatttctcaaatacagttgtttattgtaacgctgatggggggaggaaaacttgtttttttatacatcatctttcctcttaaagtcagtttccatgaagccactgtggatgttcagtgaggtcttattgtattataaatgcaaatggccaaaactgggtaggagccagaaaaatgttctaagaaactagttcagcaataagaaactagttcatcaatacaaccgtaaaagacaacacatctattacctttagaaaaaatgctcaacagaagctaaaccgagtgtgactattcatatgacctatattaagctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccagcatgctggatgatctatgaagagtttatactgtgtatcacatttactgactcggtaagatcacactgtcatatcatgatgtatttattaatttctcacactcccattttgaattcctgagattacctgtcaggatttaaaaaatagaacaggctgagtgcagctcatgcgtgtaatcccagcactacagaggccgagaagggaggatcacttgaggccaggagttcaagaccagcctgggcaacatagcgagaccctgtctcttaaaaaaaaaaaaaagaggtttttaattagttgcttgtggtggcacatgcctgcaatcccaagcactctgggaggctaaggcaggaggattgcttgaacccaggagttccaggctgcagtgagatatgacagcactgcagcacttcagactgtgctacagatggtctcttaaaaataataatataaaaacattgtttctcccccagattggtaacattttatcctccaaataatcagaaaagttgagagctttccaagtctcaaggggtgatgggggaggaaacaagacttttgagagaccataaaaaaatctgtgtgatgtctgaatactgccataaaaggaaaaataagccctcaaaacttgtgaataccaacatttaaaacaatggggctatgtcaaatgaactcaaattctttcctacttaaactgtacaaactagctgtaactatcaacttacaaattttgtttctgaatctgtacctaagaagcttatttcccctcttaaatgtgtaacttcttttgttttttcttcttgctcaatcttctgggcattcagaatatgtaacttatttctgacacagcacaaatgacccacttatggcttcaactttctgaaagtcggtcgtttttagaaaaatgatcattctttagccagtctacctaccactgaagtagttccatctccaacttctttgtcttgcagatcagccagctcacaaagaactttagctgcaggatgttctacctccagtaacttcaggatggttgcaccatcgttagtaatggttacatcctaagaaattcgcaggaaaaaatatgaaccacttatagaaatcaacacagccccattataatacacgttcacctttaatatcaccttccagtacgtggattctgataaagtcaaagaaagaacatagcaaaacactgaagatagttttactttaaggaaactaacacaacagttatgtgtacttacaccaatatcatccaccaacattttatccaagccaactggaccaagagaactttttacaatattggcaatcgaagctgcagccataactgtagacaatcaattaaaaataaaaaagaaatgaggataagccacaactctgaaagacagtaatttcagcctaaaggtaaatgacatccaacagcccccgtatttcccaaatctacaaatctgtgttaattatttaaaaaccacctactaagagtgtaaatggggccagacactgtggctcacaggtgtaatcccaacactgcgaggccgaggcaggaggatcgcttgatgccaggagtttgagacccctttgggcaacatagcgaaacccatttctacaaaaaataaaaacaaagccggatgcggcggcgcggacctgtgcttggagaatgcagtgagctatgatggcactctcgtctgggcgacaggtgggaccctgtccctaaacaaagcgagcctatttggcacagctttgatgcggggtggaatctgatggcggggaaaaaaaaaaaaagtaataaccaccaatttcatgctctgccacttcgtacagctataccagccttttccttcagattctgcaagttttttgctcattaaaactctctttatctgtgaggagagaaatcggtagtcaacggggaaggtggtgactttcagatttgtttacgaaaaaaattaggaatctatcaagaaacagtaagctctgtaggtatccaaaggcctgacagcaaacgctctgctaagttagcgctgccgtctcctggggtcaatgcactcgagtggcgtttcctgggctaactctactgtaagaagctgtcaacccggatacggctggacgccggacgcccgacctcgactgcagctgcgggcggacagggcaccgggctcatccgagggcgcgcggatggacctactctttttctggtaaatggtcctaaaataaaacctggcgtttaacatggacactcagggggtcgccctgaaacaaaagggggtgcgaggcgtggcccgcacgtgcgagcccgggaggcccgctttcccgcggagggcgcgtttccaacgccgccccggacaccacatccacgcgttgccggtctcaaaaccctgccgcgcgcggcggggctcctcctcgctgtgggaaaagtggggccacagcgccctgccccagagaacggcgggtgggctgggtccggctgcggggccccgaggccctttctgcggaggtaaaggagagaaacgagggcagccggggtccggtcgcggtgggactcggccctccccggccgcaaacccgacccaggcccggcccgcccttaccgttttgggagcggatcgtttccccagtgctgcggtcaccgaacacggacaaaggcccctccatcttgacggcagcgatacacgtcgaattctgcttacaccgcgggcaaccagtatcgcggcccctcggccgaccggcgaccacagcagtggctgcgacggcgtggagcgtacccgagcgatgtcccaggagctactgggtaacacaccaccccacccgcttcccggctgccccggcccggccgcggggcacggcgggaaggaaaaagaggcagggacaacagggagagaaacaggactgtgacggaagtgaggctccggggaaggggcggggtcggcatttttgtccaattagatagccgatgggaagggcgcgaaagcggagaacggaagtcggatgttggaccgctgggaagaggttgaaccttcgcctcaaacgatgttgcgcagacgcagtgggccattctagtgccttctagaaaaggttgtaagaagggtggagcttggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtgtaagtttaagggcgcgaacctgggtgggacggggcagtttttccagcgggccatacgggaaaatttttggttcgaggaagacaaccaccctttttaaggagaaaactgcatcttgccctgccttattcctacgcggtgcccaggtggggtgtgtgtggaccagtcgatgaccgcccaagctctccgagtagaaaacccaaacatggttttgtggggtgtgtgcctttgaccccggacttaagcaacaagcgtggtcttgggcgtagctacgaggtggttggtgggctccagggcctgcgtgcccctcgacgtgagcgatgattggcgatgaaggataacagatcgccttctcggccactcagtggcaggggacttgctacttccgggtcggtggcgtctggcgtggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctggtaattagtcttgccccccttctcccagctcactcgcctgggcttgcacagtacattggaacgtgcgggttctattttgtattcgacgtgccggatcgaaatagagctcgcggcactgcgaagaccacagtaggaagttaaggacggggtcagtgctgactccaccctgtgggcatacgtatttttcgtcccctcgggcctaaagattgggggtgtaaaagcggatagacgttagagcgggttcgtgcgctgtccatatccgtcatttttaagccctgtgcggtttttcccgttgcccagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggtaattaaatctgcttgtgattgacaagggcagtgcaccctacagactattttcattcattcaactccaggcactctcccaggtagctgccatgcggcgggtagaggcagggttcgcggaggggctggaacaaacaacaaataggtgtgatgggggctatttaaagaggatgttacagtagcggacaggatacctgcctgtctgaggtgacatttaagaaggtgagatctgaaagaggaagaagcctagtcatctgccagaaagagcagtcctagcaaaggaaactgctggggtgaggaactgaagggcttgtggatctgaagctcaatgggcagaggatgaatggcccaagatgaacatggaggggtaaggaggcgacagatgattagctttgtaagtcaagatgagcactttagactttcttttcattatagtgggaaactacgagaggatttaaagcttgagcccgaattggtttttcaagatcattctggctgggcgcattgtctcatgcctgtaatcccagcactttagggagccagccgaagaagccggatcatctgaggtcaggagtttgagaccaacctggccaacatggtgaaaccccgtctctactaaaaatataaaaattagaggggcgtggtggtgcacgcctgtaatcccagctactccagtggctgaggcacgagaatcacttgaacccaggaggcggaggttgcagtgagctgagcgcctgggcgacagagcaaaattctgtctcaaaaaaaaaaaaatcattttagctgctttttggaagattaaatttttgagggagcaggacttgaagaaagaccagttaggagtctagtatgacttgagatactttgttataaaggtggttgtttaatgaacacttacatttgccaggaattatgctacttgctttatatgttttttctcatttaatccttaaaattacatcatgaagcagttataatttcccccattttacaggatcaaagaaattgaggtttagggagacatgattagtaagtgccagagctaagatttacatatgttttaactgacctcagagccaggacgctaggttattaccactatactacagcatgtaagtgtttatcaggtttatctgctgcttatctgcttggtgaggattttttagaatttcttaaggacttcttaagtactatgtaaagttgtaagagtaaattggaaatcattactgtgtgatgtattatttatttattgaacaagcatcatacctgtatcacttgctaggcattgcgttagaggcaggagttacaaagataaagtagatgttatccctgtcatcaaaagtcttaagtttcatagtggaaagtggaatggggataatgatgtgttacagttgctgtaatacatttttactcatagaggagggagtccaagaaagggagtaggcagttcactttttaaataatctggatcttaaggctaaaaatcttttgaaacacccaacctattactttcttttttctttgtttttgagacagggtctgggtctgttgcccaggctagaatgcagtggtatgatatctgcttactgcatccttgacttccctgggctccagcaatcttcccacctcagcctcctgagtggctgggactagaggcgcatgccattactcccagctaatttgttttgttttgtttgagacaagctctggctctatcacccaggctggagtgcagtggtacagtatcagctggctgcaacctctgcctcccaggctcaaacgattctcccatctcagcttcctgagcatctgggactgcaggcacacactaccatggccggctaatttttttctttttctttttttttttttctggtattttttgtagagatggggttttgctgctgcccaggctggtctcgagctcttgagctcgagagatctgcctgattcagcctcccaaggtgctgggattacagacgtgagccactgcactcggccccaacgcattactttgatttaatatttggatcattaaaaataactaaagatgtatttcctcattttttctctgtctgccttactcgcaatattaaaagtagagaatttcagaatattatagtaggaaatgacctttgacataatgaatcgggcccttcattgaacaaatggttcaagtgtcagcaaactacggcccgtgggccaaaggtagattgtgagctaaaaacttgtttttactttttttaagttaaaaaaaaaatcaaaagaatattttgtggcttgggaaaattaaatgaaaatcaaatttcgttgcccaggttcttagaacctagctgtacctactctcatttgtttacgcatcacctggctgttctagcactacaatggctgagtcgaacagtttcaacagaagctattggacctagaaagcctaaaatatttactatctggcactttgtggaaaaagattgttgactcctggtttaacagattgtgatttttggccgggcgcggtggctcacgtttgtaatcccagcactttgggaggtcgaggcgggcggatcacgaggtcaggagatcaagaccatcctggctaacacggtgaaaccccgtctctactaaaaatacacaaaaaaattagccaggcgtggtggcaggcacctgtagtcccagctactagggaggctgagacaggagagtggcgtgaacctgggaggcggagcttgcagtgagccgagatcgcgccactgcactccagcctgggcaacagactgagactccgtctcaaaaaaaaaaaaagagattgtgattttttactagagccaccaggaaaaccaggagtagactccatatttccaaatctaatgcctcttctatttcacattgagaatcctagtgagaatctaatgatttgggtgtgttttctttaacttaaacttgactttttaaagggtaacatatacgtatgttataaaatccaaagggagtacagtttcttgtgtgtccttctaaagattgtctatgcatataagcaaaaactgttaaaaacaataaatcttagcatacgataaacacttccgcatctttcttcaccaccaccctcaaccaccccaagcacgcacttaaaaatacatcttggagattcttcatggtagttaagagcattgactctggagccagacactgggacttaaaccatggctccattacttactagttttaatctttttcaagttacttaacctttctgtgttagtttctgcagctaaaaaaaaatatagaaaaaataatagaattgagacataagctttatctataaaccgttaagacaggcctggcatatactaagtgctcagtaaatgttaactattatcttcatcattataaagcattatttcattcatttcagtaactgtatggaatactattgcatggattttacttaactcgctcctagagggtgattatcttttatgattacagtgttgcatcgaattgtcttgtccatgcattttgttagtgagattgagcatatttttgtgaatttgagtcattaatatttttcttttctgtgaacagtctgtttggataatgctttgcctattaagttatgaaggggtgggttgcccctcctcacctgtgggtgtttcttgttaggtggaacgagagacttggaaaagaaaaagacacaaagtatagagaaagaaataaggggacccagggaaccagcgttcagcatatggaggatcccgccagcctctgagttcccttagtatttattgatcattcgtgggtgtttctctgagagggggatgtgtcagggtcacaagacaatagtggggagaggattagcagacaaacatgtgaacaaaggtctttgcatcatagacaaagtaaagaatcaagtgctgtgcttttagatatgcatacacataaacatctcaatgctttacaaagcagtattgctgcccgcatgtcccacctccagccctaaggcggtttttccctaactcagtagatggaacgtacaatcgggttttataccgagacagtgcattgcccagggacaggcaggagacagatgctttcctcttgtctcaagtgcaagaggcatgccttcctcttatactaatcctcctcagcacagaccctttacgggtgtcaggctgggggacggtcaggtctttcccttcccacgaggccatatttcagtctatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcacaacccttaatccatttaaccctgagtttgacacagcacgtatttcagagagcagggggttgggggtaaggtcatagattaacagaatctcaaggcagaagaatttttcttagtacagaacaaaatggagtctcctatgtctacttctttctacacagacagtaacaatctgatctcttgcttttccccacaagttattgatcattttcttgttaattataggaggcttttaacatattgtgtaaattagctctttgaacaatatatgagtttaaaatattttttctttttatatttttgtgacagggtttcactctgtcacccaggctggagtgcagggcattatcacggctcactgcagccacaacctcctgggctcaaacaatcttcccacctcagcctcccaagtagctgggactacaggtgcacaccatcacgcctggctgattttttctattttttgtagagacagagtgtcactgtgttgcctgggctggtcttgaactccttggctctagcagtcctcctgcctcagccttccaaagtgctgggattacaagcttgagtcacatgcccagcctaaaatattttttgtttcattgcttttcttttgacttcattttactttttttttttttttttttttaaccatgcagcaaattttgtccatcatttcttttttatgccatatgaggggctgggcatggtggctcagcctgtaaccccagcacattaggaggctgaggtgggtagactgcttgagcttaggagtttgagacgagcctgggcaatatggcaaaccctgtctctacaaaaaaatacaaaaattagctgggtgcagtggcatgcgcctgtagtcccagccacttgggaggttgaggtggaaggatgacttgatcccaggaggcagaggctgctgtgagccaagttcgtgcctctgtactctagcctgagagacagaggcagaccctgtctcaaaaaaaaaaaaaaatggccatatgaagctggacacagtggctcatgcctgtaatcccagtgctttgggaggttgagaagggtgggtcgcttgaggccaggagtttgacaccagccttggcaacatagggagaccctgtctctacaaaataaaaattatcttggtgcagtggcatgcacctgtaatgccaactacttgggagactaaggcaggagggttgcttgagcctaggggtttgaggctacagtgagctgtggttgcactgctgtactccgagctgggtgacagtgagaccctgtttctgaaaaataataaaagccatatgacatggtttgatgtcatatttaaatatgcataccttgagattataaaaaaatttctcatgttttcttctagtactgttatgatttcagtttttgcatttaaatttttgttccgtcttatatttattttggtgctagctataaataaaagcaaagagtaagtatatccatgtcatgcatatgttcagtaacttagctctgtctcttcaaatctctttttgaagtagatctgtaaataaaactcagctcttcagaaacaaatttcttcatgatacttgaactatttagtttgttattattgaggatattctcataaaggcggaggaaaaatacttttcccaagcaaaatccaagttaaatatgttgaagtaaatgaaccaaacactggattgttgaaaaatatttagtcatttattcacctcaattaatgtaactttaggatacagattcttctgtgattttattatcttctcaccccatttaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcggtatttttgttttcatgtacttattgaaaaggtattgtgttaattcttggcattagataacttacataataataacagtttttacttaccaaatactttccatgtgtcagaccctttggtgagtactcaacagtgttacttcatttaatcctcacatcagtccatagggtagggactagtactctcattctatacagaaataaactgaggcttacttgcccagagtcagtgtatggtggatttcaaacccagggtgactgattctgtagtccatgatgtcagccactgtatttcctgttcatatattgacatcttgtccatataatattttgaaatgctgctgaaccttgacatctctacatttcctttttacttacatcattattaagatcactttctgaaaaaccgttgtaggctgggaagttagcaagaacaaatcaatttatttctgtcttttggaaggtgaaagtattttcagcctactcgtgctgctgacttaatcttttccttttttttctgattttcaaaaccagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtgggttgttttttaaaataggaaatgtcagtatcaatctaatactatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgataaatgtgagaaaaaacctgtaggcagttaaggtggcttctagagcattgttttccagtttttttaatgtataccccaattaaatgtttgtttagaagtgaaatatgttacttctgccaatttgagtattcaatgtgttattttaaatggaacacatctgtatgaagtatgatttgttctgagaggtcttcagaatcaaatggcttaatagtccccttttgcttaattaatgtcccggagaggcatttaaaagtataattgaagatcggatgcagtgcctcacacctctaatcccaccactttaggaggctgaagcaggtggatcacttgtggccaggaattcgagaccagcctggccaatacggtttaaccctatctctactaaaaacaaaaatgagttgggcgtggtggtgcatgcctgtaatcccagctgttcagaggctgaggcgggagaatcgcttgaactcaggaggtggagattgcagagagccgagatggcaccactgcactccagcctgggtgacagagtgagactgtctcaaaaggaaaaaataaagtataacggtaatgttttctccgctaaccttaaagattgatttgagcacctcactttgaggaccatagttccaaaacgctgttcaagtagaagcctagaattcaagggaggacactgtaaggaagaccatggactagttgcactggaaacagtaacaaaagtaaaaattaagctcacatgtatgtgatgatgtaggtagggatttccgcaaggagtgagtgcacgagataatccctgg

SEQ ID NO: 1324 - DNA, 43166 bp, Homo sapiens
tcctggcaatggcagaggctactaccccaagccccccaagtctccctaggaagcccaacctcttccgcttcaccttggacctcctcatgctgcaggaagtaacccctggcaaagttcatgcccggcatggaggggcctgcactggctgcccccacagttacagttgttcatttctccagtagcaccccagggctgagacacgtgggccacctgctttggaaaaggacccaggagagtgatgtgtcagtcaaagattggttttgtcatttaaggtagctttgccttgtggtcccaaacactgggcccagcagcagaggaccctccttggtttcacatccagccccgatgacatgtgaaatgtgtgaccacacataagcggaccctacgtccgtcctgaggtgggctcatcaggaaagtgggaattgtgattgcccctgccgtggggcccagccatggtcaccagagcctcctcccattctgggatccctggctcttgaatggaatctggctgctccacttccagccaggcaggcctgctcagagccccagttcctgcacgcaaagtggtgagcagagggcctggaccatggggaccctcattcagcaggcatcactgctgttcccaagccagggcccaggaggaaattgggggtggcagggaccacagtgtgttgcctcgggagggcagcagtggccccgacgtgtcccccatccgtgcattcagttggcatgtgctgagcatctgtgatgtccacaggctctggggataaggcggggaccaaaaccaacgaaaggcttccctgcctgaaaaggggtcccactctagtgaggaagatctagaattttctagcacttcatggtgatggggccatgaggaaaagtgaagcagtgggaggggagtgacagggtggctagggaaggcctctctgaggggctgacagcaaaggcctgcaggaagtgggaggagcattcctggcagaggccatagtaggtgccagagcccccagcagcaccaaggggcagaaggggctggagcagtcgcaaggggtcgcaagggggtaggagatctctgagtggccaaatcaagctaggcttggcaacccaagtgcgtgctgctgggtttacttgctgccttagggcatgggcagctgtcctgcctgtggtcagctctggctaatcccggcctctatccactggagggcagtagcaagcccccagtgatgacgtcaaaatgtcaaaatgccgtgggggcaaaattacccccaagtggttctttgttgagagccactgcctgcttgagaatgtaagcccatgtgtcgccacattttacagctttttaagaaaaactagagctttggggttttttttagacagggtctcctttgtcacccaggctggaatgtggtggtttgatcatagctcaccgcagccttgacctcctggcctgaagtgagcctcccgcctcagccaactgagtaagctgggactacaggtgctcaccaccacgcctggctactttttcaatttttttgtagagacagggtctccctttgttgcccagggctccaactgctgggctcaagccatcttcctgccttggcctcccatagtgctgggattgcaggcatgagccaccatgcccagcccagagtttttgtgcaaactctgatttggaaaatgttcccttgagttttaaaccctgagagttttaaacactatctcccttgggagggtcagctctgacggctgccagcacatggcctttgacatcagggtgccccaggcctttgacctgggcatccgagggtcccagggagacccagtccttgacagcctcctcctcctgcagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctatacgtaaatttgttgtgtaggtttttaaaaagcgatgagagacacagaaattgagtcagaattagggttagtcagatggtcaagacgtgagcatctagctgacagacagaggtggagccagtcccagggacagggattagatggggagacaggaagagaggtggagacagagtggggtagggatgacgggagacacaccccctggtcactgcctctgagacctgggggtggtgggccccagggcgggtgcctcccatccccctcccagttctcccggggtcggggtaggtggaaaggctgagtcagggagggcgggccccgctgggagacaacccctaggtgggcatccggcccccacccccgtgtctcctgtccgtcctggccctggcctggctcgctggcctggccgccaccccgccccccacgtctgacacctccatgcgtcctgccaaagcaagctgcctccctgcactcttccccctccagctccagtcactctgtccctctgtcccccgtcccttctccctgcttctgtgcgtttctttccagccctctgccttcctccctcaccgccactgctctgtcttctcgttctgtctccacacctctggctgtcggtgtctccccgtgactttccgtctcccctctctctcctcccttgtttttcccatgcctctccctccctccctccctccctctcctccccaccttttccactccgtgtccccagccattctccatctctgttctcagctcctgtcacctcgtttccccatccctttctctgctggagtctccctctggggggctctgtcctctcctcactttgccctttccctctcgctgctgtgtgtcttggcccgccccccgtgccccccatctcctctgtctcccacactctgggaagcccggctgggatatccaggttggagcctcactggcggccactggaaacccagaatgaggggtcatcgcctctcgcccacccagaaagggcgcaggagggggcagcaaggttgcggggcctgtctggccagaaggaaatgtctgtgctgtggcctggtcacccccgcccccaggacctgctgggctgctgccgcccccggccggggctgaggccgagtaaacacagcaaacacagccgccggcagcctgggatatttataccgaggctgggcgtgggtccagtgcccaccacagcccctgccctgccctgccttgcctgctgccacagccagctccgagccagcgtggcaccagccggcaaggggacgcgccgcagacacagcctgcgctgggtatggaggccaacaggcactggccgctcatgatgcaggcggctccatggacgcaccctgtccccctcccctgaaaacaccagcacacaatgtggacccacactcgcagctgctcacaaacacacatccacccctgctgagaacgcgaaatcccctcaacgatgatgcaaaacagacccacacaactccacacactgcagtcaccagcctacatgtgggaacacagcatgcagacaccaccttagcacctgctcacagcacccacaggctgggaacaccagtccctgagatggacacacagccccgaagtacagccctccctcacacagacaaacactgagaaccacaggaagcatgctggatgcacaccacgtagacaaacatgctcagaataccagcgacacatgcactgatcacagtgcaacccagaaacaactcaactcatctgcctcatatgtaagaaacacacacggccgggcgcggtggctcatgcctgtgtctcagcactttgggagaccaaggtgggtggattacaaggtcaggagttcgagaccagcctggccaacatggtgaaatcccatctctactaaaaatacaaaaattagacgggtgtggtggtgggtgcctgtaatcccatctactcgggaggctgaggcaggagaatcgcttgagcctgggaggcggagcttgcagtgagacaagatcgcgccattgcactccagcccaggcgacagagcaagaccccgtcttacacatatacacacacactcactcccctctcctggagaaacaccattcccacagatgattaacatatgcagaaaacaccacatttcaagtcaaacttacacttaaaaatgcacaaatttacactcagaagaacagtgaagatgttgagaaaaatatcagacacacaatatgccccagatacatggccgacttgcagaatcaaacagtgccagagcataaaacccacagaaaatacaacagcttgcccagcagaaatacaaaatgcagacgcacaccccagaaatgcagcgcagccacaaacacacggagctaacacgtgctggggacacacatagacaagaccatccataccaaacagcacacaggcccccagaacacccatgccagacgcagctcacgccacaaagcttggaatcacgcacacaataagttcctgaacacacaaatccgaatccacactggaacctcaaatactctgcatgtccagagactaagggggaaggggctttctctcacccaccaatctccccactcccccttgctgacccgggtcccaggcccgtcttgggggcgggggagggggcaggaaggcctgagctggcctcccccagcagcttcctgccccacgggggctggacaggaagctggggctccagccggaacccaggctccccccacgacttccctctgtggccccgggccgcctgcagaggcaggggcggggcagggggaggaagcggggagccccaaaccccctgccctgcccctgcggtcggccacaggcgggggcagacttgtcccgacggggctgagccacccatcgggcctgggtgccagggtggcagggcaggggcagtgcgcacgcggccagaggaaggtgctgagcccacagtttcccctccccgccctgtggggctgtgccagctcagccggcagccctgggcaggtgggcggggtgtgtcatgagggcgtgttgggcaggccgaccacaccgcgaatgtgcagccagcacttgtcctcaggccgaggcacgagctggggctgggcatgtgagggccgcgtctgccaccctgggggtgtgtctgctccgtctgggaccctgggtgtgacagtgtgtctgggcgtgacgtgacggggtcgctgcaatctgtggggccctgtgggactccccaggctggaattgtgcgtgtgtggcggagggtgtgggatgtcagactgagtgggtaagaccgacctgctgtctgtgaggttgtgacgtgtcagacctctgtgtggggtgtgtctggtgggactgtgacaggtccgactgtggacatgcaccctggacctgtttgtgactgtgaacccatggaggaggaggtggctgttgagggatccatttcctgtccgggctctgatgccgtgatgcgtgtgcgtgcatgacactgtttgaatcagtgtctggtgtgcggtggttgcgaccatgaccctgtggaatatatttgtatatgactgtgttgtgccaggtccctattgaagtctctgctcgtgttgtgtcccagtgaggctccgaggctgggtggtgtttacgtgatgggctgacactttctctatttgtatctgtgtatatgtgggctgcagctgctgccaaatgacacagcccatgtgttacgggccctgcaggaatctctgtgtgtccacggcggctctgagaggtgaatatttgtgtagtgtggggcaccgtccgtgtttcccgccgtgtgagtgtgtctgcatgtgtacacgcaccacatcctcatagggctgcagcgattacagccgagtcactgtgtcctagcttgtgactctgcctcttggggccagacctcagcatctctatacctatccatttgttggcatgtccttgcatagtgaactcctgcctccccactcctccctcagccctgtgtgctttgggacctgaggccagaggagtaaccacatttctacccctatgctgagctgggagggccccaggtccctggcacccagacccagtgctgccaacagctctcatgcccacaggcaaaggaaccgcagcactcatactgtccttcctcccaggacaatcactgggtgtggggaagtgaaacctaggagaaagagcagaaactgagaggcaggagaaagaggaagcaggagagaattcacaagcaggaccatagcagatgggaagaaatggagacagcagagggagacccacctgtggctgctgccatttcttgcctggacagctggtctgtctgtgctcaccctcaccctgacacttctgtccactcccaaccatgagcaagacggcggaccctctgagcgcctaggtcaaaccctgccatggctcctgtcttccttgagtgcaagttctttttttttttttttttgagatggagtctcactctgttgcccaggctggagtgcagtggtgcgactttagctcactgcaacctctgcctcccctgttcatgcgattctcctgcctcaggcccctgagtagctgggatacaggtgtgcaccacaatgccagactaatttttttttgtattttttatttttatttatttatttgagatggagtctcactctgtctcccaggctggagtgaagtggcgtgatctcggctcactgcaacctccacctcccaggttcaagcgattctcctgcctcagcctcctgagtagctgagattacaggcgtgcgccaccatggctaatttttgtatttttagtagagactgggtttcaccatgttggtcaggctggtctcaaactcctgacctcgtgatctgcccgccttggcctcccaaagtgctgggattacaggcgtgagccactgcgcccagcctttttttgtattttagtagagacagggtttcaccatgtggtccaggctggtctcaaactcctgacctcaagtgatccccctgcctcagcctcccaaagtgctgggattgcaggtgtgagccaccgtgcccagtctttttttttttttttttttaaagatgcagtcttggctgggtgcgctggctcatgcttgtaatctcagcattttgggaggccgaggcgggcggatcacctcaggtcagaagttcgagaccagcctgaacaacatggtgaaacttcgtctctactaaaaaaaaatacaaaattagccgagcatggtggcgcatgcctgtaatcccagctacccagctacttgggaggctgaggcaggagaatcgcttaaacccgggaggcagaggttgtggtgagccaagatctcgacattgcactccagcctgggcaacaagagtgaaaatccgtctcaaaaaaaaaacataaaaaaaagatggagtcttgctttgtcacccaggctggcatacagtggcacagtcagggctcactgcagccttgacctcccaggatcaagtgatcctcccaccttagcctccagagtagctgggaccacaggtgtacattttttaaaagtgttttgtagagatagggtctcactatgttacccaggctggtctcaaatgcctggattcaagtaatcctcccatctctgcctcccaaaagtgctaggattacaggcgtgagccaccccgcctggcctgaactactatcttttattgtcttcttcactatcccccactaaagcaggttcctggtgggcaggaactcctcccttaacctctctgggcttgtttcctcacctttaaaatgggtgttatcagagtccctgcatctcagagtgttgctatggtgactgaatgagttcattaatgtaaggcacttcaacagtgcccaaggtgctcaataaatagatctaactacagtagtgttccccactggtcccctgtgccttgatgccgggcaaaggaatagtgcagacaggcaggaggaggcagagagggagagagagggagtgggagtgggggaacgtcagggatggagaccccaggcaggcgcccaatgacacagagatccgcagtcctctctccatctttaatggggccccaggtgggcttggggcacgggtgtccttaaatacagcccccatgggcaaggcagcgggggcggggcggggtggggccgggcctgccggggcggggcggggcggggcgggacctcagctgcacttgcaggagcgcacgatcatgttggacagctgctccaccttgggcttgcggcccacgtagtacacgatgggcagcggctccagcgcctgcggcacgcagcacggcgccgccgaggcgcccgggttatgctggttgtacagggccaggacctgcgggcggcgggcggggtcagggctcagggctcgtggagggaggaaaacggccctccactgccccatcccccacccgctaccgcgccagcctctctcacttcgtctctccccgcatcccctcttcccatctccaattcggtctctcttatcttctaacatcctatcttattctgtctctccccacctgtctgattttctttttgttttgagactgggtctcgctctgccacccaggctggagtatagtggcacgatcatggctcgctgcagcctcaacctcctgagcgcaagccatcctcccgcctcagcctccggagtagctccaaccacaggcaagcgccaccactcctagctttttttttttttttttttttttttttggtagagatgggatctcagtctgctgcctgggctactctcgaactcctgggctcaagcgatcctcctgcttcagcgtcccaaagtgttggtattaccatcgtgagccgccgcgcccgcctgattttctttctcagtctctgtccctcctcatcttcgcctcttgccttgttgtgtatctgtctttgtctctccttggcctaactctgtgtctgtatctgtctctctcattttgtctctccatttctgcgtttttccttccatctccctgtctctcttctccccttcacccccatccctctgttacttcactctgtgggtcttcatagctcatctccctctggcccctgctcagagcccctctctagcttcctgcctctctccccatctctttattcattcccctccccaccccatccctctctttctccccatcctgccaactcacctctctgactttacttctctttctctctcctcttcctccgtcctggctccccccaagcgcatctcgtagcccggtgggccagacgtaccttgctgtactgcgtgtccaggctccaaatgtaggggcagggcccgaggcagaagttggcatggtagcccttgggctcgtggatccacttccagccgaggtccttgcggaagtcaatgtacagctgccgcacgcagcagttcttctccgtggagctgcaggcaggagagacgcgtcaggggcagggaggggctaccaccatagaagccacatgcccctcctccccaggtgcgtgtgtcaccctaggttgcccccccagccctatctccatctgggtctcccttgcacccactgtgttaataacaacacaaatagtcatgataatcactaacacagattaagcacttcctccagtgctaagagcaatgtaataattaatttcacgcaatgcttaagacaagcctgtaagaagccagatgaccatccacgggggggctaaataaatcatggcatgccacaccctggaacatacaaaataacacagctccatgtaaactgatctgctctatttgtgcaacaaatgtttattgaactactactgtgtgctgggctgggatctactgtggactgaggacaaatgaaacagatagaaataggctaggcatggtggctcacacctttaatcccagcactttgggaggatgaagtgggaggatcgctggagtcgaggagttcgaggttgcagtgaactatgataacaccactgcatgccagcctggacaacaaagtgcaagaccctgtctctacaaaattttttttcaatttttttaaaaaagagacagaaatctctgccctccatgggcatgctataaattgtcttgtcactcctctgctctgaacctggctccatctcacggcaaatgcccaagtcctcaccgtgagccacaaggtgctatcaaatctggctgatctcaactccctctctcacgcctactccactccagccacactggcgtcctgtctgttcctcagacagtcttatttcggggctcctgcatctgctgttccctctgcctgccttgctagtcccacagatacccactccagcttgttccttcacttcatttcttctttttttttctatttttttttttttttttttttgagacagagtctcactctgtctgccaggctggagtgcagtggcatgatctcggctcactgcaacctccgcctcccaggttcaagcgattctcctgcctcagccttccgagtagctgggattacaggcgtgtgccaccatgcccggctaatttttttgtctttttagtagagacagggtttcaccatgttggccaggctggtctcgaactcctgaccttgtgatccgcccacctcagcctcccaaagtgctggtattacagacctgagccactgcatctggcctatttattctttttaatttgttattctttttagagacacggtctcactatgttgctgaggctggtgtcgaacttgggctcaaacgatccgcacgcctcggcctcccaaagcattgggattactggcatgagccaccacacctggccccttcacttcatttaaaccttagctcaaatgtccttcactcagggacccttaactcctaaagcagtgtctggaatgcagtaggtactagtaaatatcagttacatgactgaacatcacctcctcagagatacctttctgagccatcctttccaaaatatccaagtgactgttagttccatttagtgcaatacggtattgcagttatgcaagaaaatataaaaatgtctgcatttgaaatggggcaaaatcttaattaccgatgacgctggatgagagtttacgggcattcattatcttcattgcttttgtatacatttgaaattttccataataaaggaatttaaatcagaataggaaaaataacagttcccaatatctattactctctgcctgccttcttctggtttattttacttcttagaactgtcaaagaggccgggtgcagtggctcacgcctgtaatcccagcactttgggaggccaaggcgggtggatcacctgagatcaggagattgagaccagcctgaccaacatggcgaaaccccgtctctactaaaaatacaaaaattagctgggtgtggcggtgcttgtctgtaatcccagctactcaggaggctgaggcacaagaatctgcttgaacccaagaagcagaggttgcagtgagccaagatcgtgccactgcactccacccagggcaacagggtgagactctgtcttgaaaagaaaagaaaaaagaaagaaaagaaaagaaaaagttgacaatgccttttttttttttttttttttttgagacagagtcttgctccgtcacccaggctggagtgcagtggtgcaatcttggctcactgcaacctctgctcatagattggtggggccagccaggcacggtggctcacgcctgtcatcccggcactttgggaggctagggcaggcagacttgaggaccctgtctttactaaaaattcaaaaattagctggacctggtggcgggcacctgtaatcccagctactggggagtctgaggcaggagaatcgcttgaacccaacttcaagtggcaccggataacctagaggcaagataaagcctttccaagagccacagaagcctgagaaggaagtcaagaaactgagatccctgtgaactcagcccgtaccacccaatttggttggacctcagtttcctcatctgttcagaggtaggagctactagataaaataaggtgttaagctgagggccaaggggccatcatgggcaggcttagggagggccatgagtgcctgagatcatatgcacatgtgtgtatgtatgcatgtatttctgggaaaaagagtcctggctttcactttctcacaggaagttctgaactcacaaaaggggaagaactagtgtccggaatctttttttttttttgagatggagtttccctcctgttgcccaggctggagtgcgatggtgtgatctcagctcactgcaacctccgtctcccgggttcaagcaattctcctgcctcagcctctcaagtacctgggattacaggcatgtgccaccatgcctggctaattttttgtatttttagtagaggctgggtttcaccatgttggtcaggctggtctcaaactcctgacctcaggtgacccacccacctcggcctcccaaagtgctgggattacaggcatgagccaccgcacccggctcagaatcatctttaatatgcagttcaaccctagctggggttctgagatcctaggatttgaacaatctgtgatactgttatccaagtcagcagctctccacgtgagctcccaggaccagcggcagcatcacctgggaactatgggaaatgcagattctcaggtggcaccccaggccactgaaatcagaaattgtgtgcaggactgggaacaacagtccgtgttgaacaagccgtctaggtgatcctctgactcattttttcagcacacattcggggcctaccctgcaccgggccttgggatacccacagcccttgcccttgccaagcctcttccgtccagtctctcaagacctaggccaggtgcagtgactcacgcctgtaatctcagcactttgggaagccaagaccggtgaatcgcttgagcccaaggagtttaagaccagcctggggagcatagtgagaccctgtcgctacaaaactttttataaataaaagacccaacagagactgtttgttgagtcaaagatctacttagggccccaggggagcccagaggcctcacatccatcttggatgttggagaaaggggttaggaaggaggtagtgttcgagctgccttaagaacaaattttcctatgaaagttttttttttttttttttgagatggagtcttgctctgttgccccaggctggagtgcagtggtgcaatcttggctcactgcaacctccatgtcccaagttcaagcaattctcctggctcagcctcccaagtagctgggattacaggcacacaccaccatacccagctaatttttctgtatttttagtagagacagggtttcaccatgttggacaggctggtctcgaactcctgacctcatgtgatccacccgcctcagccttccaaagtgctgggattacaggtgtgagccaccgcgtccagctggaaagtttcagatgtacacaaaagcagcttcaacaatgaccaactcatggccaatttccattgcatctctacccctatccactatctcttttttttttttttttgagacaggatctcactctgtcacccaggctggagtgcagtggtgcaatcacagctcactgtggcctccagctcctggggctcaagccaacctcccacctcagcctcctgagtagctgggacaaaaggtacacaccaccaggcccagctacttttcatatttttttttttgggagatggggtttcaccatattgcccaggctggtctccaactcttaggctcaagcaatcctcctgccttggcctcccaaagtggtgggattatagctgtgagccactgcagccagccgacaatggtttatctcaaagcacatgcaatccaccgtgttgcttcatccataaatatttcaaatgtatctctaattaagactactttaaaacacagtcacaataccatgtaagaaaattaacaattccttgatatctagaggaatatctagacagagttcacatttacccaactgtctcataaatatcttttttttttaagcctgtgtaaataaggattcaagtaaggtctacacattgcaattggttgatatgtctcttaggatttttttttttttttaatttttgagatggagtctcactctgtcacccaggatgcagtgaagtggtgcaatctcgggtcactgcaacctgtgcctcccaggttcaagtgattctcctgcctcagtctcccaagtagctaagactacaggcgcctgccaccataccctgctaatttttgtatttttaattatttatttatttttttgagacgggagtctcactcttgttgcccaggctggagtgcaatggcgcgacctcggctcactgcaacctccacttcctgggttcaagcagttctcctgcctcagcctcaagagtagctgggattacagggcccgccaccacgcctggctcatttttgaatttttagtagagaggaggtttcaccacgttggccagactggtctcgaactcctgacctcaggtggtccacccaccttggcctcccaaagtgctgggattacaggtgtgagccacgacagctggcctgatttttgtatttttagtacagacagggtttcaccatgttggccaggctggtctccaactcctgacctcaagtgatccacctgcctcagcctcccaaagtgctgggattacgggtgtgagctaccatacctggcctctcttaggacttttttcaaaatctacaaaatcatctctctctctctctgtatatatattcagggtcaactatatatagactgacccttggacatgggtttgaactacatgggtcctcttacaaaattcaccacttacaggtgaatttttcttccacctctgccctgagacagcaagaccaacaccttttcttcctcctcctcagcctactcaacatgaagacctttatgataagccacttccactcaatgaatggaaaatatacttcctcttccttatgattttcttaaggacattttcttttctctatcttatttttaaaatgcaggcataggccgggagcagtggttcaagcctgtaaggccagcactttgggaggccgaggctgatggatcacctgaggtcaggagttcaagaccagcctggccaacatggtgaaaccccgtctctactaaaaatacaaaaattacccgggtgcgatggcggatgcctgaaatcacagctatttgggagactgaggcaggagaattgcttgaacctgggaggcggaggttgcagtgagctgagatcacttcactgcactccagcctgggtgacacagctagactctgtctcaaaaaaaaaaacaaagaatacggccgggtgcgtggctcacccctgcaatcccagcactttgggaggctgaggcgggtagatcacttgaggtcaggagttcaagaccagcctggccaacatggtgaaaccccacctctactaaaaatacaaaagttagccgggcatggtggcaggtgcctataatcccaactactcaggaggctgaagcaggagaattgcttgaacccccgggaggtggaggttgccgtgagctgagattgtgccattacactccagcctgagtgacaacagcgaaactccgtctcaaaaaaaaaaaaaggggatataggacataatacataaaacatgcaaaatatgtattattcggccgggagcagtggctcatgcctgtaatcctagcactttgggaggctgaggtgggcggattgcctgacctcaggagttcaagaccagcctgggcaatacggtgaaaccccatctctactaaaatacaaaaaattagctgggcgtggcggtgggcacctgtggtcccagctactcgggaggctgaagcaagagaatcacttgaacccgggaggcagaagctgcagtgagccgagaccgcaccactgcactccagcctgaatgacagagactctgtctccaaaaaaaaaaaaaagtattaatcaactgtttatgttgtggataaagcagaattccagtccacagtaggctattaatagttaagtttttggggagtcaaaacttgtatgtgaatttttggttgcatggggggtacgtgtgtgtgtgtgtgtgctttccccttctttgcattgtatttgatgaagaaactgggtgaggtttcttgcagtctgagttttgctgaccatttcctctgttcctgtctttctagaaaactgttaggatctacagtcctgatcagattcaggtttgatttttttttttttttcctgagacaaggtcctgctctgtcctgaaatgcagtggcgtgatcctggctgactgcagccacaacctcctaggctcaagcactcctgcctcagcctcccaagtagctgggactacaggcacacaccacccagccagctagtttttttgtatttcttgtacagaggcagggttttaacatgttgcacaagctggtcttgaactcctaagctcaagcgatctgcctgccttggcctcccaaagtgctgggattacaggcatgagccaccgcacctggccttcaggtttgattttttgccaagacttcctaggcaacattgggtccctccctacggaggctgacatggctggctatctccctttgtaatgtcaggagctgttggcactcaagacctcaatttgtggccgggcgcagtggttcatgcctgtaatcccagcactttgggaggccgaggcgggtggatcacgaggtcaggagttcgagaccagcctgaccaacatggtgaaacccagtgtctactaaaaaaaccaaaaattagccgggtgtggtggcacacgcctgtaatcccagctactcaggaggctgaggcaggagaatcacttgaacctgggaggcggaggttgcagtgagccgagatcacgccactgcactccagcctgggcaacagagcgagactctgtctcaaaaaagacctcaatttgttcattgacagcgttgctgggctgatggcgctaagatctggtggtgaaggagcctgggagcagggctgattttctggcagggaaacagccggtaacaaagcccagagacaggaccaaaatattttaagcaagggaggaataaggtcagatgatcactctaaatttacaacattctaactctccatttcaactttctaggaatccaacatttcagctttcttagattgcagtattagcattccagcatcttatgattctaacattctgacagcatcttcaactctctaggattccccctttccaacctttgaggatcttggcattcctgaattccagtatgccagtattgcatcccaacattccaaagttctgagccatcactcaagaggttcaaactgacactttctttcttttttttttttttttttttttttagatggagtctcgcatcattgcccaggccggagtgcagtggcgcgatctcggttcactgcaacctccacccccgaggttccagtgattctcctgccccagcctgggtacctggatagccgtaatcccagccgagtagctgggattacaggtgccagccaccacacctggctaatttttgtatttttaatagagatggggtttcaccatgttggccaggctggtcttgaactccagacctcagggatccgcccacctcagcctcccaaagtgctggaattataggcgtgagccaccgcgcccagcctgctgccactttctattaataaaatcccagcattctaatattctaacattccaacactgagttccaacatgctgagataccaatattctgctttctccaactccaacatttgtggatgtgaatatttcaaaacagaattctaccactgtgagcccaatattcaaggactccaatctgccaacactggtatccacaattggccagtggtgcaggaattccacatgggccatcttcccattttgaatccccaaattctaggattccaatgtttcagctttccttgagtccgacattttccatttcagtaattaacaccaaattctagcattctagaatcccagcattctagaacctcaacctgccaacaatttagggattcaagatggtgaccttccaactttgaattccaacaatcacagggttcaactttctaacattctgtgattccaacactccagcaagaaagcaaggctgggcgtggtggctcacacctgtaatcccagcacttcgggaggctgaggcaggcggatcacgaggtcaggagatcaagaccatcctggctaacatggtgaaacccagtctctactaaagatacaaaaaattaggccgggcgcgttggctcacgcctgtaatcccagcactttgggaggctgaggtgggtgtatcacgaggtcaggagatggagaccatcctggctaacacagtgaaaccccatctctactaaaaatacaaaaaaattagctgggcgtggtggcacgtgcctgtagtcctagctactcgggaggctgagacaggagaatcgtgtgaacccgggaggtggagcttgcagtgaatcaagatagcgccactgcactccagcccaggtgacagagcgagactctgtctcaaaaaaaaaaaaaaaaaaaaaaaaaggaacctgatcccaacattacaagactcccagttctttttttgttttttgtggctgggattataggcgcccaccacgcctggctaatttttggatttttagtagagacgggtttcaccatgttggccagacaggtctcaaactcctcacttcaggtgatccacctgcctcagcctcccaaagtgttgggattacaggcgtgagccaccgcacctggcacaagactcctggttcttacacccagacctcatcccctgagccctccaagctaaaggagacagatgctcagcccaagcacagcagcagccaggtgtccaacctggagcacctggtcagcagatggcagtcatgcccccagcctggaaggcctccatccaggctacaaggctcacctgaagcaatagttggtgtccagggctcggcggtgccgggagctttgcagatgctgggccctctccagcggggtggccatgagaagcaggaaaggccggttcatgccatgaatggtggccaggtcacctcggcggccggtagtgaaccctgctttggtgtgggagtcaggggataggggacatacacacacactctcagagggatagataagtggggcgtggggcagatgggaacacacacacgcacacacgtcacaactgggcatggccggggaagcaggcctcaccgttgatgtccacttgcagtgtgttatccctgctgtcacaggagcagtgggcgctaaggcgaaagccctcaatttcccctgtaggagtggcgagagggaagccagtctgagagtgcagctcacccagcccctggaggaagaggaaggaaggagcaaaccccaggggcttccttcctgcctcccccacccaccccactctgccctctcactgcagctctctctttttttttttttttttttttttgagacaaggtctcgcagcctcaatctccaaggcccaagcaatcctcccatctcagcctcccgagtagctgggaccacaggcgcgtgctaccacgcatggctaattttttttttttttttgagatggagtctggctctgttgcccaggctggagttcagtggcgtgatatcagctcactgcaacctccacctcccaggttcaaacgattctcctgcctcagcctcccaagtagctgggataacaggcatgcgccaccacacccggctaattttttgtatttttagtagagatggggtttcaccatgctggccaggctggtctcaaactcctgacctcaggtgatccgcctgccttggcatcccaaagtgctgggattacaggcttgagccactgcatccggcctacacggctactttttaaattctctgtagagacagaggtctcactatgttgcccaggctgggctcaagcaatcctcctgccctggcctcccgaagtgctgggattacaggcatgagccactgcacccagccagcatcaatctcttgaatgaatgagtgaatgatgttttctaggctcctacaatgtgccgaagcctgtgctgtgtgcttgggactcagcattgaccaagacagatgagctccttctaggcctttgtcgaacagcccaggacactcctcccagtgcccacctgctccctaatccctattttttctttttcttttcttttttttttttgagacggagtttcactgttgttgcccaggctggagtgcaatggcacgatcttggctcactgaaacctccacctcctgggttcaagcaattctcctgcctcagcctcccgagtagctgggattacaggcatgcatcaccacgccgagctaattatgtatttttagtagagacggggtttctccatgttggtcaggctggtctcgaactcccgatctcaggtgatccacccacctcggcctctcaaagtgctgggattacaggcgtgagccaccatgccaggccccctaatcccttttttttcatgtggccaaactactatttatcctgtgagtctccacacaatcaccctcacccagcaagccctcctagactccccagatgggtccaggtgccttctctgggctcccaacagcacttagggcgttcccccatcctgcatgcctccctgtcccagccttgtcctccctgctggtgcctccccatcccattcttgatcattctaggtcattcctgcctggtggggccttgacaagatctcttaggtgtccagaagtgactgtgggccccatgagggcagaactgagggctgtcttggttatcactatgtcccccacaccacccagcacatggccaggcacacagcaggaacctgtgggcaattattgaataaaagcataaatgagagggaggtgagggagagagataggggcaccatgggccctgccagaaaccagacagagacaatcatctcctggacagatcaaatgagttagttaggctctccctggcctccaggcctttgcacaggctgttccctttgcctggaatcttttttttttttttttttttgagatgggatctcactctttcatgtaggctggattgcagtagtgtgattatgactcactgcagcctcgacctcccaggctcaggtgattctcccacctcagtctcccaagcagctggaactacaggcacgtaacagcatgcatggctaatttttgtatttttgtgtagagaccgggtttcgccatgttgcccaggctgctctcaaaactcctgagctccagtgatccatcctccttggccttcaaaagtgctgggattataggcataagccaccatgcccagccccagaatactcttacacctctccttttcctgaccattctactcatcccttcaacatcagctatggtgcccctcctccaggaagccctccctgattctgggctgggtcaggtacctcctttgggctccccatcccagtcccacccactctgggtcatcactgccttacaggtctgttccccagctacctagccaatggactatatgagctctgtgagggcaaggatggggctgttttggtcattgctgtgtccttggcatcacccatcacagggcagggcagagaggtgctcaggaaacagattagccaatcactcaggtttccatgccacagaggggagccaggtctcagcactttcacaccagtatggggcggagaggggtcctaggcaaagtgaccccaggacaaacaatggggtggaccccagggagaaacaggggtgggacacacaagtaatcctcacctccacggctcaaccactgccgcacaactccggtgacatcaaaagataaccactctggcgagtcgctgggtgccagcagccggttgctgaggtatcgccaggaattgttgctgtatttctagaggatgatgaaggcaggagagagacagtgggtagatggtgtcacgaccccacatacactaactgaatccttcaccccatctgcttccccaaacaggcttccagaaagttcccaggcactaccctctcagacagccacctgtgtggtcctgtggcacccatcctccccaacagtacccatgagaggaggggtggagaaaaagctcaggctgcggtcaagtcaccttcacacagctcagccgaaggtgttttcttgccttctcgaggcctgtttcctcattggtgaaatgctaagccccactcagcgtggacagcccacaatgctaaaattctgctgctaacattctgggccgggcgcagtggctcacgcctgtaatcccagcactttgggagcccaaggtgggtggatcacttgaggtcaggagttcaagaccagcctggccaacatagtgaaaccccatctctactaaaaatacaaaaattagccaggcatggtggcacacgcctgtagtcgccactatttgggaggctgaggcaggagaattgcttgagcccgggagacacagactgcagtgagccaagatcacgccactgcactccagcctgggcgacaggacgagacttcgtctcaaaataataataataaataaaataaaattctgctgcaaacattctggggtttactgagcatacggttctgcaaatttgacaccctgaattctcagtaacttagaagtcatttctaatgattccggctgggcacggtggctcacgcctgttatcccagcactttgggaggccaaggcgggtggatctcctgaggtcaggagttcaagaccagcctggccaacaaagtgaaacctcgtctctactaaaaatacaaaaattagccaggcgtggtggcacacgcctgtaatcccagctactcaggaggctgaggcaggagaatcacttgaacccaagacacagaggttgcagtgagccgagattgcaccactgcactctagccagggtgacagagtgagactctgtctcaaaaaaaaaaaaagtcattttgtgattcaaatgtttgataatatcccaagatttccacttctagagcctgagaagctttagaagactaatgttctataaacccaagagtctgccatgccgcacctagatgctgcaggtacccaacatctgtgtagaataattttctgggccaggcacagtcgctcacgcttgtaatcccagcactttgggaggccgaggagggtggatcaccagaggtcagaagttcgagaccagcctgaccaatatggagaaacaccgtctctactaaaaatacaaaattagctaggtgtggtggtgcatgcctgtaatcccagctgctcgggtggctgaggcaggagaatcgcttgaacccaggaagcaaaggttgtggtgagccaagatggtgccattgcactccagcctgggcaacaggagcaaaactccatcacacacacacacaaaaaaaagaagaattttctggggctggatagtccactccagggactgcagaataaagctgaattccccagactccaagaagccaagctaacataggacaaagttctctcactgtgaaagtctgaaatctaccatcctatgagttaacattccctctgatatggattctagctcatagaaactgctagagcctccagcccttccagatgccccagtcctcttggaagctccctatcttctagagcagtgctgtcctaaagaactttctggaaatgtgctttatctgcaacatccaaaatagtagctgctaaccacatgtgactatagagtactagaaatatggccagtgagaatgaggatttctttttcatttttatttttttgagacagagtctcgctctgttgcccaggctggagtgcagtggtatgatctccgctcactgcagtctccacctcctggggtcaagcgattctcccacctcagcctcccaagtagctgggattacaggtgcctgccaccacacctggctaatttttgtatttttagtagagatggagtttcgtcatgttggccaggctggtcttgaactcctgacctcaagtgatccacccaccctggcctcccaaagtgctgggattgcaggcatgagccaccacgcctggcctatatatatatatttttgagacggtctcgctccatcacccaggctggaatgcagtggtgcaatcacagttcactacagcctcgacctcctgggctcaatcaatcctcccacctcagactactgagtagctgggactagaggcacgcatcaccataacaggctaattttagtattttttgtagagacgaagtttcaacatgttgcccagactggtctcggactcctgggctcaagcaatctgcctgcctcggcttcccaaagttctgggattagaggtgtgagccactatgcctggccctaaatttttaatttaattttaaacaatttaaattttaatcaagctaaatgtgactagtggctgtcatattggacagaatgattctagagcccccaaccttttcagagattccaactttcaagaatcctgtgtccttaaagagtccaactcctaagattccagccttctaagtgtttaacatcctaggatgcaaagagtctgaacatttaaaagtgctctaggttccgggtgcagtggctcacacctgtaatcccagcactctgggaggctcaggtaggagaatcacttgagggcaggagtttgagacaagcctggccaacatgataaaactctgtctctactaaaaatacaaaaattagcccagcgtgttggcacatgcctgtaatcccagctactcgggtggctgaggcaggagaatcacttgaacccaggaggcggaggttgcagtgagccgagatcaccccattgtactccagcctgggcgacagagcaagactccatctcaaaaaaaaaaaaaaaaaaaaaagaggccaggcgcagtggctcacgcctgtaatctgagcactttgggagaccgaggcaggtggatcacgaggtcaggagatcgagaccatcctggccaacatggtaaaaccccatctctaccaaaaatacaaaaattagctgggcgtggtggcgcacacctgtaatcccagctacttgggaggctgaggcaggagaatcactggaacccaggaggcggagattgcagtgagctgaggtcataccactgcactccagcttggcaacagagtgagacactgtctcaaaaaaaaaaaaaaagcgttctaggattgtatggtttgtgttcttctatccttcagggaccatctaggtggaccttgtaaccagccgacccacagccacccccttggtcacagctcaccctctccagcccatgccctgaccttccttctggctcatgtcctcacctggtacagctccacgtgctgctccacttttaacttgagcctcagcagacgcagctctgcccgggagagcaacacgggttcaggtaccgcttctcggagctctgatgtgttgaagaacatatatatgctgtgtgtactctgcttgaacttgtcatagatttctagcagggagaaatgaagggaggcgatcaggggtttggcagaggtgaggggagctggtgctcccaactctaggagttttggagctgacagctctggggtggagtcagtctctgataccttttatttatttatttatttatttatttatttatttatttatttaaatgaatttttttttttttttgagacggagactcgctctgtcacccaggcttggagtgcagtggcgcaatctctgctcactgcaacctccgcctccagggttcaagcaattctcctgcctcagcctcccgagcagctgggactaaaggctcatgccaccatgcccagctaatttttgtatttttagtagagatggggtttcaccatgttggccaggatggtctcgatctcctgacctcgtgatccacccgcctcggcctcccaaagtgctgggattacaggtgtgagccaccacgcccagccctgactgtgatactttttagctgtgtgaccttgaggaagtggtttctccccctaggtttgtttcctcctctgtaaaataggtcctaaccacattcctctctcatgtagcatcatctctcaagtcgactaaggctggcaccaaggggaaccactctgtttgctctggccttccttgccccaaatgcaagagcccctaaaatgcagagtaaggatcaaaggcacaggctttggactcagatagtgcctctgctgcctcttggctgtgtgaccatgggcagttaacaccctctttctgaatgtcagtttcctgttattctttgaaaaacagcaataacattaagctccctgcattcccacacagactctcctaatttaagcgctgtgtaaccttgggcaagtgaattcctctctctgagccaggtgtaagacaagacagagtgactctagaacccattccagtattatagtgggaaattagatgacccaggtcaagccatgtggcaccaattctgcatacactggtcactcaatcatgtatacgtctaagagtgctggctgggcgcagtggctcacgcctgtaatcccagcactttgggaggccgaggtggattgattacttgaggtcgggagttcgagaccagcctggccaacatggtgaaaccccgtttctactaaaaatacaaaaattggccaggcatggtgccggacggctctaatcccagctacttgggaggttgaggcatgagaatcgcttgaacctgagaggcagaggttatagtgtgccgagattgcgccactgcactccagcctgggtgacagagtaagactctgtctcaaaaacaacaacaacaaaaaaccacaaaacagcgctatttaccagatgctatctaaagcactttacaaagatgaagacatttaaacctcacaaccttatactattattatacccgtttaatagatgagaaactgaggcaccgagattaagtaatttgccccaaggtcacatagctgcagactgggattcaaactcaagctgtctcattccagagactgtgctttttttttttcttcccccaagagacagggtctcactctgtcccccagacggaagtgcagtagcacaaccatggctcacggcaggctggaactcctgggctcaagggatcctcacgcctcagcctcccaatatgttgagatcacaggcatgagccaccacacccacccagctagagactgtgctcttaacccctaagtgattcttctacttatttttattattagttttccacccttaactcccttccccagctggttagggaaagtgaagttcattctgggtaggaatggctgtagtggggagaaaaggaattaaggtgttttcttttctttttttttttttttttttgagatggagtttctgtcgcccaggctggagtgcagtggcgcgatcttggctcatagcaacctctgcctcccaggttcaagcgattctcctgcctcagcctcccaagtagctgggattacaggcgccgcccgccaccccgcccagctaatttttgtatttttagtagagaccgggtttcaccatgttggccaggctggtctccaactcctgacctcaggtggtccacccaccttggcctcccaaagtgctgggattacaggcgtgagccaccgcgcccagccaaggtattttctagtttaggaaaagtttggggatggggatgagggaacaggccatgaactgctggatcaactggggcaactgcttccagcctcccatagtgggggtgtgaaaagagactggtgagaaaggcagaggaaacccctcccctacggcccccttcgatcctcctcctcctccccagtctccctccccacccagccccagtaagccctattcttggcccggaggttactcagcaaaccccaaaggaaaggcagagccttggctggggaagacagatagggaggaagacagagaggagggagaggaagggttggagggtgatgcagagagggagaggcggggagatgtcagagacggagacgaggcaacaggaccgtggaggagaaaaatagaaagggagagaaaatagtcggagagacaaaaaccaggagacccatgcgtggacagaaagactaacggagacgaaaagaaagaggcagatggggagacacgtgcgagacgagacacatgtgcatttgttggggagaagaggattggaggtgtcagtgttaaaggaacctctacaacgaaggtgaagccacggaagataaggtaaggctgagacttgggtgcggagtgcgcgtcattgggctggagctgtaaactggcgcagaaatgggcagggaacccgcaagcccacaccgcccaagagtcagtgaaacctgagggatcttccccaaggctctgaaccacgcgggacgcctgggtcctcgcatggatgccgacggggccggctgagtgggagccccgcccgtagctggggtgaggagggcgggaggcgccgcagccaggagggcggggaccagacctgccccgtctcgccccgggctccgcgagcgatccccgcctccgccgggggcatgggaaggaaagggaagggagggggatgaggccgccggacgctggggtttccccagccaccctgagaggaactgggactttggggtccagactgccagcgtttagcgcagcggggtcctcctgccccttggtggaagcgcaggctcctccccccgcgcgtggcacccacgtggggctttctcactcctcccagcttggttttctcacctcggtcttgtagagtcaccccccacccagcacttcccctgcggctggactccgctcagcccattcccctgcatcctgcggggaatgcagcgtggatggcgctgggtatctctcctcctccccgctcacaccacctttcccacgcctgtctcccctctcggtaaagcccttcccatgacccaggactctaggtcttctggaagctcgattcctccgctgggctccccactctgtccctcacgtccctgtgtgaaacaccgaggacacctctgcatcccgggcgccctcccgagtctccgctcctctcccgcttgcctcctccttccaataacctcccgtccctttctccccacatttatcacacgcacctctgtttctctttctacgactctcccccacccccgcatcccgcgtgttcctggcagcctctggaagtgggtccgctctcactttcctggcaccctctggggttgccttcatctagcttttctgtccttcttgaatctttccacctcaggacccccaagctctgggtcaactttctccagcgcctctcctttcccaaatgctggggtcttcgcttctcccacaccaggctcccttctctgcacctggcaccccacgacccccccccccattcaacgcgtcctggaagagggagccttctaccctccccctattgcttgtctccctctaggggactgcccccacgaccccgcatgtttctgtcgcactctagaagcggtccacttcgctatctcctcctctccaagaccagacacctgggtggtagggggctcagtgccatcctctttcggacacccccctcccaccatcacacgttccctttgccccggggtgtcctcttcctccagccagtttcttctgccagtcacttcctacccgtggccccggcactccggcgccccctgggggcccccctcccggctcccctgcccctccgagctcaccgttgtgggtttccaccattagcacgcgggtgacctccttggcgtagtagtcggcctcaggctcgggctccggttctgcactctccccggccacccggtcgcgggtgctgttgtacagggcgagcacggcctcgggcagcgggccgggcggcacctccccctggctcggggggctggcgagccgcagcttggacaggatctggccgcggatggcctcgatgcgcttccgcttcaccagctccatgtcgatagtcttgcaggtggatagtcccgcggccggccggccaggcgtcagcaccagtagccacagcagcggtagcagcagcggcagcagccgcagcccggagggcggcatgggggaggcggcgccccccggcactgccgagagcgcgaacagggctggtgtggtggggaggccccgcccctgcaggggctgggggtctcccggcaaaaggtaggagggcctcgagggaaagctgaggtcctcagggagaagggcgcagtggtggaggggaggcttggaccgggggtgtctcagtatcccacggaaataacctagatgggcgcgatctggtaccagaaggtgggtggtcttgaataggggatctgtggcaggtcggagagagatccgtctcctggaggagaaagggtctaggatgcgcgggggctcaggagacaggccggggatgaaggcggcgtgcagggggtgcgcccgaggtctggggaaaagtctttgcgggaggccgggtcggcgactcccgagggctggtccggaatgggggcgcctgagggacgccgtgtagggggcagggagggagcaagcgtccccggcggcaaagggaggcggtctggggtccccaagtcctgcctcctcgcggggcagcgtcgcgccaagaggtccccgcgcctccggctcccagcggcaacggaaaagtctcaaaagtttttttcctcttctcccgaccagctcgtccctcctcccgctcctcctccccctcctccccgcagtggcgggggcggcggcggctcgtctcagactctggggcctcaggctgctcctcggcgactccttcctccgctccgggccgaggccggccccgcgggcggctcagagccgggggggtgccccggacggggcgtcccccctgcccccggccggggccctcgctgtctggctgctccgcggagggaggtgggagggagatggcccagggcgcgaagggcggcggcggcggggaccggctgggtcggcagggggttttgaagccgcccccggccccacccaggaagcgcacggggcgggagcgggggcggcccccagggggagggcatgggggggctgggccaccgtcctcatctcgcgtgggcgggctccgaggggggtcccttcagccctgggggaaagggggcgggcaccccggctccgccccgcaaacagggtgctgcctcctggcggccaagcgccaccaaagcgggtgatccagatgcgctgtggctttgcgggcggtgtgggtcaccagagaaagaggaccaggcggagaaggcttaatccgggggatgagacacaggggagccgaccagaggagggggacccagaacggaaggagagtcaggctgggaaacaaggtaggagaagagggtctgtcaacatgggggcctccggagggtgtcagtgggaggagggggcaacaggacacctgaaggatggaagggtcaggaggcagacacctgtaagaattgctctcctttactgagcacctcccatgtggctaagcagcctcctgtcactcaacaccctgcgaccccatacatttactgtccccaatttacagatagggaaactgggcccagagggaccccgaggtcctagaaaggacagaagcggtgccatgccttagctggggtcagctctgacagtctctagagtctgtgctcttgaccactgtgccatcctcccccatcactgggtgtccggggtgtggatggtggtgacgttggaggcagagtccctcagcactccacgccgtagcggtcgaagttgcggagcagcaggccgatctccaggtgcacggtgccaccagcagctgtgtgcaggcgatagcggtcggccccactgtagatggtgtccccatgcagcagctgcggcccaccacccacgaaagcccgtgccaactgttctcgccaactgcccaggggccgccacgtggggcaggccagctggtgggtgcccgggctactgggcacatggcaaaatccatagcctgcaagctggcagcggccaaagctgtcctgggaccacacctggaaatggagccggggccagcctgcaggaaaggagagagaggggaaaggagggatgggtggggaccagactcctgctgattccccactccctgatactcactggagaccccaggcccagtcttttcctctctgggtttctgtcccagagtttccaacccagcctcctttctaggctcccaccgtcttatctatccccacacagcagccaaagtgatctttccaaatccatgttactcccctgctaaggatccttccatagctccccagtgccctcagtataaagtccaacctcttcaacattcaaggcccttctaatcagacctctgctgaatttcctctctgtgttatcctcctccatgaccccatgtcagggcagcccattgctcctccagtccccaggtaaccatcatgggccttgtcagggacacctcctgccttccctcatgtccctgccctgctctctttgggcccagggccttctttcttgcccctctctaatccaccttccacctggcatctggaagcatctttctctccttccatagctttgcccatgtcctcagaacacagttcagctcctcagtctggtagtcaaagcccttggagatccagccccatctcatctcatgctgatcccttctcctgtgctagactctgttctagctagctggggacacggcagacatgaacatggatggcagacaaaaattcctgcccccgtgaagctgatatcctagacaacgaatgtagtaaataagcaaattatagggtagatcagatggtggtaattgctgtgagggaaaacagagctgggtagggtgagggtggggataccgctttagcaagaaggggatcaaggaagcttcattaagaaggtgacatttgagcaaatgctaaaaggaaggaagggagtaggccatgtggccatctagaggaagagtgctcctagccagagggaacagcaagtgccaaggccctggggggggactgtctggtggggacagtatggctggagcccagacggagtgtgcctggtggggacagcatggctagagcagaatgaggtggggagacgggaaggaggtgccagcctggttgtggagagccttgtgatgcatgctaagactatggctttcaccctgagtgagatggggaccattggagggttctgagcagagcagagatgggacctgacttaggtgttcacagggtcccagctgcatgtggggtgcagaccaggggggttggggaaggggactccagagacaagattcttgtcatagtccatgtgagagaagaacttggacagatcaaggtgctgggcgagaaaagggtaagaagtgggatttaggatgtatttcaaaagtagaggcagtttaagatttcctgatggacaaaatgggggcttgagaaaagagaaagcaaggctggtgccaccactgggggactggaggccccaagagctgaaaggttagagctgcccacctcacccacacagcaccggaaagattttttttttccccagctccagcttaaaagacagaaagattatttaaaagtgaaatctcagccaggcgcggtggctcatgcctgtaatcccagcactttgggaggccgaggcaggtggatcacctgaggtcaggagttcgagaccagcctgaccaccttggtgaaacgccatctctattaaaaaaaaaaaaggcaaaaattagccagatgtggtggcacgtggctgtagtcccagctactcgtgaggctgaggcaggagaattgcttgaacctgggaggcagaggttgcagtgagctgagatcttgccactacactccagcctgggcaacagagtgaaactctgtctccaaaaaaaaaaaggtgaaatctcacttgtccattacctgctctggctcccaagtgccttcaggagatggcctcagctcctcagcctggcactcaaggccctgcatggcctgtccccttctgcctttcccctctgccgtcccgctctccctcaatccactagatgcccttggctcactttcccctttgagtcttccacgtagctccctctgcctagaaccttcttctatccctctgccttattagctccgctggcccttcacagcaaagttcagaagccccctcctccaggaagccctctctgacctccctgacagagtcagccacttcctctgggctcccacagcctctccaaatcacctatcttagtcctgcccactctgaggtgccactgtctggagagaggtgtgtccccccataggacggtgaaccctgtgaggacaaggctaagggacactgccttgatcctcaatgtctccctggcatcacccaacacaggctggacacagggcaggtaccaggtagacgttctttatattggtgaaatatatggcacatttacctaggcaatttctcagaatcaactcatctccaggaacccacattttctactagaaaggctttctgatgccgctcctcccccagtactgatttcccctttgagcagcagctctactttcaagccgaggagcccttcctggagaaacagcccttgcctctctcagaccctgcctcccggcttcctctttattggagactctcgttttgtctctttacttgaatgccacctcccctcccaccctgaccccccaccttcccacctcctgctccaccctggcctctgccctaatcatacaaacttgggatcgcctattgagcaggcctgggaaggccttagctcagcctctccagggccagacttggctgcaaaagggacctacgtggtatggggagcagggacaggtcttggtgttcccagccccagggacctcagaggctactggccccctcccctcagcctggacccgggtccaggtgtgatacccaccttgaagacctttggtggcgaagtgcaggtcgatggggtgggaccagtaagccatgtcccctatctgcggggtgtccacttgcgtttggccctcccgcacgcctgacaggagcttccatgccgcccctgcagtgagagccgggacatagaggggtgggaggcagccatcgggaaggggatgccgctgtggctataggactgtttctctgtggcatctactggtaggggttacgaagcatggactctggaaccaagtatctgggttcaaatcctggcactacctcttcctgcctctgcaaccttgggcaagttagctttctctgccttggtctccccatctataaaatgagctgagtaataatgcattcctcattgtcttcatttgttttctgttactcttaacataatatccaaaactggataatttataaagaaaaggaatttctatctcacagttataggagactgaccaaggtggaggagccccatctagtaagagccttcttgctggaactcttcagagagtcccaaggctagtgtgctaacatgccactcacgtctctctctctcattttataaagccaccacttcctctcccatgataacccactaatccattaacccattaatccatgaatgggtaatgagcatagtgagcacgggataagtcttcaatatcattttattacgattctcaccccatattttcaagcctagtccaaggattaagatggggccaagggtaccctccaggagcgcatcctgaaacacacataacaatttcgatcctactgaggggtgataatgatagctaaaatgcactgagtggtaggatacagtggctcacacctgtaatctcagcactttgggaggccaaggcaggtagatcccttgagtccaggagttcaagaccagcctgaccaacatggcaaaaccccatctctacaaataatataaaaattaaggctgagcgcagtggctcacacctctaatcccagcactttaggaggcttaggggggggtggatcatctaaggtcaggagttcaagaccagcctggccaacatggcaaaacctcgtctctactaaaaatacaaaaattagtctggagtggtggcaggtgcctgtaatcccaggtactcgggaggctgaggcacgagaatcgctggaaaagctgcagtgagccgagattgcaccactgcactccagctggtgtgacacagtgagactccatctcaaaaaatgaacaaacaagccaggcgcagtgactcacgcctgtaatctcagcactttgggaggctgaggcgggctgatcacctgaggtcaggagtttgagaccagcccggccaacatggcgaaatcccatctctactaaaaatacaaaaattaggatgggcgcagtggctcacatctgtaatcctagcactttgggaagccaaggcaggtggatcacttgaggtcaggggttcgagaccagcctggccaaaatggtaaaactctgtctctactaaaaacacacacacacacacccacaaaattagccacgtctgtaatcccagcactttgggagactaaggcaggcagatcacaaggtcaagagatcgagaccatcctggccaacattctgaaaccctatctctactaaaaaaatacaaaaattagctgggtgtggtggcgcacgcccatagtcccagctactcaggaggctgaggcaggagaatcacttgaacccaggaggcggaggttgcagtgagccaagatggtcccattgcactccagcctgggcaacaagagcgaaattccatctaaaaaaaaaaagaaaagaaaaaaagaaaatgcaccgagtactaactaaatcccagatgctatgctaagtactttaagcatccattcatttaatccaccctctaggactcttaatcccctcctcaccccccagtttacagaccctccaccatggcccacgtggcctggctcttgctcccctccctgagttcatctcccatcactctccccctccctcatcaccctctggcctcactgtcccacttctgactccccacctcagggcctttgcactggctgttccctctgcctagaaagctctgctcctgggtgtccccatccctagcttttgttttcatccttcagggcccagctcaagtgccacttccacagaggggttctccctgaccctcttcaccaaacactagtccctgccacatcatttcttttcatcctagcacttaccactgtctggaatcacggtgctcctttctttttttgggggggtggggggagacaagatctccctctgtcacccaggctggagtgcagtggcacaatcacagctcactacaaccttgacctcccaggatcaagcaatcctcccacctcaacctcccaagtagttgggacgacaggcacacagcactatgctttgctaattttttatttatttgtagagacgggggtctcactatgttgcccaggctggtctcaaactcctgggctcaagtgatcctcctgctccagtctcccaaagtgctggcattacaggggtgagtcaccacacccaactgcactcgtttatctgtttatttattttattttatttatttttttttgagacagacttttgctcttgttgcccaagctggagtgcaatggcaccatctcggctcactgcaacctccgcctcctgggttcaagcgattctcctgcctcagcctctcgagtagctgggattacaggcacacgccgccatgcccagctaattttttttgtatttttagtagaaatggggttttaccatgttagccaggctggtctcaaactcctgacctcaggtgatctgcccgcctcggactcccaaagtgctgggattacaggcatgagccaccgcgcctggcctgcttatttattttctgtctcccctactgtatggcccaggaaaacagggaccttgcacactgctggatccccaagaccacaaacccagctcttggtatacagaaggtgctcaataaatgtttcttggacaaataagtgatcctaggaggtgggagctaatataatccccatttaacaggtaaagaaacaggctctgagaaggtgagttcatgaacatttattcagcacctgctatgtgccaagcactgttttccatgctggtgacatagcagtgactatagcagaccaaggtcccatcatgggactggattcagactcagctctaactgcagagcccaagcctttcatccaactgcctcagtattcttggctggatcaacatccccagcaactccctgaaataataaaaatcaggttagtcattactcccttctgggctgagttgagggaagcaccaggccctgcgtcaggctccttaaaagcaagatttcccaacagccctatgaagaacaaatgaggaaactgaggctccaagaggggacagcctctgcccagggtcacagagaaggtgagtggtccaacctggaaaccaagtctgactccagagcctgcccctcatccatcagctggagggttccgatttcctgggaatttcaacttccacctcacttacctgtagaatcaaaaaggacccaggggccaggcgcagtggctcacacctgtaatcccagcactttggaaggcctacgcaggcggatcacttaaggccaggagttcgagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaagggccaggcgcagtggctcacgcctgtaatcccagcactttggaaggcctacgcaggcggatcacttaaggccaggagttcaagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaaaaaaaaaaaaaagggccaggcgcagtggctcacgcctgtaatcccagcactttgggaggccgagatgggcagatcacaaggtcaggagatcgagaccatcctggctaacacagtgaaaccccatctctactaaaaatacaaaaaaaaaaaaaatagccgggcatggtggcgagcgcctgtagtcccagctatgcaggaggctgaggcaggagaatggcatgaacctggaaggctgagctagattgcaccactgcactacagcctgggaaacagaacgagtctcaaaaaaaaaaaaaaaaaaaaaaaagggactaggactcaggcctgaagacatgataatgccaaatggccacatctgtttcatagacattcatctgtgccacgcaacaacataccccaggctttacaaacaagaccccatcaaagtcttgtataagccaggcaaacactgaatgagcacttcctattccagccctattcctattctaagtgctgttgatactcgtttagtactcatgacaacttcaacaggtaaatatttctatgactctcattgtacaaacaaggaagtcgaggtgaagagaagtgcccaagttcacataatcagcccaagggtgccttaacaagcaataactggttttgaacccaggcagtctgtgctcttaacctcaaacctgtgctgcttcttagctactattagcttcactttgaaacaaggaaactgaggctcaaagtggtcgagtccaaaggtctccaattaataggtgggggagttaatatttaaatgcagatctggcagcccatgaccctaaccattacactataccatgactctatagggcctcagttggggaagcatgaacaaaattactttcctgggacgtggcggctcacgtttttaatcctagcactttgagaggctgaagtgggtggcctgtttgagcgcaggagttcgagaccagcctgggcaacatagcgagaccctgtctctacaaaaaataaaaaaaattagccagatttggtggtgcgtgtctgtagtcccagcttctcaggaggctgaggcgggaggatcactagagcccgagagttcgaggctgcactgagctatgatcacaccaccttactccagcccgggcgcagagagagaccctgtctgtatcccacccctcacacacacaaagatgggagcttgagactcatgtggacagggtgtgggctgggcctggagtactgagaactgatggaaatgaggttaagagtctgcgttaaggggtggaggaaggagcatgtagcctctaggctaggggtcttggtgtggaaatgaaccaggcttgggggaatacctgtgtgaatgccccacttgcagaagaggctactttccgagaaaccgctggcccctatgatctgcccgatcacgtgcacctcagccatggccctgggaggggaaaaatataatcacaaccctgtgaggtaagtgtattatctccatttgacgggggggaaactgaggcccagcaagtaaagggtagtactaggattccaagctagcttcgtcacacccctgaggctgaggtcttgaccacagatcctaattgccaacccatgaaagcctggaaaaaatggggggacccttgtctggggaaccagcatttaactctgggaagtccaaaataaccttttcgggttcaggtcggcggaaagccccgcccgaaggggctatggctccgcccacgagcgcaaaagacccgccttccgcgtcacgccagccaccccgcttccctcccccagcaagctccataaggcgcatgcgttatgagttcagg

SEQ ID NO: 1325 - DNA, 63897 bp, Homo sapiens
catacctgatcaaaccaatctaagagccctatataaataagacactgcctcctcaaaccagactataaaattccgcatattcaccaccagcaggtcttttgcgctgggagactccttcctctacagaggcagctgtttctctttctcttctcctctacctattaaacctctgctcctaaactcctcatgtgtgtctgtgttgtaaattttcctggttcgctacaaggaaccccaggttatataccccaggcaacgcagtcgctccagcatcatcttactaaggtgattagagggaaaatgggaacaacctaaaagtcacagctgaatagttcctttctaccttccacatgtatgtaatcattaagagatcaaaaaagtgcttttatatacctgaagggacagggcacatgggttaaggccctgggccatggaggtgcttcttagttagaatcccagctgactagcctctttatctgactgagcttccatttcctcatctgtcaaacagagataaaagtgacaactacctcaaagggtgattgtcatgattaaatttaaaagcgtatttaaagtgcttagggcagtgtctgacttactgtacatgctcaaataatattaatgatgatgattggccctgttatgaattccaagcacaaagccaggggcacatggtgagcatcccataaagatggcatggatccgttgatttgagaaggaatcaggacacttgattctagtcctgtctcactaaccatggtgggaacacagtcactttgcttctctgtgcttccattttgctcctctatgaaatggggatacactgtccctctgacacagagcaccaatgtttgaaaatgcctagaaaagtatgaagcagcatagaaatataaggtgagatttctttctattactctcacatctgtgataaagccaactgtcttccgccaagctaagaaagttctgccatagctaagaattcttgctctaatttgccttcaccacctaggtctgaatgtttcagccccttcctccattgactggtgacccttacagcaaaggtacaggtccacaagttcaagaacgtatctatatatatgcagaatttctaagcatattatcccttcactctttttgtttctcaggcacatcagaaattatccaaataattggaatcatgaaatgggtgataaagatagaaatggctttgcagactgtaagctgcttaggatcagggactgggactctcttgttcctcacaatgccccagctccccacagggccctttggcacataggagacaaccagtaaccttgtggtggatgagtgactatggcagaaatcaagactgtccaccccacagccattcccagtttcacccatgctaacagatcctagtcaatatgcatagcctagagaatgaataatgattgattaatataagtcatctaagcagttgcatttccctttgccaaggtctgggtatgtgacccagtttggacaatcaaacacaggaaagtcttttagtaatgtccctttttgataaagcatcatattagaagaaaagccccatttgccacctgcttcctttcttcctacttggcttttcttttctttttttttttttttttttgagaaaggatcttgctctgttgcccaggctggagtgcagtggtgcaatcagctcaatacagcctcaaaatcctgggctcaaggaatccttctgccttagcctcctgagtagctaagtgagcaggtacatgccaccatccacagctaattttttaaaaaaatttttgtagagatggggtcttgctgtgttgccagggctttctttctacttgggatgcttttgtgggaggacatatcagagctgtggcagccatcctgtgaccaggagagaagtgccaatgaagacacagagacctgactaacacctcattcttgtgaagctgctgaacccaatcctacaacactcctaagtcccaactctagttatgtgaaatgattcaaagtctttgctaattaaatcattattttttcgtattctcttacttgcaaaagaatacagtcttactgagacaatgaatgactgcttgttccctacagaagatctcccattatatctaagtacaaaagaaaatatagttgcctttttaccaagttccttattgtgcaacaaagattaccacttaaccaatctcccacttttctcttacaatcttggtgtcaagacatctttctagtgtcttctgaagagattcatagtgccaccccgaccctaaggacattccttctctgattatcttttgtcttattatcactttccatagactaaatattatatcttggtttgtaactactttagggggcctcttccagagtaattggtcattatctttatgcctcagatcttcttgagcgatattgatgatttccatatgcaaaatcacatggggttagtagagccacacaaacttaggccaagctttgttctgattaattagaaacattattttctggtgcaaagctaccccctctctagggctgaagtttgcaaacattgctgtatattcaaatcacctgaagtgctttaaaaactgatgcccatgtctcctcgttgtgaatcaaatcaggacctcagatgggagccaggcatcagtatttttaaaaatgttttaattatttatttattttattattttactttttgagatggagtttcgctcttgtcacccaggctggagtgcaatggcgtgatcctggctcactgcaacctccacatcccagcttcaagtgattttcctgcctcagcctcccgagtacctgggattgcaggcgcctaccaccatgcatagctaatttttgtatttttagtagaggtggggtttcaccatgttggccaggctggtctcgaattcctgacctcaggtgatccaccctcctcggcctcccaaagtgctgggattacaggcgtgggccacagcatcttgcctaaatttatttttaattgacaataattgtgtatatttatggggtacaaggtgatgttttgatctatggatcaggcatcagtattttttaagtttctccatgtgattccagtgtgcagctgagtttgaaaatcaatgctttagaccaggacttctcaaactttaatgtgcacatgagtgacctagagatcctagatgttacaaggtgaattctgattcataggatctatggtagggcctgggattctgcatttctaatatgctcccaggtgatgacaaaactgctggtctgaatctcacacttcgaatagcaagggtctagatataaaatgtagatctagtagtagtctattctaacagcggatctgaacaaactaaattccatttgggttcaactgcaaagtcacaggaaaagtgatcactgcaataaagtcaagagcaggggctgtgagtgagagaactgagaggatggttgtttttgatctctagtttatagacttaggttgaccaaccatccaagagaagccatctttgcaaaattataacgatgagagaaatctgacacagtcgaccccattttgcataactgacatattttgaccccatagtttccacaatcccttattgctcaggagtcatatggccagagatcacaaggtttgcgacttccccagttgctcatctaggtaacatcactactgtagaaactaagattggttttttgaaatattttttcaacagatcccacccggccttgtgactcatgattcacccggtcctgtggccccacccagagttggactcagcacacaaagaagtgttccacacccctatgatttcatccccaatttatcagcagcaccctttccctagacccctgctctccaaactgtccataaaaaccctaaccttcaagcctttggggagattgatttgtataataactctatttcccatgtggctggcgtcatgtccattaaactttttctctactgcaatgccgtgttctcaatgaactggttttgtctgtgcagatggcacaggaagaacctattgggtgattacaccagtttgcccaggactgaggggttcctggcatgtgggactttgagttttaaaaccaagaaagcccagagcaaattgagacaagttggtcaccatagttatggtgctgctaggagagcagcagagcagccaagctgtgcgctttttgcattctgattcctcttcctgggggcagcagcccactataaagccaggggtgtgctaagatagatggcttacggaaaaggaacgctgaattgcatggccacaccaacaagaacttaattacatgactccagaagggcaataacagggcagattctgtgaaaactccagaatcttagccacagagacaagtctagaaaacacagtttagtgctttgctctagcactggttaactgtgggacctgggcaactcatgccccctttctgagcctcagtttccttggctgaaaatgggagtgaaactgacagatgtgtgcgagtctttgctgtgctcccaccccattatttcacatacagtatggataatgcatataaccgcacaatagcaccttttcagcacaagcagcaaatccaccttctgttttgcgagcagccatttccagtgctccccaaactccctctggatagcattagcattcatcttattcgggaacacttcccttcactgtcctttgatgctcagagagctgagaactcacagtgctttttttttttaaggctgtaacatatttacaaatctaaatgaagctctatttccagacccagtctttcggttttgagtggcttcctccttctgctctcacctccacccagggagcccacttctcaacttcctgttttctttagagagacaaagagtctccccagccacccattgctggattcctgttaacctttcattaagcctgctgacagctggctttagctcttcatgagttagttcaacacattcccatttaaatgtgtcccacctggcttcattaagtttcctgccaggttctccctttacagcttcctctgcaaatgcaaatcagattctgagtaaataatatggggacaagggaagattgagctataatggggttgtaactggaaagccattgatatactcaggttgctgtggatcagaggacactgaaatccatttgagtccaatgcaggtcagtgttacagagccatatgcatgaagtctggaattggagccctcactgtgaagtacagggtagtggttagagtgtggagtccttcaagcctggttcaaaacctggctctgctacaggagattggacgacgtgaccttgagcaagttccttcacctgcctgtgcttctgttttcttagctccaaagccaaaataatatacccgctttattgagctgctgtcaggagtcaatgagataattgccttgaaacagttaatagagtacccagaatataataggtgctcattacaaattgatagtatctcctgtgtttagcctagaaaggccatggtgaggaattaggttgctttaaattgagcttgcatgcggcccaggatggctttgaatgtggcccaatacaaattggtaaactttcttaaacattatgagattttttttgcgatttttttagcttattagttataattagtgttcgcgtattttatgtgtggcccaagataattcctttacttccagtgtggcccagggaagccaaaagattggaaactcctgctttaaattgtgaggtttgattgtggatccaccatataatcattagctgtaagaagcacatactgcatcacattccttccttatggaaatggaaaaacaacattgattccattcgattgcattacctttttgtttgtttgtttgttttttgagacagacacagtcttaatccgtttcccaggctggagtgcaatggtgcgatctcggctcactgcaacctcctcctcccaggttcaaccgattttcctgcctcagcctcccgagtagctggaattacaggcacctgccaccaagcttagctaatttttgtattttgggtagagacagggtttcgccatgttggccaggctggtctcaaactcctggcctcaagtgatgtgccacctcggcctcccaaagtgctgggattacaggtgtgagccactgcacccggcctattctattgcatttcccatgtgtgttttgtctcattcagaagtgaagctccttaaaagaagcaattctctctcctgggccccacatacaatagataccaaaaagttatttatagatgctaacaattcatcctgattacacaaagagggaatgagaggagcaactacatccacagcctcctctgatcaaggagtctcagtataagaattatatatttattttaattcatcttttactaaaatccaccctttatccccagtctcaaactggctaccttgttttagcccacagccatgttttgcttgcccaggaaatcattttaactaattttaaattttaatgcccttaagtggacatacactccgatttatcatgggccatgtcatctccctttgactccctcaactgtatcagctgcctggcctctaaattcatcagagtttgccacctctgccccaggcagagctaagtgtgctgcttctaggtaggtctaggggccaaggatgaaaagggctggaagacaggagacaggagacccatacctgtattgaaagagggtatctctgccacagcatggagaacagacaggaaaaggagtaaagtcagagattataattaggaagatactgcaggaatccagccagaaagtgctatcagcttaaaggagatgaagcagcaggacctttgcccctggtactggaagctcctgaccctctgtctggccaagcccaccaccacacagccctggtaaagggagattgttttcttgaacactttatctgttaggaattactacagtgcaacatttctcaaactctaacgcacatcagaatcatctggagggtctgttaaaacacagtttgctagactctacccccagagtttctgattctggaggtatggggtgaaggacatgaatctgcatttctatcaagtaccagtgacacggaggctgctggtctgaagtgcatagtttgagagccaccgggctagaccagcatttttcagaacttggttccatattagaaccactttgggacatttttcaaaaattcagatgcccaagtcataccctggaccaattacagaaagaatctcttaaagggtaggactcaggaattggcatttaaaaagctccccagttgattattcagctaacattgagaactactaggacagaggctcctggaggccattacgagctctaaaatactatgattgctcatgttagtgtttcttagtcggtacaaggagtttcagaaatacatttgggaatcgattgaaaatacccctttgcaaaacagaaaagtaatattcattgagtttaaatgttctgtttaggaagtgtctgtcgtcttctttttctagtcagacccaagctggtagtgacattgataatggcggtggttttggaaggtggatagggagcatgagctaagttagggttgggtgtatcattacctcacaagatactataacctgactacatacacaaagccatctggccccactccattttctagatggggaaattcaggccctgaacctggctctagacccacttccccaacgtttctaaataaatgtttgagtttagcacactagacaaagtcactttaagtatcttaagctgacatcaaagccaagttgaccaaaaaaaaaaaaaaattttttttttaaaaaaagggccaggcacagtggctcacgcctgtaatcccagaactttgggaggccaaggcaggcagatcacctaaggtcaggagctcgagaccagtctggccaacatggcaaaacccatctctactaaaaatataaaaaattagccaggtgtggtggcgggcgcctgtaatcccagctgcttgggaggctgaggcaggagaatcgtttgaacccaccaggcagaggttgcagttagccaagatcatgcaattgcactccagcctgggcaacaacagcaaaactccgtctcgaaaagacgagaaaagaaaagagaagagaaaaagaaaagaaacagctgccaatctgctgctaattgttttcatcattggtgccaatcattctgcccaactgcaactgaacaagtcagaagtcaggctgccttgggccagtttttccaagtacccaggtgagggggatttttactaactgttggatcagtgttgtgtgaactaataggacaaaaaaatctataggcttcaccagtcaagtaattagactgacttttttctctcttaaatgtaatgtcaagagagttgaaatccaaagatggctacatttagagaaccacgtacttattccattaatgttgctattgctgtaaacatgctgggaagtccttcacagaaatgtctttcagatctggtttactttccacatttctacccagccagaagcccctctcactcaggcacacatgttttttatacattcattcaacaactgtttgctttaatctctctcccatggctcctcgtgttagcagttattaaagttttaaaataaacctgttgttgctgaggagcacatttccaagattatatttagagaaacttatttggattgccttgctttcacatccacgcactgcccctggttgaatattcctgtcattcaccacattttactcccacggactcttccctgtttccaaaattaaattccccaagcaagaactaggatgtgacactatggtcacctctaaagacactcaaatgtgaaaagaaaataatagaaaatttaggagttttagaagtgagtcaatgttggccaagtgcagtggcccaagcctgtaatcccagcactcggggaggctgaggcaggcagattacctgaggtcaggagctagagacccacctggccaatacagtgaaaccccatctctactaaaaatacaaaaattggtggtcatggtggcatgcacctgtaagcccagctgctcaatcaggaggcttaggcaggagaatcgcttgaacccgggaggcggaggttgcagtgagcagagattgtccattgcactccagcctgggcaacagagcaagactccgtctcaagaaagaaaataaagaagtgagtcacagttacggtgtgattccatgtcatttcctgcattgttaatgaaccataggctctgtgctgctcatatcatacctgcagtgagacaatgaactctgaaagctgggcataaaaggagagatacgaatccatacgagatgaaggcaattagggtaacaaaagaaccagaaattgtatcccagaagcaaggaaatttggagaaacatgagattctccttctaatacctgaagagttaacagctctccagtacttcccagcatgcttagagcaatagcaacattaatggaataagcacatgtttctccaaaggtaaccatcttttggatttctactctcttgacattacctttaagagagaaaaaaaaaaatcagtcttattgactgatggagcctatagattttttgtcctgttagttcacacaacactgatccggcagttaataaaggagatgttctgataggcataaggagctcaactatgacctatgggcagatgtcatccggagacagattttgctataaatatttcttaatctcagaactgctctgagattgaatggactcccttgcgtgtggtaaggagttcactgtcactgaaagtgttcaagtgtactgtgaaagatcacttagcggtgattctacagagatgattagagcatggacagagaagttgtggtctctaaagtacccttcattcatgaaactaaagcaagcctggatcaatgacatccatggaataagtgagtcttttttatgaaacaaggaaatctactaagacttattttgacactggagtgtcatgcccccatcctcaatctaacatgctactgcgttgttagagggtaaaaaggccgtcttcgtcttcccttccatgctgcacgtcattgaggacatttttactatctccaatgtagtctagcctgtaaacagaaaagaggggctcataatgggaaacacaagactagaaaacaaaacaaaacagatgctgctaagttacagtgcaattacccttaaagttcaaagggctcacagttcatttagtctaagctccacattttacagatgggaaaactgaggctgcaggggaaaaagagtttctgccaatccattataatgagataaaaaagattcttagcaaaatataaaatcatgatttcaatacgtttatttaccaaaaggtctctaagtgtgaccttgaaaggtcacctcgctgggtgtcaattttccttcttgctaatacatattgtggtattaatgcaactaattagtgaatgcaattaattaggcaaggacttcattaataatttatgccttttttaaaaatttcttttccaaaagctatagaatagggcaaatagctaaaatcccttactagagaatcttcaaatactatttttaaaaaggccccaaaacaagctgcttccatggtctaactgggcagaggaaccaactcccaggaataatattctacatgcttttttcattttccatattgccaacgctcctcaataaactccagtttaacaatggcctcttaaactaacttacccataggtgaacaaaaaatttcagagtaaagtgccatatcaccttctttcttttgcgtgctatacttctattaatcccacctgccttggtactggcattttgctcagagtgttaaccaagacacaggttaatgtgagctaaatctgcacaactttttcacttctaatgtcacatctttccaactctatgtgtaatcgtaacacaagctcaagtcattaaaccactgagtagtagctaatcatttgtaacagcttgtacaatcattacaacacccattcatgcaagatagattaccttgtgtgtttctgcgaacaataggtttccatgagtttccctgaaaagacaaggccacagtgtgagcagagtggctgcggtgcatagaacatgcaaaatgctgggggaattccagtgctgccccgcaaagagcagatatgggccaaaggtgagaaccagtggctggctttggcagaaaaagccattccctttcccaggtcaaacacttgctattttaaccacagttagtgctcatcaattaccaagttgttccaacattctgggcaatggtgttaagctatttcattctgagtcatctgcctatccagaattcaagcactcacttgggtttcaaaacacttctttacgagacatactcagaattttccaaaactgtaatcatgcctttgtatgaaggctaacagcaggattccagtaaattttaaatttgcttttgcacctggggcaggtgttgaaatatacaagtttcattattattcaaatcagctgagatggttactagtctcatctcctgacatactgccctgaaacagcttttgttaatgagtacagaacaatttatccccattttacaacagtaccaggtgccacgtgcctataatttgcctgaaaaccataagctgtttcatggctgtttttgtagcattttaaaacttttgggggcggggggcaggggtgggatggaggtgcaaggtcatggagcagcttgctaacttaatgaaaactacagaccttgtcccctgaaaaatgcaggcatgaacacataaacacttttgcatgtgatttcaaaggattcacattacccttgaagtccatctgtggcctccaggttaagaaagcttgcttttagggaacatataagaaaaccaggatcacgccaggcatggtggctcatgcctgtaatcccagagctttgggaggctaaagtgggtggatcacctgaggtcaggagtttgagtccaacctagcccacatggtgaaaccccctcctactaaacatacaaaaattagtcccgtgtgatggcgtgaacctgtagtctcagctactcaggaggctgaggcaggagaatcacttgaacccaggaggcggaggtgcagtaagctgagatcacgccactgcactccagcctggacaacagaatgagactctctcaaaaaaaaaaaaaaaaaaaaaaaaaaaaaagaagaagaaaaccaggattgttcatggtcttcgtcctgcaacaatcctagccaaaagaagagacaagctagggttttcccaaccaaagaacagagaaagtgaacaaagtaggaaatagtactttcctcttaaggcagtaatagggataaaatgaattaggcacatcaagagtataccatcaggactggcacagaaatgtccaataaatgaaggtgctcttctgctttttttccttttccaaaacgtaaactctaccaggaggttaatacacagagtcattagcagcttggggagaatgaacttacctgttacttccctggctgggatgggaacaatggcagaactgagcctctttggggagggataaaggggaaggaagtggagacaactccagatcctcctgcagtcgccagggttctgaagtgctccatcacctggccctccctccttacctctcaggagaaacgccacaaacaatgcgaagagcacaaatcccaaggagggggcgatgatcatcagtagttgggagatgggcatttcattcttcattgacatgggtattccatccatctgatgggacacaggcaaggagatggacccagtcactgctagatgccaccctcacaagatgacatcccagcccaatagcaccttacaaccaccagcagtttcactacatttcaccaccttttgtcaaaaatctctgaaaacccaaaacacgtgacccatatcccaaaattttccgaagtgttagacatcaggcataaggagctgtggggctcaggggtctgaggataaaaaataactgttgtgagctgtgttctccatggtcaaatctctttcctagccgctgctcaaatcctttgagctctccctagccctgtgctactcttttcatggctgacttaggcttctagagaaaacaggatgaaagagaaaatgaaacttaatttcacattttctacagcagtggttctcaaagtctagatggggggcccatgagatcaaaatgattttcatgagacattttttgccattttcactatcattctctcatgagatatacagtatactttcccagaggctatgtgatgtgtgatgtcattgctgtcacttacacagaatgtggaaacagagatgagaatccctctgtctcctattaagccagatattaatgagatttgcaaaaaatgtaaaacaatgccatatttctcagtaattttttcattcatttttctcactaatattttttcaaaatagagttagttagttgccataaaacatgttatgttagcacaaagtgagtttgttgttatttttaaataaattgatttttttaaatgttttaaatacagatacctgtataacaaacttgcacatgtacccctgaacctaaaagaaaagtttaaactttttttttttaattttaaaaaatgagatggtgtctcgctatgttgcccaggctgggctcaagctcctgccattgctgggattaaatttttttttttttttttttttttgacacagagtctcactctgtcagccaggctggagtgcagtggtgcaatctcagctaactgcaacctctgcctcccgagttcaagcaattctcctgcctcaacctcccacgtagctggggttacaggcatgcatatccaagcccggctaatttttttgtttttagtacagatgggtttccaccatgttggctaggctggtctcgaactcctgacctcaagtgatctgcccacctcagcctcccaaagtgctgggattataggcatgagccactgcacccggcctaaaaaaattttttaattgtaaaaatgtctcagttttttctgctgagcagtctagagaatcaaaaaccaagtctcagttttaagaaactgattttttttttcttttgtagagacaaggtcttgctcttgcccaggctggagtgcagtggcaatgattacagctcactgcaaccttgaattcccgggttcaagcaatcctcccacctcagcctcctgagtagctgggactacaggcatgcatcacgatgcctggctattttttttttttttaattttgtgtagagacagagtctcactattttgcccaggctggtcttgaactcctgggctcaagcaatcctcctgcctcggcttcccaaagtgggattacaggagtgtgccacaagacccaggctgttattttgtttgagacagggtctctctctgttgcctacgttgtagtgcagtggcacaaacaaggctcactgcagcctcaacctcctggactcaagtgatcctcccaccccagcctcccaaagtagccaggattataggtacatgataccacactcggctattttttttttaatttttatttttgtagagacaggggtctcgccctgttgcccaggctagaaactgagtttcaaacgtttaaaaagaccttgtgaaagtccccactgccagtaacatgttcaaggtggtttagaggtccatggggctgaccagcctgagcctactcaccttcaaagtctatgcagcaccaaaaaaggacttccctccccaaaatcccatgaaggtttatgagttttactctactaagttctcgagggctaatctaaacatgcagatgagtcaaggacccagcttaggaaagcatctctcagctttgacattatcaagagctatataaaagttggtgtcaggaaaggtactcctaaatgaagccaaagatgtaaagtttggttcaatgggggtgagacagctatgaatatctccaaaatgcacctgctggattttttccaggactgggtgttattggttttgctggccttgttggacttgttttggctagaggttcaaaaataaagaagcaggcatttctacccagtttcataggattagcagcctctatccattatccacagcaagccatcgagtttgtgcaggtcagaaaggagatattatatgaccagggtttatgaggatacatagtcgtggaagatttttggaaggagaactttctaaagccaggaaatgtgaggaattcatctgaaaataaatagaaaatttcatgctctacacattttaatcagttacaggtaagcaacagaaacttcaaatggtcaatcattatttttacagaaaaatagcagagaagtcagtattgaatatattaaactggctttcttcttcaggaaaaactatactaggtctctgttatcttgggtgatgccatcctacaagcaaacaaatctgaaatcctttcacttagagataaggcacaaggcttagaactccctgtactcatgttgctatttacatacatgattaaaatccaagttaaaaaaagaaaaagagagagagagagagaatataggccaggcatgttggctcacgcctgtaatcctggcactttgggaggccaagatgggtggaccacttgaggctaggaactgaagaccagcctggccaacataatgaaaccacatctctgttaaaaatataaaaaatcagccaggcatggtggcatgtgcctgtaatcccagctactcaggaggctgaggcaggagaatcgcttgaacccaggaggcagaggttgcggtgagtcaagattgcaccactgcactccagcctgggcaagagtgagactttgtctcaaaaaaaattgagaactgctgctctgcaggcaggcattggggcatcttgctggggctatgccatctccattgaccaagatatgctctctccctctcttcctgttccattctgtaacacacagaatcccagagacagtgggcacagcaaccaggacaggacaacagacagtgtctgagagagagatggggaagaagaaagaggggatggggaaactttacttatcctttacagacttctgtactgcctgaagctttcacttaaaatggcttgaatcacttttgtaataataaaaatagcaccctcagaaaacaagagaaatattgatggcaggtgttgattctgcagtatgtcatgaactctgggtcacgcagacggaacacacaatgatcttgcatgttttttatatttttttctttttgcttttcaaagtattggcacatacagatgtaacaatcaaggttatttctgccaagagtacaagtctataaattattgggctgtttcataattgttgcaatgaattttgcgacagcaatatcctgcttttcctagtccatctctgcaaacctctgcggattttttgtttgtttgttttttgttttgttttgttttaagagacacagtctcactctgccaccaggctggagtgcaatagcgccatcttggctcactgcaacctctgcctcctgggttcaagcaattctcatgcctcagccttctgggtagctgggactacaggcatgtgccaccacacctggctaatttttgcatttttgatagagatggggttttgccgtgttggccagggtgatctcaaatttctggcatcaagtgatctgcccaccttggcctcccaaagtgctgggattataggcatgagccaccgtgcctggccactactgtggatttttactatttaagtgatatactgcaaatacttcacagattttttacctgtcctgtttttgttgttttgttctgctcaggaactgctgtatcagatgctgggaaggaaaagagaagaaaatggttatatgtctggttggggaataaaatatcacatcctgaaataggtaattaagagtccatctggaactgcagctgatgtgtttaattatttaatcccgtgttttttgtataatctatttatgcatatttgttttgatatggttttaatgtaaattttatctgctatacaacgttatccctgggaacatcaccattttacagatgagtagagtcaggcattgggccagtaggcaattggctctaatttttctgtaggcttcagcaattcattcaggatttttatccggcaagaaaatttgtcagttttctagttaataaatatttactgagcacctattataggccatgcagtgtgatagctataccttggacctcatagaatttacaacttagtgcagaaaatgaaatgtaaaaatgtaatgtaaatagttgaaaacataattagttacaagtacacaattctgggaaaaatacagtataagggacatatcatgaggatgccaggcttgttctggagggtcaaagaaaacttccttgagaatgggagtttatgctgagaggtggagtcatgtattcataatctatagttgagttacaagggaaccatactgagaatctaccaaatgctaagcactgttccaggcactaagaatactgtgagactgcggcatggcccctaccctcaagaaatttacagtccattagagaagagagaccgaaagatgatttcagcctaacaggccaaaggtagtgatggagcacacaggctgctggaagggcaggtagagggagaagcattcagctcaactttgtagttcattgaaagttttattagaataaagtgtcatgaggacagagtccctgtctgcttgttcactactgagactgtgataccacctcacatatacttggtgctcaataaatgtttgttgaataacacttctgagttaaggtcgtgtaagaattagccaggcaaggaatggtggcaacggtgtttcaggtggacagaacagcatcagcaaagctgtggaaacaagaaagagcatggtgcccatgtcagatggcaagtggccatgaagaggtgaaatgaggggtggtagctgcaagagatgagacaggtgagcaagagccaatcagggaaggcctttgtttcctgatggtaagtctccattggattctgtaggcaatggaaaaccacagaaatgtttaagcatgatatggtccagttaggaggataagggaagagccaagaagagagttgtcatctaattccaggtctgaaattcagagctagtaaaaccaaagagagagagagatttcagaaatgcttagaaggcagaacaacaggatatggacattgaatgtgggggtaagaaagagagaaaagtctttgatacctcaccagttcctacttgagacacctggccatggcctgagctgtccactaagactgagaacaggggaaggagtggagaagggtaagtctaggggagaaaagtgatgagttcacatttacagtcactgagtgaccgtggggcacatgcaagcacaattcccctaacaagcagttgatgcatttgaatctaaatcaaactcaggaaaaaaagggtgcagttggaaatactgatttgggagtcatcagtatccagggagcagttgaccccctcagagtatataagaaatctggcccgggcacagtggctcatgcctgtaatcccagcactttgggaggccgaggtgggcagatcaagaggtcaagagatcaagaccatcctggccaatatgctgaaactaaaatacaacatacaaaaattagctggcatggtggtgtgcgcctgtagtcccagctattggggaggctgaagcaggagaatcgcttgaacccaggatggggagattgcagtgagccgagattgccccactgcacttcagcctggcaacagagagagactccatctaaaaaaaaaagacagaaagaaatccatgggctgcatgttcagagagaagagcagggatcctggaaaacatcagcattaaacagtaggcagaggaggtggaggagagaaaaaaaaagagaagaaatggtcagagagatcagaaagtaagagcagtatcagaagccggggcaaggaagaaaacatccaggagggatgtaaagtcatatgtacaataaagtcttaaaatagaaacagaacttaaataaaacacacagggagaggtcctggatataataaatacctaagctaataattaatgaaattgatcattgtttccccagagcttcctttgtacttaaggcaaaaggataaatgtggtagattttgtaaggctcataatttggtatcagagagctgatttgttcatcaggaaagtgacttgttaaatgtcactaggaacaaaggggaaattcagcatgttttcatatcctagaactaagttattgttgtttttctctctgcaattatcccctagagctgaaaattgcaggtaagaattcaaaactcctacccttgttctgtcaaaatcctgttgtattacaatcatttgtgatgaataagcctgaaattgaaactatcaaacagaaaagccagcctgggtcagttttgtcagagctaatctgtattttaaattggaatcgtccaatgggagagacattttgcaaacacaaatgctgctgcgtgataccaaacagcacttttttctttcttcttcttcttcttctgaagatgctaaaagcccaaatgggaagcactccaagggctacagtgtcatacacagaatggcaacactgagaacaagttgactgtgatttttcttccttgtgaaaagtagccatgccagtggcaaggggatggggttagacaaggcaaaactactgatttccaggttgtctgtgttcccccagcccttagattctcaaggccctgagctctgacacatgtacattgagacaaaggcaggagcctcccagaacttgggagtaaagcaattctgcaagagggaagtataatgagtagcatagtatcactaccccctctccccaccaaatcacatccacccagaacctcagactgtgacattgtttagaaattgtgtccttgcagatgtaattagttaagctcttgagacaaaatcattctacatttagggtaggccctaaatccaatgattggtgtccttaagagaaggggtcacagagagacacacacagagaaggtcatgtgaagacgagagagatgggagtgatgctgtcataagccagggaatccctggagtaccagaagctaggaagaggcaaggaagggttctcctttagagcctccaaggagagcatggctgtgccaaccccttgatttgtcagacttctgccctccagaactgagagagaatgaaaatttccgtggttttaagtttgtggtactttgtgttacagcagccccaggaaataaattcaaaggaatcaacacacaaagaatgaaagcaaccttaaacaggggtaaccaacctaaaaaaaagtcaggaagtgggtgctgagcacaggtaagaagactaaatccaacgaaagatcctagtattaaactccaaagagtataaatctaatgtcatattgttattaaaattccattgaacattatttatttatttattttggagacagagtctcgctcggtcacccaggctgcagtgcagtggcacgatcttggctcgctgcaacctccgcctaccaggttgaagcgattctcatgcctcagcctcccaagtagctgggattacaggtatgcaccaccaattttttgtatttttagtagagacagggtcttgctatgttgcccagaccagtctcaaactcctggcctcaagtgatacgcacgcctcagcctccaaagtgctgggataacaggcatgaaccactgcacccagcctcacactgaatatttaatcctcacaagcaaccctatgagacagacattatgccatattgccagtgaaaaaaatgaggcccatggggttgagcaatgtgatggaggttggacaggtggtagttgtggagctgggatttgaactgtttgactgacataaatacctatactgttaacaacctcattatgctggagttcaagtgccttgtaccatataaatagcatgtcctactgacagaagaaaggaatgttcaggacagtgatttgcactgaatgtagaaaaaggatagtttaggacagtggtctctaaagagggctcggtactcaccatgagtgtagcaggcaatccactggctgtggggaaaatgacaacttctatttacatttatttataccttatcttttaaacattttccagaaggatatatttcataatgtactgaacaaattggtaaacaaatataaataagcatcttaataacaagaatacattatttttcatcagaacacattattagtctggtctagagaagaaggagtcattcatctctcaaatgtagtttggagactgtggtcagcaaaataatgacacccaaatatgtccatgtcctaatcttcagaaactgtgaatatgttctcttccatggcaaaagatattttgcaatgtcattaagctaaggatcttgtgatgagaagattatcctgggttatctggtgggtctcatgtaattacaagggtccttatgaggaggtggcaagaaagttagagaagaagtcagaggatgtgtgataaaggaagaagagatcacagagagagagagatatttgaagatgctatgctgctgactttgaggatgaaggaaggagtcacaagccaaggaatgcctctaggagctagaaaaagcaaagaaacaaattatcccctaacaaatccagtatgaatatagccctgccaacaccttgattttagagcttctacccttcacaactctgagataataaatttgtgtgttaagccagtaagtttgaggtcatttgttacagcagcaacaagaaactaatacagagacagtggttcctaagaccttccaaaagaacagttgttctgggacaggcacaagatatgaaaggaagattgacttttcatgttaacattttttgcatgctttgtactttttccatgagtgtgtatgatgtatcttaaattaattaaaatttaaacattaacaaaacaatcttaacattaactccacttttcctgggtccatggattcaccaaaccttctggttaatattagatgtttctataggatgagaatacatttacaggaggattacaggttagatctcttggcagctagaattcttactgtaagttagtaaattggctttctagcttgtattttggtctcttgagttcttggtaggcatgggcactctggtaaaatgaaattcctgtaacacttaaccttagatcttggagtattgccaagggcttgcccctcagccttcctcactgtggcatcctgggactctctgccatcactaagtatttatgtcaactttcctggctatgcgaccttggctaagatactttccttctctgagccatagtttcttcatctgaaaatattaatatttcaccaactgatctcctatatcctttttaacctttctaattctggatatcttttttcaaagaattttactgagaaaaattatcattacacagtattcttttaaaaggatataaaactacgcttagtatagggaatgagtatgcaaatacttaaaaatacatacagaaatacaattatgtattcttaaatatttgcatacttattccccaaagaaaactaaaaagaaacataaagactaaatacacctgctttcaagtagaaatatcaagacaattaaaattattcttcctagtaccattttaattttgtctaatttctaaattttctcaaatgtgacttttcaatggtaaaatattatttgtatcatgtgttcatcactggaaactccacgatgcttgaggcaagagcaaactcttggggtgtttatcatttccctgaagcagcgtcaaagcgaccttctatgtgaaactttgaagacaggtgttagaaacccagtaacccacagccaaaaaaggacaccctccagatctaaaagtactgacatggaaagctgcacaatagatatatactgcttgttttttaagtccaaagaatttttaacagtaagtacatataaaacccaacaaaggcctgcgagggttaatatactagttaattacattgtgccagtgtcagtttcctggattggacaatgttctatagttaggtaagatgtgatcattgggggacactggaggaatatataggagaacctcactgcactatttttgcaagttctcgtgagacgaaaattatttgaaaacaagcattaaagaaaacggtttaagggctgaatgcagtgactcacgcctgtaatcccagcactttgggaggccgaggcggatggatcacctgaggtcagttcaagaccagcctggccaacatggttaaaccctgtctctactaaaaatgcaaaaattagccaggcgtggtggtgggtgcctgtaatcccagctactccggaggttgaggcaagagaatggcttgagcctgggaggtgaaggttgcagtgagctgagatcgtgccactgcactccagcctgggcaaccgagtaagactctgtctcaaaaaaagaaaagaaaagaaaagaaaagaaaatggtttaaatatcagccatttcacattgttctatcgaatatatgaatggtatatagcagctttgtggtaaagatttcttgaatgaaactaatgaaatttaaagtgagtttaaaagaatatagaatgattttgaaaagaaaaaattgaaagtttttgtgaaaaacaataatctattgttatgaggaaaattaaaaagactgggcaagggtggtgactcatgcctgtaattctagcactttgggaggccaaggtggaagggtcgtttggggccacaactttgagaccagcctgggaaacatatcaagatgctctctctacaaaaaatttttgtaacaaattagccaggcattctaggctgcagtgagctatgactggttcactgcactacagcttgggcaacagagtgagatctcgccccccaacccccccccaaaaaaagctgaaaagtgaaaggatatagtccaaactgtaacagtgataatctctttatctgttcatgggtgagagtgttgttttgttttgttttgttttgttttgttttgttttgtttgagacagagtctcactctgtctcccagactggagtgcagtggtgcgatcttggctcactgcaacctccacctcccaggttcaagcgattctcctgcctcagtctcctgagtggctgggattacaggcccagctaatttttgtatttttggtagaaatatggtttcatcatgttggccaggctggtctcaaactcctgaccttgaggagctgtgatccacccaccttggcctcctaaagtggtgggattataggtgtgagccaccgtgcccggccctttctggccctttacggaaaaagtttgcagatccctattggtctactggtgcaaaaacaacccccatggtatcaaggaattaatttaattgtaagagccttcagaagttagggtaataatagacttccttttcaacatggctatgcttaccgtggtacaccagaacctgctttgtcacttaattagaactgtgctatgtgcagttctgaaatggcattacaattttagacaagaagatcttttaagaatccacttttaatatcatccccgttcccatcctattcatagaaacttgctttaaaattagcagagacttcctctttgaatacatttattgagctcttactatgtgccaggcacagttataagcactttgtataaattataattttttaaaaacctagagacagggtcttgttctgtcgcctaggcttaagtgcagtgtgcaatcagggctcactgcagcctcaacctcccaggctctggctcacggtatcctcccacctcacctctgcttcccaaatagctgggactacaagtgtgtgccaccacacctagctagtgtgtgtggttttttttgtttgtttgtttgttttgttttgttttgttttggtagagatggagttttgctatgttgaccaggctggtctcaaactcctgggctcaagtgatcctcccaagtcgttctcccaaagtgctgagattacaagtgtgagctaccatgcctggccaaattatcacatttaatgttcataaacccattttacagatggtaaactgaggctgaaagaagttacattgattgcccaaggtgacacaaacaaaggaaatttgaacccaactctgaatgactcaaaaaaaaatgttcttaacgaatctgacagaaaagaaaaaaagcatattataatcctacttgaaaacacaaattctcgaatgagtgagcttcgagccagaaatcaacggaaaagaagagcactctgtcttctcagtgggtgcattttaaaacagatatcacatatgttgactcatcattgaattcatagatgctgggactcatctgtcctatgtttaaaacaaaattagttctgaaataagtcaactcaaagatacaacttcaacgcaatcctagaattttagaagtgacaagtgcaagccttcagagaacagtttcttttctttcatgggtagcctcgggcttacgctgccccctgtggatcatgggcgatatggtcttaaaaaatccaaaagagcaaaagaatccaaaaatcacaatctgaatgtttaagagttgggagggatttgaaattgtctcctccaatttcttttttttttttaatttgtcaagagggaagctgaaatctagagagaaaagttcatttgcgcaagattttacagtaaataacaaaggaagggactacgtattttgctgacctctactcagaattcatattttctgacctttcccagcagcactaatacaaatccggaatttcaaaactccttttgaaagtggaagcacacatttattgaattcgcatgcttgcttcaaattctaaaggactttacatgtttttatacacttaaatgaatatatacactgaaatgaataaatcaacagagcattacatacatcagtcaggcgttccttagttccaagggaagaattgggtggggtccatgttggtaattttgaaagagaacagagagcaagttctgttggcacccaatgtggttcagaaagagaaagaaatggtgagatactgtcacatttcacgcagattaggtagatagaaggaaaccagggattctagaacaccattgttcaagaggcaccttggttctgaaccttggcctcaaccttccactagcaacaaaatctcatcaaccttgagacaccctagcaacaaaatctcatcaaccctgtgagagcctagagtcacctccttaggcttctgttctcatgtgccaatagctgagggtctcagtaaagcacagataagacctcattcctaatccttcatcactggactctcctctggagggcaatgtctagcactgggctttgcccacattagctgatcaataaatcttcaatgagaccaggcacggtagctcatgcttgtaatccagcgctttgggaggccgaggcggccagatctcttgaacgcaggagttcaagaccagcctgggcaacatagggagacaccatctctacaaaataaaaaaaaattagctgggcatggtggtgcatgactgtagtcccagctactcaggaggctgcggcaggaggatcgcttgagcccaagagataaaggctgcagtgagccatgatcacaccactgcactccagcctgagctgcagaacgagaccccatctcaaaaacagaaataaataaattaactaatcttgattgagggaggtgggaagatctgcatttgacctaaaacactcagaattattgataacaacaacaataataataaatggctaccatatactgagcacttactgcatgccaagtacaatgtgaagtacttctcatgttcttagttaattctcagaaaatgctcgtcagtagttcccattactgccctcatctcacagtgggaaacttgtggcctggagaggtcaggcaacttgctcaagttgcatagtaggaagggacagagcaaatcttggagccaggatcatttaacttcaaagcccaaactcctatcctctgggctctatggactttggaaaatgtggcaagatgagtgctggagagtgaatacaatgggaagagtggctcacgcctgtaatcccagcagtttgggaggccgaggtgggcagatcacctgaggtcaaaagttcaaaaccagcctggcccacatggtgaaaccccgtctctacaaaagtacaaaaaaaaaaagaaaaaaaaattagccaggcatgatggcgggtgcctgtaatcccagctactcaggaggttgaggtaggagaatcgcttgaacatgggaggcagaggttgcagtgagccgagatggcgcccttgccctccagcctgggtaagagagcgagactccgtctggaaaaaaaaaaaaaaaaaaaggaaatgaaaccccagtcctgtaccacctggatgggtacagtttttggaaaagagattctaataatcattattatcgatgattattattgtgagtacaatgtaagcatctgaaagtgcacaaagcactttcacatacattatctcattggagctttaatatgagtctatgagctaagtaaacttgggcagacttattgaaagaggaggaaatgaaagctctgaggggtccatatcttgcccaaggctgcatagctaataatgagagctagtgaatggtagggcaatgacatctgattccaggttccacttcttttcctctctaatatactgctgagtatcacagggttcaacagcccccagttacagatggtagatcttaccaaagggcgtttgtacctttatttattgacttgtttatagggcagaaaacagagagagagaccacactgcagaacacactgaggtttactcttttattctacccgctgtgaaatcagagacctctccagtgcctagaaacccctccctggctctgcatcagagagatgttttggcctacagaggggccacccagctcagtttgttagccatcaatgaggacctatctcggggctggctttgtgttctatttcaacagctcaccccttatttctttttcactctttgtttgtcttacatggacatacctcttttaaagcttggcaattctctttgatcttatttggttgacatttctgaaggtgagctgttagatgctagaattacatggattcaattccaatgttattaataaaaaattgtacagttggtagactagaatgctattgtgagaaaaaataataagaatccaattttgtctttttcctttatcccccagccgggctaccaactgattcaagtctgtgaacagcactgggcatgagagataaaacaaatctgttaatacctcatgaaagatgttgactttgaaatcaagtgcatccaatttctttcttcctaacaatggcattggtgagtacaaatgtggtttccttcattcctctgcctttctctgttccttctgctgaacttgcactgagaatggcaattcctcctacaacttttccatgcccttgatcagcgaaaggctcagaaaattgtcaggttctgacagggctcaattttatctttactttattaaaatagtgcaatgtagggcaatgagctctaatttgggagccagaagagactcctacctaaggacgagtgctcactcctctttaaactttttaaatgtctctgtgcctcaatttccttatttgtaaaataaggagagtgtactatactaggaattcctaactgccttcttgggaccagggctgtggcttcaaaagactcatctgaggtttgttaaacatatgatttcttgaccccactgccagaggttctcatctgcaagtcttgggtacactaaggagacctatatttttactaagttccctgtgattccagcacatgatcaggtctggaattcatggattagataatctccaagttcaaggtcttgcttccccagtcttctcccacctcctagaggtcaacacgagatctgattgttctcacaccttcatttgttctctcctcaccctcttctctcttatctccacgtctagatcaaacctacctctgccatgtttgactgcatcctcctatgccatgccagaatacatcttgctcgttcagcagctccttccttctctaccctgccttccctctaaatttcttgaaagaacgtcaaacattcatcctctagcaattgctcattttgggatttcatggagtccgcccacagagctcatactctctgttcacttcatggtgaccctgctgcagtacacagccacctctctaaatgcctcattccagaatttcctaatctttaactacagcctccctaggctttgccagcccagcttcctcggcccttgtgtgcttatgcatcccattctaattctggtgtcttcctgtctagctccttagctggcttaggagtagctccttagttggcttttcttcctccaccacaagctcccccagtgtactgctcctttgtggggagggagtctccctttgcacctcttcacctctctcttcatctcacacaatatctttaggtgattatacaggagcttccattatccctcctgtgctaatgaggcaagacaataaagtgtgtaagagctcaggttcaagcaccaaagagacctgggattcaaattctggacaattttttaacctcttcaagccttagtttttctcctttatcgtggaccttataatagaatctgcctcatagattcagacaattgctcacaatgagacaatgcactagacacgttgagccaagccttggcatataataagtactcagtaagtgtcatttatgagcaatgacctcccaaattatatccttagtcttgcactaccccttttgagagaatatacatgaaagtattggtatactggcaagtctttatttagcacttataatgtgaatcagtgtagtaattattttgaccagatataagtgccaattagcaaagacacccacccaagcatccatgagtcagcccagacccacactttcaactgcctgttagacacttctgaggcatttcaaactcaagatctcacacacaaacttaactcttcctcatggagctgctttaccagttaacccacacattgacccattctcccaactgcagagaattagccgtccttcattctccatttaggccaccaagtcttctgactcctaattgctaaatggctgttactccgtcccctctctattgttgttgctgctatcattctaatctagacactcatgcttcacctgaagtattgcaggagactccagccttactcccatctaatacatcttccacacccttgccacagcaatttttcctaaaacaactgaaaatgccattccctactcaaaaaacatgaaccctctccctctgcctctccgtcgtctccgtctcccgctttccacggtctccctctgttgccgaggctggactgtactgccgcgatctcggctcactgcaacctccctgcctgattctcctgcctcagcctgctgagtgcctgggattgcaggcgcgtgccgccaggcctgactggtttttgtattttttggtggagacggggtttcgccctgttggccgggctggtctccagctcctgacctcgagtgatctgcccgcctcggcctcccgaggtgccgggattgcagacggagtctcacttacacagtgctcaatgtcgcccaggctggagtgtagtggcgtgatctcggcttgctacaacctccacctcccagccgcctgccttggcctcccaaagtgctgagattgcagcctctgcccggccgccaccccatctaggaagtgaggagcgtctctgcctggccgcccatcgtctgggatgtgaggagcccctctgcccggccgcccagcctgggaagtgaggagcgcctcttcccggccgccgccccgtctaggaagtgaggagcatctctgcctggccgcccatcatctgggatgtagggagtgcctctgccccgccgccccgtctgggatgtgaggagcgcctctgcccggccgccccgtctgggaggtgaggagcatctctacccggccaccaccccatctgggaggtgaggagcgcctctgcccggctgccccgtatgagaagtgaggagcccctccgcccggcagccgccccgtctgggaagtgaggagagtctccacccggctgccccatctgggaggtagggggcacccccgcccggcagccgccccgtctgggaggtgtacccaacagctcattgagaaggggccatgatgacgatggcggttttgttgaacagaaaagggggaaatgtggggaaaagaaagagagatcagattgttactgtgtctgtgtagaaagaagtagacataggagactccattttgttctttactaagaaaaattcttctgccttgggatgctgttaatctataaccttacccccaagcccctgctctctgaaacatgtgctgtgtcaactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacatgtttatctgctgaccttctctccactattgtcctatgaccctgccaaatccccctctccgagaaacacccaagaatgatcaataaatactaaaaaaaattaaaaaaatgaacaattcctcatgactctgaaataaaatataaattctttagtcgatcatacaagccccttaagaacctagaccattaccagcttcctatctctatttttggattaaaccagactgttaaataatcaccaaagacatcatgcttgtattacatttctccgtctttgctcatgctgttcttccatcctgttggctcttccctccttaatagcattttctccttgaagaaccaattcaaaggtcaatgagtaaaatcagccctgaccctggtcctcattttcattttcacctcttccatctttgggccccagtgtgccttttcttacctctatctcaaagcagagctcactaaaggatggtttgttatgcacaagcctgtccatcccactaaagtgtgatccctttaaagaagaaggccatgacttactcatttttacatgtcctatgccacataaagtgcaaccaaatatattacctactgtcatatatctaaaccaaatgccagagttacaaggtacagatttaaaattccatgtgcaaccacatatccctctgagcatgccttaactccatggaaaggccagcttgttttggaccttgaagcttcaactggctttgcaaaataaaaagatacagtaatagaaaaaaatgtttctaaactcatccctaacccactcccccatattcttgtccctgggaccaagaaataactactgttaagtatcgcaaggaaagaaaaatgttgttattgtcagagcaatcttcatttttcccaatttgaatattgacagcaaagtcctcgtgtgtttttcagtgcattcaacttgaatttgtgctacagtttttgacttcctgctgattacaggtataatgattcatttggggcacaagaaaagtgaaacctcatatgtaaataaggaacctgccttcaagaaagctctgttgagaaacagtggctgcccatctgggaacaaagaccaactctgcacggggtcaggaccactggcctcttgccttagctctcttcctaactcactacaagccttctctcaattccctggccttctctgggtctcaatttcctatcttcttagtttcccagcattctacagacaagacttcccccctacatcccctggaagttcatagacacaagtttaaaatccctgaaatgcggatgtgagtcccagttctccctctgtctagctgtgtgaccttggataaatcattctacatctctgagccctatatctggcatccagagagtggagattagaatttgccacactaagtagggcttctttggttgatatctgcagaccagccacctaaaaattggaggagagcattgaactagaagacatgtacacagagttgctttgtaaaataaataacacaaacctggaagcattagaatggcaaactggaccacagctctttttcagctgtaacttgattctcaagcctaaattatagagtggagcctcaatagattgagcaacatgagaacaaaacaactgagaggcagttgaaaattaaagatattcacccacaggaataaaaccaataattgagagttctacatagccatctaaacagaggtcagtgaaaagctttcagaatctcagatttattctaatactgagaattactactatgagattgtaaaagcttttgtaacttctctgggtttgtgattttgtcactcctcagctgtttccctagtgtgattagtagtttaaaaaaatcataaaactggaaagtatctatatactgatcaggaacagccagttatttgggagctggcagaagtggcctcttgttaccctgctggactgcctgaaaatgaaggtttgtgatctggaatagcagcagagatgtaaagaaaagaaaaaaatagaagttcttcctaatgactattatttacaagccagtaattatgtactaggcatttttctcatgcattttctcacttaacagccctatacaataagtactaccgttatccccattttacattttgaggaaactgagattcagaaaaggatagaacaaataactcacctgagattctacaagaaaaacaaaaatctcacaaaatggcagaggtaggatataatcaggagcctttgcactccctgactcaactctttcaactcccacctaatgccacccaacaggctatgagaagaaaggactagaaagaaaggatagggatttgggatgttatagaggcagtgaacatgagcctgagatacaatcagtagggaacttaatcccagcccacctgattttatttaggaaatggcatagttatgtagctttttatgccctggctttggagtccctacccagtagagaggaggccttttgggagaaactgggggccatttcacacattcctgctaccaagcaagaaataaaattaatcccagctgggtgcagaggctcacacctgtaatcccagcactttgggaggccaaggcaggtggatcacaaggtcaggagtttgagaccagcctggccaatatggtgaaaccccgtctctactaaaaatacaaaaaaaaaaaaaaattagccaggtgtggtggtgggtgcctgtagtcccagttactcaggaggctgaggcaggaaaatcgcttgaacccaggaggcaaagcttgcagtgagccgagaccatgccactgcactccagcctgggtgacagaggtgagactctgtctcaaaaaaaaaaaaagaaataaagaaataaaattaatcccataggcgaaaagtatgatcagagttcctaggtatcttgaggtatgagtttgtatcactctaatagatttggggggagtgggacctatgtcatattttcatgtgagttgttactgttgttttatctgtttgtgcttgtacttgttactgaattatagctcctagccatttggggttttgtagaatatttagagaattgaatgaaagtcctggactttgccccagaaaaatgtgtgtgcacacatacatacaattatgcatatcatttcaggagggtcatgcccttcctgcaagaagctcatctacagatatcccccatccaggagtcctcagacacagtttaaaatctctaaaagctgggtatgactcctagctctcccgctgttcagctgtgtgatctttttttttttttttttttttttttttgagacggagtctcgttatttcccccaggctggagtacagtggcgcgatctcggctcactgcaagctccgcctcctgggttcacaccattctcctgcctcagcctcccaagtagctgggactacaggtgcccgccaccacgcctggctaattttttgtattttttagtagagacggggtttcactgtgttagccaggatggtctcgatctcctgatttcgtgatccgcccacctcggcctcccaaagtgctgggattacaggcttgagccactgtgcctggcctcccaaagtgctgggattacaggcttgagccactgtgcctggccagctgtgtgatcttaagacaagtcactctacatctctgagctccattctaggcagccataaagtggaggcaagaaattgctaccctgggtcatgctaattttagagaacaatgattgacaagaccctctttaaggatttaaatcagcccacaaccacagaagctttgccatcgaaaattacatgaaaaaatggagagggaattgtggattgttagccagagaaagaaaaacccacagaagcctgtaggccctctgaagtgggttggaagggttttcatgtgaatgaagatgtagtcttattctgtaagaggcaccagaggggagaccaggaggaagcagagtggcacggtgttagagtgatctggagttgaaaagacgtggttaaatccaggtcggccatttaccggacaagtttttaatcttcaagggctctaaaatggaggtgaggagataatggtacccatttcttaggaatgtggggacaatcaaaagagataatacatgcaacgtgcatggtgttaaaacaaggcagacctacaatggtaggtgttagcttccctaataaagtctctgaccctccatttctttacctataaaatgaggataatatctgtagctgcctaggaggttgttgtgagattcaaataagaaaattaatgcaaaaacgctgagcacagtacctaatgcataggtaaatcctcggtggatgttaaccacaattatcactatgaatgtttcattaccaaaaaaacagtgggaagagaggaagtagggagtgaaagaattttatttctatctgttttcatgtacccctaacaaaaaagcatgcgtgtaatgtttgtgtaatttaaaataaatgaatagtagttaaaagaatatgacttttaatttcagattagagaaccagataaaataaaatgatacctaaagagtgtagaatcagagctagacatcccagacctgacacctgagagctgtgtggccttgggagattttgataaaacaaaaatatgagcatctgctaacgagggattaaatgaagtggcccaggaagatggcttgacacagacctagaacataacacgtgcgcaataaaccctgcttttcatccctaatgactaaatgttccatagagactgactggccttcttacaccaagctcctcttcaccagagcagcaagtgttctctcttctgggatttggtcaaggaggagagaaatgaaaactataaagaagcttatggaaggtaaacatcacatgacctcttattcccttgtaattcaatgtaaaatagtccaagatttaaatggaataaaggatgatggtgttagaatgttctccctactttccatcacctttctagtcactgtcatctctttctttgtcagaaaatagtcccccacccttaccccatcccatagacaaagagggtttggatctttggcaccccatttcccttaaattatcaactcctaatccagattttctgttttcccactgtatgagttagtgcaggccaaagcgtcttaatatcagggccccctcgcatttcatcctaagttacagtcttacttcaaaacctatccccttccattcactcttgtctgtttcctccaactctgagcttttttttgtttgtttgttttgagacggagtctcactcgtcgcccaggctggagtgcagtggcacaatctcggctcactgcaagctccgcctcccaggttcacgccattctcctgcctcagcctctcgagtagctaggactacgggcgcccgccaccacgtccacctaatttttttgtatttttttttttttagtagagacggggtttcaccatgttagacaggatggtcttgatctcctgacctcgtgatccgcctgcctcggcctcccaaggtgctgtaattataggcatgagccaccgcgcctggcctcttctgaatttttgagagtgatgctacattgtctccttcacagaattaaatgatgcctgtttcctggctaataaacatatagaaaggaactcaaactctctgttaatcaggataagaaaagaacaagatgggccgggcaaggtggctcatgcctgcaaccccagcactttgggaggccgaggcaggtggatcacctgagcttaggagttcaagaccaaccagggcaacgtggtgaaaccccatctctactaaaatacaaaaaattagccaggcatggtggcatgtgcctgtagtcccagctactcagaaggctaaggcacgagaatcacttgagcccaggaggcagaggttgcagtgagcggagatcgcaccactgcactccaacttgggctacagagtgaggctctgtctcaaaaaaaaaataaaatagaaagaaagaaaaaagaaaagaacaagatgacattttcttctcataagattgaaaaagttaaacaaacagtcatatcaagtgtagggagaatatgggaaagcagatactctgtgggtggaaaaataaattggcacagccttttctgagaacatttttctacaagctattaaatttaaaggtgcacatttcttttaaccagcaatttttactttttggtcaccatcctaactacagaaacacttgcatgaatggttagggaggtatgcatgtgctaggatgttcactgcagcactgtttataaaaaggaaacattgaaacaacctaaatgcccctcaatagacaagaaatactgtgagtactcataatgtgaaatattacacagcaatttgacatgtatctacatagattaaagaagaaagtggtccaatatataacaataagtgaataaaacaaaatgcagaatgctgcatatagcatgataacattgtctaaagacatgcacaaaactgaactatgtatttctatagctatgtagacacataagggaatggaaaaaagacctagaatgatcatcttcaactaataacagttattatctcatggcagggggctgggattgaagacaaggagtgaaagagaattttatttctatctgtttctatgcactcctaacaaaaatgcattagtgtgacatttgtgtaatttaaaataaaaaaacaaaatttgaaatatgaataggtggttttcctactatcattcctggcataaggtcagcagttgctaaggaagaaggaagatttcaacagagggacttcagagatgagcagaggagaggagaagccagcactgatgcttgcagcatgttttgcttccactccagctggcgggaggatgtggtacgtggccacgaaggagccagaatagttgaatcccaagacaaccagatagatgacagattgtttccacatccaaagacaagccactcatgagaacacagccccaggccaggcaagctggctctagaactttgagaggccaaggcaggaggatcacttgaggccaagagatttgagaccagcctgggcaacatggtgagaactcatctctacaaaaaaaaaaaaaagcaagattctgtctaaaaaaaataataataataattaataaagtaaaataaaataaaaaaaatcacagcccccctacctccaggctgaggagaagacacagaatcactcgttttccacattgacacgtgggatgttgatgggagatcccaaactttggactctttggaaaaacaaaggaaaacagaaaacagacttaggtaaatgcttgtcttcctgcttttggtactcaactgtccctatactgacttctgtcattgaaaacaaaacaaaacaaaacaaagtatgtgccagacactgtcttaagtgacctacatgcattctgtcatttaatccttagaaaggtgtaaacacaggataggtgttattcccagtttaccagtgaggaaactaaggcccagagagattaggtagcttagctaaaatcacacagcaggaaagaggcaggatttgtgtttaggcaaagtgaagccggagcacccacataaatcactctatcatactgtgtccctgtgctgtactatcacaaacgctgacttacttaccttacagatgtctgttttcccttgctagattattagctccattatggtaacacctcccatgtgagtgcttacaaatgtgccaggcactcttctaagtcctcacatgcatgaagttatacaactctacaacaaacctaggaatataaactgagggcagggacccccagcaaaaaggaatagaactgggagtcaaccccaagtgctcctctctagcaccccaatcgtgatgccaatcgtgtcttatttcagggtataccccgtcccaggccccagtaactacctaaagaagttttgatgggtagatgacaggataaataatgaaagagtgaccaattctcgctccactctaaaaacccaatgcattgaattagtaaacccctcagcagtctcaacaaagaagatttgcgtgcatgaaatcagaatgagacagctaagtgctacttagcctagagtctaaaagcaaacatcctagagatgtaccatgagctactgcagagaattgcaccaatcaagaagggtcttccttttccctacctccctcctcctcctcctcctcctcctcctcctcctccttctctctctctctctctcagccacaagaaggaacaaactacaaaggctgccttgaggccaatttgccacagggggattttatggcacaaaagacccaaagaggttgtcagtcatctgattcagcaagacttttagtaatttccttctcctcagtacaaagggtgagggaggacagagagagtgagtgtctgcacacctttggatgtcagcaggacagtgtcagcagaagtagactcaacactactccaggaatcactggggaggacagtttctgattctggaagagaaaaaagttggataaaaggcagctgaaaagtagttattgtgtttgtggtgggtggtgggatttgggattatctttttttaattaattaattttttgaaacagagtcttgctctatcacccaggctggagtgcagtggcacaatctctgctcacttctgtctccacctcccagattcaagagattctcctgcctcagcctcccgagcagctgggattacaggtacccgccaccatgcctggctaattttgtatttttagtaagagatggggtttcaccatgttggctgggatggtctcaaacccctgaccttaagtgatccacctgctttggtctcccaaagtgctgaggttacaggcatgagccaccacacctggccactttttttttctaatttatctaattctttaaaagacagagtctcactatgttgtccaggctggaactgacttcttgggctcaagggatcctcctgcgtcaacctctgaagtagctgggattacaggctcacatcaccatgttccagggtatttttatggctgtctttgtgcttctttatatatttcaagttttcttcaaggattgcaagtaatttttagaatcaaggaatagaaactacaaatgttgtgttttatggtagttatttattttaaaacccaaaggaataaaaaaatacatacaagaattgattggtttagggttcatggattttaggtactattcagagtataatagaattagccaattcaattttgtaaagctattggaattttccaagacttattgaggcagctgaaatatctaagaaagccttcaagctatctcatgattgctttcccaattcttactgcagaatcagagtctgacatagagtgacagccttgacaagcccccctaagcaatggagcaagtcactcagtgagaggtacaagttgcagggtcaagaattccaggggaaaaaaaagaaacaaagaaaagaaacaaggctagaactagttcaccatcaggggatattttaaaggcgtctggaggtctttcctcaaccaatctctaatgctcaggcagcgacttaacccctgaaagaatggaactggagtctgaccaggagtgacctttcctggttcttcaataaacatctcttgcaagactccttagaggtcaattggagaacccaaaatgctgacttttcaaaaacactaaggaaaaggcagaagaaaagagaaaccataaaaaaagaaaaggaacaatttggtgaaaacacctcctcgtacacacacacacacacacacacacccatgcctactgtgaaggaataaattgtgtcccctcaaaattcatatgttgaagtgctaaccctcagtaccttggatgcaaatgtatattgagatagcgcctttaaagagatagttaaggtaaaatgaggtcatatcaatggaccctaatccaatacaactggtattcttacaagagattaggacatggaaggacaggcagagggaagacagccacctgcaagccaaggagagaggacttagaagaaaccaaccctgctgacaccttgacccaggacttgtagaacccagagcagtgcgaaaataaatttctgttgtttaagctacccagtctgcggtgtttgtttgataggcctagcagactaatatacgcatgtgtacacgcacacactcacacacacactgagagagagcaagtcactgggctgcctcattcagtgagacagcactgttctaagaaacccaagatacatctgcgtacctgcagtgaggatgggcccttccttagaaggctcgggagtcagaagacctgtggcttcctccggaagggtgcttggggttagtgaaaggcacgtgtttgctgttgtgaagacggcaatggttgtcatctggagtggtgttccggttgtgagatcgggtgtggtcacgactgttgttggaagtgcagctggggttgttgtcatttgtcgggtggtggtggggcttgttgttgttgttctgcgtgtggtggtggttgctgttctgtgcgtggttgttgaggctgtaaccaacaacagacatgtttggcaccaagcggagatggaggaaaaagaaaataatgcaagtatatctgggacccatccatttctgttgtcctcacctggtccactggcctggacgattgtaatgcccaataaaattgtgtttcctgcccccaccctgacatgttccttccaatctattcttcacacattggctacataatcatttaaaatgttggccaggtgcagtggttcacacctgtaatcccagcactttgggaggccgaggcgggtggatcatttgaggtcaggagtttgagaccagcctggtcaacatggtgaaaccctgcctctactaaaaatacaaaaattagctgggcctggtggtgtgtgcctgtaatcctagctactcaggaggctgaggcaggagaatcacttcaacctgggaggcagaggttgcagtgagctgagatagtgccactgcattccagcctgggcaacagagtaagactccatctcaaaaaaaaaaaaaaaagtcaaatataattatgtccatcccctgcctaaatcttttactgggtcctccttgcccttaagataaagaacccagtcctgcaccttggcctgcaagctacaagcctccatttgaccccatcttgcctttctttccaatctcatatctccacccgcccccgctatcactttttcccacccaactggcatttatttagctctttgaatatatcagcaaccttcccgctgcacgaacctttgtacctgctgcttcctattctcattcttcatgaggctgacttctacttcactctcatgtctcagctaaaggttacttctgcaaggaggccatgtagattctccaataatgattaggctttattatatgctctcatagtttacctccacagcctttattgcatttcataactgcacatttatttcattgctattgtttaaagcctgtttatcccgttaaactttaagcaccatgagggaaaatctgacatttattttgttctatgctacaaatccaataactatcacagtgtcttgcatatagtaggtgctccaaaaacattgcatgaatacataaatcagtgcatcaaaagtgagctcaaagtatgcaacctagagtgagaatgtggtctctttcagacagtaaagattggttcataccaacaccactcacctcctacatatctgatttgagcttcattagctaccgtttattcgacagatctcatcctccctagaatatgccaaatttccattgactctaatggaccagaaagacaccatttgttccaagtgaacttcgaaatgacctcataatatataaaggtcaagtattttataaaataatagctggttatacccaacttgaaaagagaagacttgagtgggagtcatctaacttcaataaacctcatttctctcttctgcaaaattggaatagcttttatctcagaatgttgccttaagagaaagacatactaatatgtatgtaagttcttaaattagaagcatttacatcagttggcctcaaattttagagtgcgttagagtcacctgaaaacttgagaatataggccgggtgtggtggctcatgcttgtaatcccagcactttgggaggccgaggtgggtggatcacttaaggtcaggagttcaagaccagcctggccaacatggtgaaatctcatctctactaaaaatacaaaattagctgggtgtggtgccaggcacctgtaatcccagctactcaggaggctgaggcaggagaatcgcttgaaccgggaagtagaggttgcagtgagatgaaattgtgccactgtactccagcctgggcaacaagagcaaaactctgtccaaaaaaaaaaaaaaaaaaaaaagagagagagagagaatatagatgtctagattcctgtcttccaaagtgcccatccagttaggaatagagcccaaggatcctccaggtgacactgatgcaggtggaatacagagctcattttgggaagctctatactggacaagccctaaaggtaattattgttagcattattcaaccatacgctcaatgcagctcaaatttttgaagtcccaccatatcccagatttcatcaaaagcaactgatagtaacagaagaaaaagctcctgaaaactgctatgactgtgtccaaatctcatgccctttctcccctgccagaagtggcaaactgttggtttactggttgaaggtgacccctgaatacattttatttagttcatgcagtttttttattattttgaaatctggcaacatgtaaaaaatcaacagagttcacataaaacttgataggtctgaaaacactggacccaaatatctgcaaggtggtaatcccctagatacgtagcagctgccttttcagattgaccctgcaattcacgagttccctttccaccttccactcatttctgtggctgcttttgtatttacttgcctacttcaaaccacggcactttatttcaaattcaatcttcccactcactgtgaaagcaactctaacctcttcaccaccatccactgatcccattgtccattaaccactgaatctctccttccgcaggcatgaggcccttcgtgtgcttacctctctgtagattcaggcgcacgtttatctttacatcgttgaaccagccaggcacttctatgcggcagcagtacacaccgctgtcactttcactggggtttaagatggtcaaggagacatcacctctcgggatagtcccctgaagtctatattttgctgactttcttgaggtcaccctcattccatcagtgcggatgagcgcctccttgcaaccggagtaggggcactggtctttcccccagcacatgctgttgctgttgtgagaccaggatgagtacagacagggcaaagtcacccggtgacccaaaacctccgtcacaacagtctctgaagtgactggtgctgcaaggaaaaatgcgaaatttaggtcatgcagtactgaaatctctcaaacatgctacacagtttttgtgctaatagatgcttccaggaagatgaagaaagctgtagtctatgtttcttttctttcctttttttttttgatacagggtcttgctttgtcacccaggctggagtgcagtggtacaatcatggctcactacagcctcaacctcccagactcaatccatcctcccacctcagccttctgagtagctgggaccacaggtgcgtggcagcattcccagctaatttttgtgttgcttttgtacagacagggtttcccatgttgccaggcttatgtggttctttagcgtaagttttgatgtgccttgcttactcctgtgctcctaactccacatgattctatcccctaagtggaaccaggtgaccagttgagtctctaaccgtggcaagacctttttgctgatttaaatactctgatttgagttccattcgctaaccaataaactcttacatgaaaaatcctgaccttgaaacccaatttcacttattcatataatcaggtgggctgttttccacaaatagatattgtggactacagacttaaaagcttcaaatggctgggcatggtggctcacgcctgtaatcccagtactttgggaggccgaggcaggcggatcacaaggtcaggagatcgagaccatcctggctaacacagtgaaaccccgtctctactaaaaatacaaaaaattagccgggcgtggtggcaggcgcctatggtcccagctactcaggaggctgaggcaggagaatggcatgtaccagggaggcagagcttgcagtgagccgagatcatgccactgcactccagcctgggcaacaaagtgagactccatctcaaaaaaaaaaaagcttcaaatgggtctcccaatccagagagtgctatgagagaaagataggctgtaaaactgtattccatttccttctctcctttcagtggaaattactagaattggaaattacttagactatttgtttgctgttagataatatgaagttaggtggagttcatggactatctatttatttttaatggacaaataataattgtatatatttataggatacaatgtgatgttctgatatacatatacatcgtagaaagattcaatcaagctaattaacatatccatcgccttaccaacttaacaaacttttgtggcaagaacattaaaaatctattagcaattttgaaatatacaacacatgattaattactgtggtcaccatgcagtgcaatagatcagtacaacttagtccttcagtctaactgaaactttgtaccttttaatcaacatctcccctttcactatcccacccactcacccaccccccagcctctggtaaccacctttatactgtttctatgggattaacttttttagattctgcatataagtgagatcttctatttgtctttctatgcctcgcttatttcactttgcagcatgtattttttgttaacgttagagctagaaggaaccacaggaattatctaaaatggcagctgtgccataaaaaaaaaatgctggagggtaaggtttactgcatcagctacttgagatggaatgtttctccctttctaaaatgaagcatgagtgtgttttaaccacttctcctcattagcatgacctagggagcttgttaaaaatacatagttcattgcccaaacctgagcctgaatccctaaggccaaggccagtgcatatgtacttgaatcaagttctccaggccactttgatgtagttgactacccatccagtgtttgagaaccactagacaagctcctctaagattcctttcatctctgacaatctgcaaaacattttcactgttaaaaatgttaagcccattggtttaattgtgcatcagagattattctaaaccatttccttccccaaaaatgctattgaagtgaaagccaggcaggctgtagatctcagattgttgagaccacaccctgctcccccttgggtacccaggtccatgcttgttgttttctcttaggcaccctcctgtgagattctccattcactaactttgcttatttagttggctaagttatagaaggcatggccagcagtgctgtgctcctccttgactcagctggcagtaacatccaggcattcctctctctaggagaaggtggacatgagccctaagagtcacccatatggtaagcaagactatgtgcttctggggtttttcacagttggctttttttttttttttaaagacagtctcattctgtcgcctaggctgaagcacagtggcgcgatctcagctcactgcaacctctggttgttcttatgataaaagatgattcccaatttggaccagcctgcagccttccccgaatttagtctcttcactttgccaagtggaaatgtttcccagattataaatgaagtgggaggctgggcacagtggcttatgcctgtaatcccagcactttaggaggcagaggctggcagatcacctgaggtcaggagttcaagaccagcctggccaacatggtaaaaccccatatctacaaaaatacaaaaattagctgggcatgatggtgggtgcctgtaatcccagctacttgggaggctgaggcaggagaatcgctggaacccaggaggcggaggttgcagtgaggcgagattgtgccattgcactccagcctgggtgacagagcgagagtctatctcaaaaaaaaaaaagaaaaaagaaaaagaaaaaagtcaatgcagtgggaagtccattttgcctcccatgaatccaggagaaaaataagaagtttattgtcatcaccctcagctatgttaacaacatagaacacatgcacctaaaattaataactactaaaatatgaacttagccaagtgtggtggcacatgcctacagtcccagctactcaggaggctgaggcaggaggatggcttgaacccaggagtttgaggctgcagtgagctatgatcatatcactggactccagcctgggcaacaaagcaagactgcctcaaattcaagaaagaaaaaagaaaaaatagatgatcttgttcctatgaatatttggtaaattaataaaacatgtacaagaagtattccactggagagtcaacattttattttcccaagtacttttgcataaaaggaggcatcctaattgctaaataagaaaagatctggccgggcgcggtggctcacacctgtaatcccagcactttgggaggcggaggcaggcagatcatgaagttaggagttcgagaccagcctggccaacatagtgaaagcccgtatctactaaaaatacaaaaatcagctgggcgtggttgtgggcgcctgtaatcccagctacttgggaggctgaggcaggagaatcgtttgaacccgggaggcagaggttgcagttagccaagatcacaccattgcactccagcctcggcagggtgagggaggacagggcaagactctgtgaaagaaagagagaaagaaagaaagaaggaaaggaaaggaaaggaaaggaaaggaaaggaaaggaaaggaaaggaaaggaaaggaaaggaaaggaaaggaaaggaaaggatccaatagagaaactagcagaggacataatagacaattcgtagataaggaaataggagcagccaataaattttacccattagactgggaaaagcttagaacactgataatattgagtaatggccaaggtgtgagtaaacaggactccaagacacttgtgggaagggacttaggaaatgacttagcctcctgagataaaccagagtgaaatggggatatgaattgttatagccacactgtgaggaaatttggcagtttctattaagtattcactacccaagagtcctagtatgccttagcaatttcacgtttgttatccaccctagaaaaacacaagttgacaaagatgcctatttgcaaatgtttattgcagcctccatgtatatgtgaatgaaatggacaatgtatatatggggaatggctaaactggtgcatatttattccatggaattctatgtagattgatagcattagagatagatctgagtgaattgacaggaagactccaagccatttaatgatgaaaagggcaaatttcaaaacaagacataaaatataaaacccttcttgtaaaataaataaataaaacaatttcctttgtttttgtgggctcagacttttgaaagtaaatgcacagaaaagtgtctagtgggatagacaccaaactcattgtgtcagttacccccaggatcagagaaaagggattggaattggggatagcagtccaaagggcatttggctttataacattttaattttttcaccaggagtgtttcgtgtcactcatcttattaaaaattaatataagaaaaggaagcaggtgctgagtatggcaggaacaacatccattaagctcacattgtaaaccccattctgccatttactgcttttgtgttgttggaggaaagccatgataatcctgacctcattatcatcacaaggcaaaggggataatactcacctcagaaatggttctgagctccacttgaagaggagtaacaaatgccacgtgaaattaacaaagtattaatacgcgtaacaaaggacattagaatttagaaataagacaaaaaaaaatggttcctgtctgttgtaaaagtatccctgagtaaagcaattgttggtatcaaaccagtttcacttctgtggagctacctggaatggtggatacaacctaggtccttatgccagcttggttccttccatagctggtgagcttaagcaaggctggcccttccccaatctgagtctcaaaattgccatctacagagtgaagggcatcttttaagagtacatccagctctgatccttggtgattctgagcagtcactctcttttaatttggttatcttagaaaaggcacatataggccgggtgtggtggctcacacctgtaatcccagcactttgggaggctgatacaggtggatcacctgaggtcaggagttcaagaccagcctggccaaatatggtgaaaccctgtctctactaaaaaatacaaaaaattagccagctgtggtggcgggcgcctgcaatctcagctacttgggaggctggggcaggagaattgcttgagcctgggaggcagaagttgcagtgagccgagattgcaccattgcactccagcctgggcattggagtgagactctgtctcgaaaaaacccaaaaatattttgaaaaacaaaagaaaaaagaaaaggcacctatgaaaaaaaaaacaaaataaaacaaaaaacagctcaccaggtgctgcctccttcaagcaggattagaaaattcccctcaaccagtgtcttgctagtagcaggacatgtagacatagacccctgcaactttcaacctaacaaaaccttccaaacttcaagtttccaggataagacaaagacagtaaaaaaaaattgatgaaaaggcagatggtagctttcttacatccaaacaaacccataccaaacccaaaatataagtgtgaaagtgacagggactgctttcattctgtagattgtttttttcttccccctttttttttttttttttttcagaaagagtctcactctgtcacccaggctggagtgcagtggtgcaatctcggctcactgcaacctctgcctctctagttcaagcgattctcctgcctcagcctcctgagtagctgggattacaggcacatgtcaccacgcctggctaatttttatatttttagtagagacggggtttcaccatgttggccaggctggtcacaaattcctgacctcgggtgatccaccaacctcggcctcccaaaatgccaggattataggcatgagccaccacccctggcctgtagattgtttcttcagtgcctataatgtatcaagggtggaactaggtgctggaatataacaagccacaaagcagacctgggctgccctcatggggcctgcagagtacctaggaagatagtcaaatgagtgagcatttgctatagagtgacaagtttacagatgcaggaactccaaggaggatgcgaactcatagcagaaacacctgaactattccagaggctacaaggtagccaggaaaagcctgaattaagtagggacctgaggatgcatggcactacggaggaaagaaaggcagagagaatagtacaagtttgagaggtgatgaaacacatttgttttccttcaaatatgggtgttttctcatgcaccatgttggaaaggtttctgcacatacaaagagccaagaggtagaagaaaaaatgtttaacattgctaatcactggggaaatgcaaatccaaaccacaatgaggtatcacttcatttctgataaaatggctactatcaaaaagacaaaaagcaagcattgctggcgaggacgcaaagaaagaggaactctcgtacgctgttggtgggaatgtaaattactacagccattatgggaaacagtatggtgattccttaaaaaactaaaaatagaattaccatatgatccaacaatcccactactggggatatatcccaaagaaaggaaatcaattaaagagatatttactctcccatgtttattacagcactatgcacgatagccaagatatagaagcaacctacgtgtccatcaatggatgaatggataaagaaaatgtggtatatggccaggtgcggtgactcacgcctataagcccagcactttgggaggccgaggtgagtggatcgcctgaggtcaggagttcaagaccagcctgaccaatatggtgaaaccccgtctctactaaaaatacaaaaattagccaggcatggtggcaggcgcccatagtcccagctacttgggaggctgaggcaggagaatggcgtggacccaggaggcagagcttgcagtgagccgagatagagatagtgccactgcagtccggcctaggcaaaagagcgagactccgtctcaaaaaaaaaaaaaaaaaaaaaaaaaaaagaaagaaaaaaaaaaagaaaatgtggtatataaacacagtagaatattcagccataaaaaaagaatgaaactcagtcatttgcaacaacatggatggaaacagagtttattaatattgtgttaagttaagctaggcacagaaagacaaatattgcatgttcccactcatacatgagagctaaaaaagttgatctcatgaaagtggagaatagaatgatagtcactggagtctacaaaggataggggaaaaggggtatgaagaaaggcaggttaatgggtacaaaaatacagttagttagaacatgaggaaaaagggaaaaaatacaattaaatagaaggaataagtcctagtgtttgatagcatagtggggtgcctattgttattaataatttcttgtgtatttcaaaataactagaagagaacatttgaaatgttctcagcacaaagaaatttaaatgtttcaagaaatgaatatcccaactaccctgattcgatcattgtacattgtatgtatatatcaaaataacacatatgtagcccataaatatgtatagttattttgtatccatttaaaaaaaaaatggacttttgtaaaactgcaagggccattcaatattatcttgtcctagaagcacagattgtgacaactggtcatttaaaaagccaggtctctcatttcaaatatgggagagccagagcaatttagacatattcccagtgtcaacagttagtgcccgagacgcagctgcagctcaggccagaacacttggctctataccaccaggatgcaaagaacttcactggccaaaactgagtgtgtacacttgcatcatccaaaacccaaaaacaacgtgcagaaaagaaaccttacataaagcctcaccccagcaaaacaaaacaaaaagcaaacacttctaaaaacagagggaatgataagaattatcacaattctcaccagaacaaattctcctggcttattgattatatgaataacacccatagaggaaatctcttttccccaatttatctgaccacttatttctgtgtctcttcttcagttgctgtttccaatataagcccaaattaccccagcctaaaacccccagaccagtctctggataaacctctgtgtaacaaggcaggacagagaccctccacagaaggaagcctggtagggagaggggagggatgcagaaatgaagtgagcttctgcttcactgaggcccaaaccagtgcatggaaatccatcacacaatagcaagtcctctggaaacttctacatagaaggtttcagaacacttactcaggtaaagccaccaaaactcaatcatcagccagagaatgagaggttctttggacattttgacggttgaccggacccaggagtctgtctatctatccaaagcccaacctcttatatcccagttaatgctgacagggtgggactctttagtttcatttctctttttgcctcataatcttccctttctcctgtcctacatggcttcccccaatgggcgatgcatgatgaaatgtgctgagcccttttctcctggtgactagtgtgtgtgtggagggatggcgtggacatacttgtgcttctttgtccatgtgtatagtgggtttcctatatgtgcacaagcatccatgcatgtgctggtgcaaatatgcctgtataacctgtgcatgtgccacagttgtcccaactgctgtacagcctgtcacaaagtgcaattgactctccatactggcaagtgtttacatgtagattcctcatggggccaaagcatagttagactgaaagttgcctccattcccattctaggttctccctcaccctgtcccctggcctccttgccctaataatggagaaagaaaagtgaggacaggcacagtggctcacacctgtaatcctagcacttagggaggccgagatgggaggatcgcttgaggccaggagtttgagaccagcctgatcaacatggcgaaaccccatctcaattttttatttaaaaaaaagtttaataaaaaaattaaatttttttttaagttttaggaagacactgaagcccagaacttcctgattccaaagcttatggttaatcactacattgtcctttgacctgtgaccgtttgggtaatgtatccatatgatgaggcctacctgtggctagctcctacttagtaccaggaagaaaatataagaattcacaaatgttctagatttttaaaaatccttaattgattgtaaacagccagcaaacctcaaacattcaacattgcttctactgaaggtatcagtgaaaaatctaaatatcaggtgaggttctagacccagagaagccagactaacatgagcagggatgaaaataacgggattcagagtgaatcttcccactgaatgcccacagaaccaagggatcctttccccattctatcccaggaaactggaggatttaatctctggataaactaagtggtcccaataaaacattttcagatatttatagttttgagtgttccccaacaaaaccactcaaccctccttcaataagttcatcagtgcatgagcctcagccatgcatgcagaactgttaatgagtctttagtgtccctttcagatatgaacagataaccagggatcatcagacatttgaggaaagcatttaacataaaaaagagacaaaaataacagggagagctaaagagaacttcaaaaactttttaaaaagctaatattttctcagaaagaaagattttacattcatgaaaaagaacatagacattataaaaatgtcccgaattttatggaagttttgaaaaataaagttaagaaaatttgttagaaattataaccatctacaaagtcaaaggactaggattgtttcagaacattaaaaaagaaaatagaggagaggaaattactaaagaaataataaaggaaagactctcgtaactaaaggagatgactctcagtattgagcgggtcaatcaaatgctaaactcaatgaataaaaatatccccaaaaagcaagacattatcatgtaatatgagaacatcagacataaagaaaagatacgaaaagactccagagagaaagaacaacatattgcactgaatggatttggaaatagaatggcattgttgttccaaacaacaaagctagaaaataatgcacgaatgccttcaaaattcagagggaaggccgagtgtggtggctcacatctgtaatcccagcattttaagaggccaaagtgggtggatcacttgagtccaggagttccagaatagcctgggcaacatggtaaaaacctgtatcagccgggcgtggcggctcacgcctgtaatcccagcactttgggaggccaagacgggcagatcatttgaggtcaggagttcaagacaagtcccagcaacatggcaaaactggtcgctactaaaaatacaaaaattagctgggtgtggtggtgcatgcctgtaatcctagctacttgggaggctgaggcaggagaatcacttgaacccaggaggcagatgttgcagtgagctgagatcatgctactgcactccagcctgggtgacagaaggagactccatcaaaaaaaaaaaaaaaaagaggaaaagaaaatctatatctgccaaaaatacaaaaaattggccgagtgtggtgatgcgcacctgtggtcctagctactccagaggctgaggtgggaggattgcttgagcccgggaggtgaaggttgtagtgagctgagattgtgccactgcactccagcctggaaaacagacagagaacctgtgtccaaaaaaaaaaaaaaaaatccagaggagaaatttaatttcaacctagaatcctactcgcagacaatctatttctcaaatgtaagatcataataaaggcctttttggacatagattcaaaatttacttactatacttcctttcctagaagttatggaagagaaatctgtagcaaaacgggagaaataaccaggaaacagaaagtcatggggtccagaaaacatgacatctaactccagggaagaaaaatttcacaaagaaaactgcagaacagacctagaggggaactgtttcactgcatcacaaaccaccccaaaacctagtgcctgaacaatgtcaatgtacttttcatgattccctgggatgacagtgttcagctgggtagctctcacccagtgacagtggctatctcaagactagattggactatttgtccaagataactttctcactcacatgactgatcatccaaaatgacacttctagctggacttgtatgtctagcaaattaatagaatgactagaagagataggggctggactgacaactgtctctctccacatgacctttctacatggaagcttgggcttccttacagtatggtggtctcagagtagttggattttttacataggatctggctttctcaaaaattagcattccaacatgctcaggaataatccacaaaggttcttatgacctagccttaggtaacattcagtatcatttttacagtattttattggtcaaaaggcaaattataaggccatcccagagaattcaagtggagggagcaatacaaggatgtgaatgcgaggaagtgtggttcattggagtggtaggggaagcatctttggagaataattactttaataaccacctcaggctggggcagaagagcagaggaataagccttggggtggtggtagtgagtgtcacgaataagctcatgtacttaggtaatttgaaaataactttgataggtgtttggcagatatgatggaatacttgggatgaatttttttttttttttttttgagacagggtcttgctctgttgcccagaccggagtgcactggtatgaacatggcttagtaaagcctcaacctccaggctcaagcaatcctgttgccccagtctcccaagtagctggaaccacaggtgtgcctccacacccagctaatttgtttaaatttttgtagaggcagggtcttgccatgttgcccaggctggtctcaaactcctggtctcaagtgatcctcccatctcagcctcccaaagtgctgggattataggcatgagccactgcccacagccatgggatgaatttttgatggatacttgggaaattaagaaaaaaacacaatgaaggctgggtgcagtggctcacgcctgtaatcccagcactttgggaggcagaggcagttggatcacttgaggtcaggagttccagaccagcctggccaacatggagaaaccccatctctaccaaaaatacaaaaagttgctgagtgcagtggcacatgcctgtaatcccagttacttgggaggctgaggtgggagaatcccttgaaccagggaggtggtggttgcagtgagtcaagatcatgccactgcactccagctggggtgacagagcgagactccgtctcaaaataacaaacaaacaaacaaacaaacaaaaaatgagataattattacaaccaggaaagataaaattttgtacgagaaaagaaatgtaattatggtgcatttgctaagtgtgaaagatattaatagttacatgctggtaataatgtaaaatctggctactggcttaatacaccatttttatttttatttatttatttttttgacacagggtctcactctgtcacccaagctggagtgcagtggtgcgatcttggctcactgcatggaatacttcggataaatctctgcctccagggtgcaagtgattcatgcctcagcctcccaagtagctgagattacagtcatgcaccacaatgcccggctaatttttgtatttttagtagagatgggatttcaccatgttggccaggctggtcttgaactcctggcctcaagtggtctgcctgcctcagcctcccaaagtgctgggattacagaaatgagccactgtgccccaacttaacacatattttgatttgactacactggaaaaattggtagagaggaagcggggtgggggtgtaagaaagccaaagtctattcacctttacagggagtcaacaaatagtgtctcaaattggtcaatcagacaataccagcataaacacgctgtgagtaatatgaaggtaaaaaccagaagaacaagctcaaaagagtttaatgcaaaaaagtgggaaagaaattcactatttttttagttataaaccttttacaacttgactattaaaaatgcatatattgaggccgggtatggtggctcatgcctgtaatcccagtactttgggaggccgaggtaggcagatcacttggggccaggagtttgagaccagcctggccaacatggcaaaaccctgtctctactaaaaatacaaaaattagctgggtgtggtggtgtgagcctgtaatcccagccactcgggaaactgaggctggaggatctcttgaacccgggaggcggaggttgcagtaagctgagatcgcaccactgcactccagcctgggcaacagagggagatcatctcaaaataaataaataagtaaataataaaataaaataaaatggctatattgagcatacctagcacccacatcttaatttctaattccatcctcccataaaaagaaccagggcttcttggagaaatggctgactctagtactgaggtgaaaaacatacggactgaacctggaacatcctgcaatgtcagtaagtaacagcaagaaagtgcttaaaaaaaaaaaaaaaaaaggaaaattaaaaaagaatcccacaataatgagattattttaaagagcaaaggagattatcaaaagagcttccaaaaagctttggctccacctcaaagctggaacaacctgagcaacaaaataaatagaagaatactggattataatccaaagtataaaataaatatctgagtccatactgacagaagtaaattatgactccataaataagtaggggagaatagacaaatcttctccccagaagcattataaataatttatgtagatactccccactcaaggagataaagcctaactccccactctttcagtgtgggtttgacctactgacttctttcaaaaaaatacaatggggagtggcggggcaggagtagctttacagtagagaaaactgacaaatactacctcaggcgcctgttgatcaagatcaacatcaacaatcagttgagttgataatatgtacccttgacatgatgtaatataagggtcactttatctctatggacttcctcctcaaaacccatgacactgacatgaagaaaacaggcaaagtgaggtggttcacacctgtaatcccagcactttgggaggctgaggtgggaggatcacttgagctcaggagttcaagaccagcctggccaacatagtgagacattgtctctatttttgaaagataaattaaataaataaataaataataaacttaatgtagtatcccaggtgggatcttggcacaggtaaaggccattagctaaaaagtaagaaaatataaataaagtatggattttagataataataatgtaccaatcctgattcatttatatgatttgatttgattgttattattattttttgagacagagtcttgctctgttgcccaggctggagtgcagtggcatgatctcggctcactgcaacttctgcctcctgggttcaagcgattcttctgcctcagcctcccaagtagctgggattacaggcacctgccaccacacccgacgaattgtttgtattttaagtagagacagggtttcaccacattggccaggctggtcttgaactcctgacctcaagcaatccacccaccttggcctctcaaagtgctaggattacaggcatgagccacagcgccgggccggttcattaattttaataaatatatcacactaatataagatgttaataataggggaaacaggtgtatggtacataagaactctgttgtattatctttgatttttctgcaaatctgaaactgctttaaaataaaattcattttttaaaatgcacatattcctttgttttaagagtgtaaatgttaaaagtaatctagtatctggaggggtcaaacaccggaaaaagagactaaacttggttgtctcttcctaagttagattccatgatcaagtttcagaatattcacaaacatcctaatatttgatgctcagtttttattaaagcatattattgacagagtccaaagcagtgctggatatttcatgtttttgccaccttcattctctgcatttggaggtttgcctctggagaaccggacttccctcattctcagtcaatgcagttcaggtggcgttgatttcattcatgggcacaattggctcaaggataggcaattgactcaaatgaagtcaaggatacacaatcttgagatgtttattgtgacttttaacagatagagaccctctctattttcctgtggtctgagctgtgaggaagtgagctggaagctaatgtcagcagtcttgccaccaacgaggaaagcctacctcacaagagaaccaatcaagcagaaggcaagtgaggaactaaagcaagtctaggtctatgacatgagtggaatccctgaaacaaggcacatcaatgaggcaatacatttccttctgggcttaagtcaatttgcattgggtttgcagtcatttggaatcttaattctgaaaaaaacaaaaacaaaaaaaccctctgcaaagcgagaatttggctggatgattttaaagtttttcctattttaagagtttaggactgggcaccctggctcacacctgtaatcccagcactttgagaggccgaggcaggtgaattgcttgagctcatgagtttgaggcaagcctgggcaaaatggtgaaacctcatctccacaaaaaatacaacaaatagccaggtgtggtggcatgtgcctgtagtccaagctacttgggaggctgaggcatgagaattacttgaacccgggaggcaaaggttgcagtgagccgagatcatgccactgcactccagcctgggcaacagagcaagaccctgtctcaaaaaataaataaatgaataagtaatacaagagtttatactattatctggtccaaccacctgcttcatcaaacatctgattcacctcaaccttttaatcattcagcaagtgcctgtcaacctattatgcttagacatgtgagaattctgttaggccctgagaataaagacaaataaggcatagattttacctttacagacctgacagttccaaacctttaaacaaagaagggattatcagaccccattttacaataaaggcatgacgccagagaagataaaagactcttatgtaatgggatgaaaatagaatccaggtttttctggataaagagtcctttatagtaccaatactttctttctggtaaatggcattattaaataaaatcccattcgttcatttttattcattcgtttcttcatcatctatagcaagggtcagcaaattaaggcccatggaccaaatatagcccaatgcccatatttgtaaataaacttttattgcaacactgtcacttccattttttagcatatggctgctttcacactacaataatagagttcaataattgcaacagatatcatatggtccacaaacccaacaatatttgctatctagtcctaacagaaaatgtttgccaacccattgagttcatgttatgtgtaggcactgtgctaagccctgagactgtcatatcagatgagtcattcttgccttcaataaactcacaacctaggcgctagggaaatggaaaaggaatgaacattcactaagctgtggctatgtgctaaacactctgctaggtcttgttcacatgtaatcccagcaacaaaccctcaaaggaggtattatatttggcactatacgtacaaggaaagagggattggaagacattgaaaacttaactcgaaatatagcttttactgcctagtatattcgagctgatatcaggacaagaatagagattcactcaaatcaccccgaggaggaggttactcatgacaagggcacaggcaatctggaatcagcacctcattaggaaacatcaaggtgttacttctgctcttctctggggtatctctttctgtccctctctgaacctctcccctgaccagctttctcataaggtcagctttctcatggtccttattatacaccctagccccaaatcctctaagtaaccctcaacccagctctctgagctcactcactcattctttctattctaaatgccagattcctgagggagaacttgagcccctctggttcgcattttccaaggtaagcctcagattgttttccactggctgcctctgtgactggctaccctgagatcagccttaccctggagaagaaagatcccaccgtgcagaatgctaccattccatttgcagtttcagcaattgggctgtggatggagtatggttgctcagaagtggctgggtttggtaggcaatgactaacaaatctagtacaaatagaaattttttatgagtctgttgccaaaacaatcatttaagtcacttaggaatccagtcaactggaaggaacagaaagtccaattcacagaagcctaaacatataaggagcttgttttttctctcataaaaagaagcctggatgtagacagcccaaggaatcaaaaatatcatcaaggagccagactcttctctttctgttcctccatactggtttgtcacaccctggtcacaggagggctgaggtacttctggacatcaagttcatgtttgggaagggcaaaggggagacagaaaggctttcacattgttagtctttgactttttatttgggaagagaagcccttctcagcagacttgacttatccagaactaagccaccagcttacccccaaatctattgcatgaggtggctatgactggtttatttatttatttttattttttatttttccataagttattggggtacaggtggtatttggttacatgagtaagttctttagtggtgatctgtgagattttggtgcacccatcacccaagcagtacacactgcaccatatttgtagtcttttatcccttaccctcctcccactcttccccacaagtcctccccaaagtccactctaccattcttatgcctttgcatcctcatagcttagctcccacatatcagtgagaacatacgatgttcggtttcccattcctgagttacttcacttagaataatagtctccactctcatccaggtcactgcaaatgctgttaactcattcctttttatagctacatagtattccacaccacagtttctttatctgctcattgattgatgggcatttgggttggttccaagattttgcaattgtgaattgtgt

SEQ ID NO: 1326 - DNA, 92414 bp, Homo sapiens
tttgggtgtggctgacagttgcagccaccctcaggtctgcgggggtgggtgtgttgcccctgaactgcaatagcagaatttctccctagcctggcaggggagtgcaatcgtggacttgcttttccacccgctggggttgcatttcataggtgccgagtgcctggggggcccaggccttttcacatgagggttttcagcccagatgtccctcctgctctaggggaacccttcacatcagtcaggtgacttgctggactggtagagcctctgccatcagcctctgatgcaaaaccttttctcaggtgtctgtgcggtccatggagacccgagttcccaggtttgggagggatgccactttccttaggaagaacagcaatgtatgtcgtccttcccatccatgcagatgggacagggctctcaggaaatctgccattagcatcgccctagaagatgcacaggcagaggcagctgctgggcacaggcacttggggaagacaggagccatgacgccacgccacctgttggtacccaaaggaagtggctcttttggctgcttggcaccattcttatgacccttccattttgtttctagtctcagaaggggtggagaaagtcatccttcctaaatggtgttgactctcagacatctgaccgtgccaggagaatggctgtgcaaggcggcagcccaggcccgggcaggtggcggccaggagttgggaccacagagggcactagcaagagcagcagctgctccgagatgctttggcacaagtcaggatacgtattttgtagttttctcttgttttttatttttctgaggtggagtctcactctgtcgcccaggctggagtgcagtggtgcaatctcagctcactgcaagctccgcctcccgggttcaagcgattatcgtgtctcggcctccagagtagctgggatcacaggtgcacgccaccacacccagctgatttttgtatttttagtagagatggggtttcgccatgtttggtcttgaactcttggcctcaggtgatctgcccccctcagcctcccagagtgcaaggattacaggcgtgagccaccgcaccccacctcccggccttttctcttgtttcattttggtaaactaaattagtttaatacctctaccccatcggtggttggaattccccacctcaatcattttgggggctctctgcctcctttgaataggacagatctccaggggtttacccaggctccgaagagccactccaggcagccggctgtttggggaggtgcaccctggtcttctagtctgcggattccctgcatcgctcccctggtactgctctcaagctcaagggtcacctcagccagatgtgccctaggctggcagaggtccttcccctaaatgcagctgggcaggatgccaccctttctacaataagttcggtcccagggattcccccaacacacacacacatacattctctcttactcacatcctcacacacactcacacaccccaccacactcacacactttcaaaatccaccgactctcacgctcacactcgccagccctttcccttgctctgtcacttccctccaagtccccgccccacacagcctcctgcagtcccagcccccttggtgccagccatctctggtgccagccatctcccccaaatatccacccttctgggctcctttctgcccagagggacctgaagtttccctaggaagcacttgctaaaggcctccagtctccaactcctggggaagaaggatccaggcctctgccgcacaaagcctccactgttctcttggggctggcaccccttcctgtggccctgtggcaccaaacaaattgattcatccagcgaatatttcttatttactctgttccacatggtggtgagtgaatcaaccctggactctccccacaaaggacttaagaacacgcaggtcatgaacaaatgaacacttttgcataatttttatgaccaacggtgaccaggccaagagcaggatgaggtgatggagaataccttggcctggggcatcggaggaaactcttgcgaggatgtgctacctccgttgaaagtgggaagatgagagaccggctgtaagaggagcaagggaaggaggttctggaatgagagaacagcacgaacaaaatgcccgagacaggagcgagcttggcaccttcaagaaaataaagaggagaatcactgaacctggcacgtggaggttgcaatgagctgagatcgcgccactgcactccagcctgcgagacagagcgagactccatctcaaaaaaaaaaaaaaaaaaaaaaaggaaagaaaaggaggccattgggatggctgaggctggaagggtggaccaggtgccccacaggcaagaggtcccaactatagatgaagcacgcaggctacagacaggtgagtggtgcctcgggtgagaggcaagtttgtctccataggtcatcctgctacacggaattctccagaatcccctgcaaaggtgtagatgggctgggtgcagtagctcatgcctctaatcccagcactttgggaggtcgagtcgggcggatcaccttgaggtcagaagttcaagaccagcctgactaacatggtgaaaccctgtctcaactagaatacaaaaattagctgggcatggtggcatttgcctgtagtcccatctactcaggaggctgaggcaggagaattgcttgaacccgggaggtggaggttgcagtgagccgagatcgcgccaccgcactccagccttggtgacagagcgagactctgtctcaaaaaaaaaaaaaaaaaaaaaggtgtagatggcttatgctttgtgattttcaatgtgacttgtttttatttttttccaaatctataggtcttttattgaatcatctaaatatcacagatacttaggtctgaggagtcatccaacatcgtgtttctgtagctggacaactcttagaacctcctcagcagcctgcggaactgttcctttttaggagacgtagacagcaccccaacattttctgatatccttgtttttaactattgctgcttgctgaatcagagcagctgaatttgaacaagactgaaacaagctcaatgtcgcttccttcaaagattaattcgacattctgggcttgagatactgaataagcaacacctggcctcatccgaaccctgcagatggattttccacccaagatgtttcagatttcaacgagagtcccgttctcctggataacgacgtttctggggaagtgagcacccacagaggtcatcttgtaatggaacccagggcaacccctttgaccatgctccgtacacgactatgaacagtcccaacggcagccggctcccttcagtttccccaccgtttgtcaacccggagcctcttttcctttccaaggagactgagttctacattgatgtgattgaagtctctcctcaaggctgtgtgcagtggctcacacctgtaatcccaacactttgggaggcagaggcaggcggatcacttgaggccaggagtttgagagcagcctggccaacatggtgaaaccatgtctctactaaaaatacaaaaattagccaggcgtggtggcacatgcctgtagtctcagctactagggaggctgaggcaggaaaattgcttgaacccaggaggcggaggttgcagtgagccaagatcgcaccactgcactccagcctgggcgacagggcaagaccctgtctcaaaaaaataaaataaataaataaataaataaataaataaagtccttcctcagggttcctctcaggcccttcccaataactgtgtgttcctttagagtaatgttgaccttttctggaatatccatgggttggttgctgggaacggtcttcattctcacagtagatgcggcaaagacagcagttttacttttttaatataacttccaggcatcttaaccttggaattttgaacatactaggacgtgtctttccatgaatattgtaaattgtcaggctggtctaacaaggcggttttggaattccactttgggaggtgtaggaagaataactttagagcggaccaaccctcagacactgctggtaggcatgtaaaatggtgcagtcactgcagaaaacaggacagtgcttcctccaaaagcgaaacataggactactatacatactatctatacatactatataaactgtatatatacactatgtatacagtatagacatagtatatatgtctacactatatacatagtatatacacatagtatatacacatagtatatatacatagtatatacccagtatatatacatagtatatacacagtatatatacatagtatatacacagtatatatacatagtatatacatatagatatacgtatatactatgtatgtagatatagatactatctatatatatattatgcttccagacttaattattgcaatacaattttttgtgtactattatgtataattatattgtaattttattatttatttatttttgagacggagtcttgctctgtcacccagtctggagtgcagtggtgccatctcagctcactgcaacctctgtctcccggattcaagggattcttctgcctcagcctcccgagtagctattacaggtgtcgcgccaccatgcccggctagttttttgtatttttagtagagatgcgatttcaccatgttggccaggctggtcttgaacccctgacctcaggtgatccaccctccttggcccctcaaagtgctgggattccaggcgtgagccaccgcgcctggactgtattgcaataattatacataatactacatatatacaaatatacataatattgtgtatatacatatatactgtatatatagatatataaatatatagtagtttagatatatgtatgctgaatcagagaagctgaatttgaaacaagcttaatgtcctttccttcaaagattaatgttgtattaatgtaggttaatgttgaatatacatatatggctctatatatctatagtagatatatatctacatatatctatagtgtatagatatctatatacatatactaagtgtgtgtgtatatatacgccaattaaaagcagggacacagatatttgcacacccatgttcatagccacattcttcacaatagccaaaaggcggaagcaacccaagtgtctactgatggatgaatggataaacaaaatgtaatagatgcacacaatggaatattagccatgaaaaagaaggaagcatggatccatgctataataccaatggaccttgaagacgtgcaaagtgagctggacataacataggtggaatcatgcaggatgatagaatatttagaataggaaaatccatagagacagaaagtagactagaggttaccaggggctaggaggaggaggacgggggttattgcatcatggttacagagtttctgggtggtggtgaaaaagttttggaaatagtggtgatggccataaaaacattgtaagtgtaattaactgaattgtacacttaaaaatggttagaaggtggccaggagcggtggctcatgcctgtaatcccagcactttgggaggctgagagggcagatcatgaggtcaagagatcgagatcatcctggccaacatggtgaaaccccgtgtctactaaaaatacaaaacttagctgggtgtggtggcaggtgcctgtagtcccagctactcgggaggctgtggcatgagaatcgcttgaaccccagagtggagattgcagtaagccaagattgtgccactgcactccagcctgggtgacagagcgagactgtctcaaaaaaaaaaaaaagaaaaaaaatctatagtcacagcaaattgcctatcataaaattgatgctagtaaaatattgtaattccactgtttggatttaattattttttaaagttagatcaggtaaaaatatccattaaaaattaggagggaaaagatactgctactgtgtgtcctataactaggctcaagttcttccatcagctccaaagtattttatttttatttatttatttttttgagatcgagtctcgctctgccacccaggctggaatacagtggctccatcttggctcattgcaacctccacctctggggttcaagtgattcttctggctcggcctcccaagtggctgggattacaggcaggagtcaccgcacccggccagctccaaagttctttaaccagtcctggtggctccccagctccaccaccaggctccatgtcccttcagattggatcttgcagggtctcttgctgcttttccatcatgggtgcacacatctctgttgatgggttgaggctgacctcacctgtccccatgcatttttcttccacagggtaaacaagactgagaggaaataatggtgtctagttgtgtccctaacaatgtcgttaccccatatgtgagtctacaaactgattttttctttttcttttttttttgagacagagtcttgctctgttgcccaggctggagtgcagtggtgcgatctcagctcaccgcaatctctgctgcctgggttcaagcaattctcctgcctcagcctcctgagtagctgggactacaggcgtgcaccagcatgcccagttaatttttttgttttgttttgttttgcttttgagatggagtctcgctctgtcgcccaggctggagcgcaatggcatgatctcggctcactgcaacctccgcctcccgggttcaagcgattctgtatcagcctcccgagtacctgggattacaggcgcccaccactgtacctggctaatttttgtatttttagtagagacggggtttcaccaccttggccagggtggttttgaacgcctgacctcaggtgatctgcctgcctcggcctcccaaagtgctgggattacaggtgtgagccaccgtgccaggcctaatttttgtatttttagtagacacgggatttcgccattttggccaggctggtctcgaactcctgaactcaggtgatcctcccgccttgccctcccaaagtgctgggattacaggtgtaagccatggcgcccggcctacaaactaatcttaaatcgttttcaaagatcagcaaaacatggataattgttgaaaacagatcatagacacatggagttggtcataccattctctgcatttttgtatatgttttaaattttccataatgactttaagtttgacttaaatgcataaatatatgaaaagggtataaatcacctggcgtgctgcttactaaaactccaaatgtgggctgcaaatgccaagtaagttcatttgtatgaaatggaaagttttgatattattattatagtataccactcaaccattttccctacatatttggacatacagaagaaataatccaaatatttctgcagtagatattaagtggatcacatttaatgtgacattggagcaaacttcagatgtcgtaagtttgttcttgctttttgggcagtaactgcacacagtaggaaacacgattcttctggctgcccctggaataacagattctgcacaacagtgtgcacatgggccagggggcagctaactgttcaaatacaccattgaagaatgtccatggctgggtgcagtggctcaggcctgtaatcccagcactttgggaggccgaggcgggcggatcacaaggtcaggagatcgagaccatcctggctaacatggtgaaacctcgtctgtactaaacatacaaaaaattagccaggcgtggtggcaggtgcctgtagtcccagctacttgggaggctgaggcaggagaatggtgtgaacccgggaggtggaggttgcagtgagccgagatcgcgccactgcactccagcctgggcgacagatcaagactctgtctcaaaaaaaataaaattaaattaaaaaaaatttcatatggtgaagtattatgagacttttgattgaagtttgaattatgatgggaacatctttctcagcacaaggatagggtgggggcagggagaaacaacctggagaataagagagacccgggaggccaagcactgtggcttaccggaggccaacgtgggcagatcacttgaggccaggggtgtgagaccagcctagccaacacggtgaaaccccgcctctactaaaaatgcaagaatttgccgggcatggtggtgcccacctgtaatctcagctactctcgaggcagaggttgcgttgagctgagatcacaccgctgcactccagactgggcaatgaggcgagactctgtctgaaaaaaaaaaaaaaacaaaaaaaaagaaaagaaaagaaagaaagaagggggagcttcaatagttatttaaaaaaagagagagagagagagacctaggagttagatcaaccaactgcaatggatggatcttatttgggtcttgattcaaacccataaaccacgcaaaagcatctatgagacagtcagagatgttagaacactgactggatatttgatgacattgatgaattctaagtaagtttttgacatgtgataaagctattttggattttgtcgttgttgttgtttgagacaggatctcactctgtcacccagattggagtgcagtggtgcgatctcagctcactgcaacctccacctcctgggctcaagtgatcctcccacctcagccccccgagtagctgggactacaggcatgcaccaccacacccagctaatctttgtattttttgtagagttggggtttctccatgttgtccaggctggtcttgaactcctgggctcaagcaatccgcccaccttggcctcccaaagtgctaggactataggtgagccaccgtacctggcctggaaaaaggttttaaaagtagtttttattttttggctgggcacggtggctcacgcctgtcatcccagcactttgggaggcccaggcgggcggatcacaaggtcaggagttcgagaccagcctgaccaacatggtgaaaccctgtctctttttgtatttttgtaaaaatacaaaaattagctgggcgttgtggcggacacctgtaatcccagctactcaggaggttgagacaagagaatcacttgaacccaggaggcagaggttgcagtgagccaagatcatgccattgcactccagcctgggtaacagagcgagactccgtctgaaaaaaaaaaaaagtagtttttattttttaaacatatgtgtactggaatatttataaatgagactgcttcatgcctggaattttttcttccaaataatttcgtgaatggtgggtgaagactgagtgtaggtctaaagctggccatgaagccctcagtgtcgaagctgtgagacgggtgcatggctctgcgtgtctctataataaaaagccagaggtatgtgttgaatgaaggggaccctctcctacacttctgccccttcatccacctaaggaaaccacatttgcttttacctgtcccatctctgctgccccgtctctgccactgcatcgcacttttcttttcttttttctttttttttttttttgagacagggtctcactctcttgcccaggctggaatgcagtggtgcaattatagctcactgcaacctctgcctccgaggttcaagtaatcctcctatctcagccttttgaatagctgggaccacaggtacatgccaccacgcctattttttgcagagacagggttttgcgaagttggccaggctagtctcgaactcctgggcacaaacaatccacccgccttggcctcccaaagtgctgggatgacaggcgtgagccaccacacctggtctgcatcccatatttgactcagagctcactggccttgtttctctggaggacacagggcgccccctcccgccggacaggagaggctccttgcagaggctgattcccattcttgagctaggaagtggccgttctgaacatcggatacagccacacggagagagcccacgttctctttgataatactgtttattgtccacggaccgagcgattgctcaagaatgatacaaagcatcagagacatgcgcagtctgcttgtcaactttcaacaactcttgtgtgttcccagcaccggaaggtctcagacttcatattccagcataaacacagtgctcccctcccccaaaaatccaaacggaaacaaaatcaacagagctttaaattacggcagcaagtccaatatttcttaatacttatcaagcaaagatttgaaaataactacaatgtaaactttattttaaatattttgagttgcttgcaggatgaaaataggagaagagagctgtgcttagaacataacatataaattaaacgatgccaaatggagagccttcttaaactatatatatattgccactatttattgtgaaggtatttgagcggcttcctctgtcagctgccacccggctcttcttaacctgttttgttttctgctcagcacggttaaaagaccaacgtgtgtggatcaaatataaaggccacacctttcagaccgaacctactcaaagatcctttactttgcaataatttgaactggagaaccaaagacgggagacgaatgaaagcaaagatgctcaaagaaccaaaggaaagacctgaaggaatccacctgcataggccacgcgttccactctgggtcaaatgcttccacgatgcagaaacctttttttaaaaaagtgcaagtctaatacctaccaagggtaataaaaaacacagcacaggaatgattacagctgatgtcaaaaacaaaccaaaacattaaaaaaacaatcagcagaaacaggagtaaatgttacatatgatatcaccatacaggaagcgaacaggggtggggtgttatatgggttggaggggtctggtggagttgtatatactgaaatcacatggactggtccattatgacatcttaccaactttaggtcactgtacagcatgaaaacgcccgtggggcaggggccgattcctggataccctcccagtctgccctagaaagggaagtcatcaagatctgtgctgaccaggtcccggtgggcatgggggctgcatgccacttgggggtcaggagtcttaacaggtgctttggggttgccgctgaatagaacaggctaaggtggctttggaagcattttgcaagaccacgcccaggccgccaagcttcggtttcattgcgtgtgtatgtttacataatgtgcctgtatatcgtcagtttatctttacaacacaggtgggaggaaacaagagattctccttatcattaccgagaaagttcttcctatcctaacccccatatcactggcttcaggaaaccacactgagggaacacataggttccctagttccctaggaagtttcttagctaggtaatctttgtcatttaagaaatacaagcagaagttggtatatctgcaactcaggttcacctatcatctgagaattcacctttagaaaaataagatgtctcttaaaacaggccatagtgtcctggaggctgagaaagaagtgagtgtgtcaccaaagccacctacctccaaaatccttcccttcctaggctggacttcttactatgcttagctggcgtcacatgcagaaagccccgtgcagaacgatggctgtcagtctttgagggagggaacactaagcctgggagggcacagcaagacccagctttttctgtcctcaggatgtgcagatggggagcccagccgggccctgcacacaagcccggataaagcaaagctgtgcaactcaatccaggtgcctgatgccagaacaggcaagaagcaatggcaaccgcagcagctagggaagggaccttgagggcagccaccggccccggacagcagcctcaggacaggacctcaccgattcctcctgcaagctggggagcatgtgggcgggggggggggggtgggggggtgggtgcagaccaaaaagactcagctgaggctggaacgcagctcagctggggtttctcgctcccatttctacaaggctcagagggaggctcccactggaattctgaggattaataggattgatggggctccttcaagaactagccactggttccaggctgcccttggatgtggggggagtcaggtgctgggagctcatggtgggcaccggggcgatgggagcacttgccaggggcagggagtgcagaggcgtggaagctgcagaaaacaagggccatgtccctctcaagatgaaagggacctggtaggcctgctacacagtcttgcaacgaccctcaaaagtttctgcaaaatgcacatttccaggccctgccctaacccagctgggagatccctaagtgctgcctgcttggcatctgtgacggtgccaaggcagggactgggagggaagccgcgtgtcccagccctgcctgcacccaaggatcgaagccccagacacatagtgcctggcagagggaggatgggatgaggaccttggacccacgtctccctccagacccacaaccatgtctaaaaggagaaggggggagcagaatcatattaatttggacccatgggatgagtgttttattcatgctgtttccaggaagggatgtcagagctggaccagtcgaaacccttggaggctttttttgcagttggccacaggggcgttggaggcctgcttatgggtcctcgatgtcgagaaactcctgcttggggggcgccgcgccgcggtaccacgcacaggagccgtcacttctcttgatgcaggcgaagaacttggcctggtgcccgttgatgttcttctctgtgacccagtccatccagaggcactcgtccggggaggagatgtagcacgggatcatggggcagcgcgtgatctggggaggggcacacggagggggacggagtcagggacccaggaaggggtgggcagaggctgctctgggggcatgtccagaacccggcaatgtgcctacctgtcatgtgcagggatggcagcctctcccgagacccacggttcctgcaggggcaggcagctggcctgcgagggggtctaacctgcagggaagctgtgccctgcccaccgctgccccccctcctactgcaggtgtgcttccctttgggccatcttctaccttcctgagcatgacagaatggcctcagcttggccctgccctctgggggacacagcaacaataaaagggcctgggtttcctggagacagattccagcccagtgttgctcgcaagccgagccccgaggtcatcggcaactagcaatttggccaaggaaccctaggctacaagaggatgaccgccttcaccaccgtggaaagaaaaaggaaaaacttgcttttgatttcatgctgggcacagaggagtttcgcttaacatacgtgtggctggagactatgagttcagaattcctgttttgaacatgcggagaaggggctgggggccgtcaggagggagggcagccccaggcagctccccagggaaggccaatccccacagcctcaccagagtctcctggtcccagactcactgggagtgacccagggtgggaggtgcccagcactcagccatgcttcctgcagggagggtggggatagggtgctaggagcccacagggtaggagccagcctgggagccctggaggcggtaatctcaccttccacagccacatctaggcgctgcactgctccagctgtgcctggcacaacctccgggctcattttaagaggagcaggtgttcaggtattctcaacacacagaccccacatagacaccaacccaggtgtgaaaatgtcgggaatgttggaaacagcgtaaggcctgcagtgccttctcataagccacacaggcgtttgcacttgcacatttgtagaaaattctccatgggaccatattctctctccccatacagctcctttttctggaagctacaggtaacagagctgaattcatgctcttactctcaaatctcctagccttccagacatctccctcttttttttttgggacagagtctcactctgtcaacccaggctggggtgcagtggtgtgatctcaactcactgcaacctccacctcccacattcaagcaattcttaagcctcatcctcccaagttgctgggatcacaggcgtgcaccacctcacctggctaatttttgtatttttgtagagacagggtttcgccatgttggtgaggctgatttccaactcccgacctcaagtgacccacctatctcggcctcccaaagtgccgggattacaggcgtgagccgcagcgcccggcctccagacatcccctgtcagagatgtgcctcagggctctccagggaccaggggtcaaaggctctgtccccagccagacagccttactcttgggatgactctaccttcccagagcctggtcttagatcaggagccggggattaacgggtcctggaaagccagggatcaaaatccctgccgtccatctggagacactgggaggaggcgatgctccagcagaggcaggacctgcttaccttgcactcgcagcccatctggtacctgtggttcaggctcttcttctgggtggtgctcagggtgtcccagggcacgatgaagtcacagagggtgatgtgcatcttgccgtccccctcggcctttcctgcggagagacggggatcaccgagctcagggagagggaaaagtcctcctcctgcccagctcctccacccggcgcaggggcgctgggatttcgttgcaacaatcctgtgcactgtctattctgagttaaaacacagtgggtggccaggcacggtggctcactcctgtaatcccagcactttgggaggctgaggcgggtggatctcttgaggccaggagttcaagaccagcctggccaacgtgatgaaaccccctctctactaaaatacaaaaaattagccgggtgtggtgtcacacgcctgtaatcccagctacttgggaggctgaggcaggagaatcgctcttgcaccccagaggcggaagttgcagtgagccgagatcgcgccactgaactccagcctgggtgacacagcaagactccgtctcaaaaaaataaaaagtggaaaaaaaaagaaagccataatgcatgttcactgacagaaacttaaacattggaaacaaagaaaaaacttcctggccaggggcggtggctcatgcctgtaatcccagcactttgggaggccgcggcaggtggatcacaaggtcaggagatcgagaccatcctggctaacacggtgaaacccccgtctctactaaaaatacaaaaaattagccaggcgtgctggcgggcacctgtagtcccagctactcaggaggctgaggtaggagaatggcgtgaacccgggaggcggaggttgcagtgagccgagttggtgccactgcactccagcctgggcctgggcgacagagcgagactcagtctaaaaaaaaaaaagaaaagaaaaaaattccctactttcattacccacagctaatattttgatgtatttccttccaatattccactattgattttgagacagtcttgctctgtcgctcaggccagagtgcaatggtatgatcatagctcactgcagccttgacctcccaagctcaagcgatcctcccgtctcagtctcctgaatagctgggactataggtgtgaaccactacaccctgctaattttttatatttttttttgtagaaacagggtcttgctatgttactcaggctggtcttaaacttctgcgctcaagcaatacccccactttggcctcccaaagtgttaggattataggcatgagccaccacgcctggccccaatattcttttaaattaaattttattctaaaaaaaggatagagacgatgtttcaccatgttgcccaggctggtcttgaactgagcttaagtgatcctcccaccttgacttcccaaagtgctgggattacaggtgtgagccactgcgcccggccaatattctcttctatgtgcatcttcacacataaaacgtcatgcagtatgtagattatattgtttcctgttttgtttttcacaaaatattaattcacaggtgcttctcccatttgagtttaaacttataattctgcatttttccattatgaagagccaaagcatggaatttttgaaaattaggaatctgctctgaattcccttcatcaggcatgatgagctgtggcttctttctgtacttccggctcctgactcagctgcctccttcctttgctgaagatactacattggcaatagccttggcgttttacaagcaggaggaaaagaacaaagcagtgtgttccagtggctgacagaacctaatgacagctatggaagtcatttaaaaactcatccctcaggccaggtgcgatggctcatgcctgtaatcctagcactttgggaggctgaggtgggcggatcacttgaggtcaggagttcgagaccagcctggccaacatggcgaaaccccgtctctactaaaaatacaaaaagaaatagccaggcgtggtgatgcatgcctgtaatcccagctactcaggagactgaggcaggaggatcgcttgaacccgggaggtggaggttgcagtgagccgagattgcaaactgcactccagcctgggcgacagagacagactccatctcaaaaaagaaaataaataaaaaataaataaaataaaaactaatctttcaggcagggcatggtggctcatggctgtaatcccagtactttgggaggctgaggtagggacatcactcgaggtcaggcatttgcgactagtctggccaacatggtgaaaccccgtctctactacacatacaaaaattagctgggcatggtcgtgggtacctgtaatcccagctactcgggaggctgaggcaggagaatcgcttgaacccagtgggcagaggttacagcgagaagaggtcatgccactacattccagcctcagtgacaagagcaaaactccatctcaaataaatacataaaataaaaaaaatacaaaaaattagccgggtgtggtggcgggtgcctgtagtcccagctactcaggaggctgaggcaggagaatcacttgaacccaggaggtggaggttgcagtgagtcaagatcaagccactgcactccagcctgggtgacagagtaagactctgtcttcaaaacaaaaaaaacaaaaacaaaaacaaaaaaaacctcatccctcctgctacaacagccccttgtgaagagacacaggtgtcagtgatgagcacccacgcctggcagagactgatgggcaattccttgagaagcagacagagcctcaggctgtgccctaagcacttttgtttgacaaagtttcagcgcatctgacttaatgatctcaggcacagcaccagcctcagaggatccactaatagaaacacagcccagcgaaggactaatgcagctcatcgactgcacccctgtgccatggaaatgtggatggcttgcctggggctccaagcagacacaagtggcctccattgtcctgggcacggggcactcattgtgccagctccctgggtttgaattcttatgctcgcacttcctgttctagctgttcctttatcttcgggtccttttctccgtttagacttatgtgacattccaggtgaggaacaggatgagaaagtagaattactcctgtaacatttattccaaatcctataacttcataaggtaaatgtttgggtggccttaaacaattcaaaactagctgggcatggtggctcacacctgtaatcccagcactttaggaggccagggtgggcagatcacttgaggtcaggagttcgagaccaacctggccaacacggtgaaaccccgtctctactaaaaatataagaattagctgggggtggtggtgcatgcctgtaatcccagctactcaggaggctgaggcaggagaatcgcttgaacccgggaggtggaagttacaaagagccaagatcgcgccattgcactccagcctgggcaacagagcaagactccgtctcaaaaaaaaaaaaaatcaaaattagatatataactttccccactagacctatagctattttctgtgagttcagaatagatcaggaaggagcaaaacagacagatggaaaggaacccattcctgtatcctggttgattctggcatttggcgcccatacaggtataccgcagccccttccctgtccagcctgggcacctgccactacagacaggctgaagctctatcctggcttcccagcttctatggtgatttccactgtatgtatcacttgaccagcattaactcccactttctattagatttgcctttcttctgcatctcgctccttaatcagagagtacgtatagagagtaagggctgtgtcttaacccttttgtttccacagttccctgcacatagtaattgctcaataagtttactgatgagacacacccgtgcttgttctaatgatatgcttcacattctgccttttcctgccatcttctcttttggccttttaccaccaattctggcttcctcaggaggtaagcaatggcaggaagaagagatgaagtgaaaattgtattttttcttttttttttttttggagacggagtcttgctctgtcaccgaggctggagtgcagcggtgccatctcgactcactggaacctctgcctcccaggttcaagcattctcctgccttagcctcccaaaaaattgggattacaggtatgcgccaccacccatggctaatctttgtattttttagtagagacacggtttcaccatgttggctgggctggtcttgaactcctgacttcaagtgatccactgcgcccagccaaaaaattgtatcttttcaatggtcctagttattgggctaacatgaacgtggctgtcatgtataaatgtgaagagaggaccgcctctggtctgattaagacttggttgggtgtacacaccgtgagcatctgcagcgatgttctacttatgtctgtctccgagaaaagcgaggcatgagtctgggttacagaaaaccgggaattaaaatttgtaacgaagggttgtatgtttatttttccttttggagaagaggaatgtagaagaaaattacagggccaactctgtatgagtctcctggtgcccgactcgacacgtgagactgagtcatcggtccaggaggaggtggcccgctcaggccatgcggtcactcactggccacagccagccagagctgagtggttcactgtgccctgtgatttctggttagcccctggataaagggtctatcctgactcgaggcaaactggatctaggttcctgcctcgggaaataaatgccagattcaatgtggagtcatctgaccaaggctgggaaagaagtcagatgagagaggttcctctcgccatgaggtgagtcagccactgtggccattaacagcttcacccctgctccccctcccagggagaggaggatgaagtaatgcagcctcattggtggagaagatacacagccagctggccactgggcaggtctcacaatctttgttgatttttagaaacaggaagtccatgtgcagatttgttacatgggtatattgtgtgtccctgaggtttggcatatgaacggatccatcgcccaggtagtgggcatagcgcccaataggtagaattttttcagcccttatcctgcttcctccctcccacctccttgtattccccagtgtctcttgttcacatttttatgaccatgtgtacccaatgtttagctcccacttttaagtgagaacatgtggtatttggttttctgtttttgcactagttcccttaggataatggtttccagctgcactcatgtggctgcaaaggacatgatttccctccttttcacggctgcgtagtattccgtagtatatatacaccacatttctttatccaagtcaccattgatgagcacttgggttgattctgtgtctttgctattgcagatagtgcggtaatgaacatacgggcgcagtgccgttgaacgatttattttcctttgggtatacacccagcagtgggattgctgggtcaaatgctagttgctttctcagttctttgagaaatctacaaagtgtgccccacagtgggtgaactcgtttacattcccaccaacagcgcataagcgttcctaagcgttccctttactccatagccttgccaacattggtttatttttattttttatttattttttttgggtggggggacagtcttgctctgtcgcccaggctagagtgcagtggcacaatcttggctcactgcaacttccgcctcccgggttcaagtgattctcctgccccagcctcccaagtagctgggactgcaggcgcccgccaccatgcctggctaattttttgtatttttagtagagacgggatttcactgtgttagccaggatggtctcaatctcctgacctcatgatccactcgcctcagcctctcaaagtgctgggatcacaggcgtcagccactgcgctgggctgtttttaactttttaactaaagctcttcaaaatctttcaatgtcagctttctaccgaggatcccgccacaggtccagggagcaatgccctttcagcagagccttcacgctcattctgctacaggctaccctagccctccttagaccttcagtatgactctctgtatcgactcaccagcttttcatgcagtgctgtgctgcgtgtatgggtcactgtcatctccagtgtaagacataaaattatcagctacccttgagtggggcctgaccaagataaccagcatctctgtgatcatcatttctggtctcctactcccactttcatcctctcaacaacccctcgtggggcagatactactgtcatcatcccccatgtacggatcggcatgggaggcacagacaggtaaagttacttggccaaggacattaacgagtcaggtgtcagagcacacattcgaactcgagcaggtgttttcagagccttcactcgggcatctcattgtatttcttcacatcttttcatgacacttagtcgttatctttttctcttctaaaacagagacagggtcccgccctgccacctgggctagagtgcagtggtgcagtcctagctcactgcagcctcaaatgcctgagctcaagagatcttcctgcctcagcctcccaagtagctaggactacaggtgcacatgaccacacccagctcatctcttctttccttccttccttccttcttcttccctccctcctttcttccctgcctctctccctctctccctgactcccttcactccctccctccttcccttcctcccttcctccatgcctccctcccccttcctccctcccttccttccttccttccttcctcccttcctgttttgtagagatagggtcttgctatatcgtccaggctgatcttgaactcctaacctgaagccatcctcctgcctcagcctcccaaaatgctaggattacaggtgtgagccactatggtcagcccatttccttattttctttatgcaataaactgtttgcacttggcacctttagttctgtgtcctcatcaaaacctcgtgcctcctccttgagatactaagtagtatctgagttaaaaagttaatggaaatgttaacaatttgaaaacatatatagaattcaacttagaagagtattacatattttggaaactttaaaatgtatgcacataaaaagaaataaaatctaccagccgggtgcagtggttcaagcctgtaatctcagcactttgggaagccaaggcaggcggatcacctgaggtcaggagttcaagaccagcctgaccaacatgatgaaaccccgtctctactaaaaaaatacaaaaattagctgggcgtggtggtgcatgcctgtaacctcagctactcaggaggctgaggcaggaaaattgcttgaacctggggggcggaagttgcagtgagccaagatcgcgccactgcactccagcctgggctttgttgcctccgtctcataaataaataaaataaaataaaatctgacccatgctacaacatggatgaacttgaggacattatgctaagtgcaatgcttcagctatggaaggaggtatgactctacctgtacgaggtgtctagaatgggcaaattcatggagacgaagtagaaaggtggttgtcaggggctgggcaaacagaggaacagggaattattggttaatggggagagagtttcagtttgggatgatgaaaaacttctagaaatagatagtgatagttacacaacactgtgaatgtacttaatgccgcccaggtgcggtggctcacacctgtaatcccagcactttgggaggccgaggtgggcggatcacctgaggtcaggagttcgagaccagcctggccaacacagagaaatcccgtctctactaaaaatacaaaattagccaggcgtggtggcacatgcctgtaatccctgctactcggaaggctgaggcaggagaatcacttgaacccgggaggcagaggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcaggagaactgcttgaacccgggaggcagagattgcagtgacccgagattgtgccactgcactccagcctgggcaacagagagagactccatctcgaacaaaaacaaaaacaaacagagagcttcagcatgggcgaggattcagctgggtatgtttggacaccggtgctggctcagaccaaggtcacttttgcacccaagagtccttccgcagcgctgcagtttggccagaaagcccctagagggcagtgtgacgaaactgagctgggacggctgggacttactttaaaggctgttccctgtggataggaacaaacaggatgcagaaaactggaagtaagttccctgcaccacgggggattctgtctcctttcttgtctctccagattttatttttctgatgacaaacgtaataaatgccataattttaaaggtttaatacaggaaagaactgaaaaggagacacagcagatgctgacacgctgggaaatttcctcccgtgctctgttctgtgcacagctgcagcagcccccgaatgccacactgcagaccatgcctctgccacgcgccaccgtgcgtgctgtgcggccaccccagctctcctgcctcctctgtgttttttttgagggcattagttagctggtaagatctttgcaccacaggtggtttttgtccctctacccttctccatttgattttttttttcttattgtaaaaatcatagataatactgggcgtgtaaaatggtgcagctgctttggaaaacggtctgccagctcctcaaatggttaaacctaaagtcacccaacccctccccacccccgaccccaccaattccactgccagggatacacccaggaaaaatgagaacaggtccctgcaaaatctcacacaccaatgttcattgcagtatttgtcacaatggccaaacggtggcaacaacccaaatgcacatcaaatgatgaccggataaacaaaacgtggtctatccatacagtggaatactcagtcatagaaaggaatgaaattctgatacacactgtaacatggatgacccttggaaacacgaaagaagccggttacacagggtcacacgtatgattccgttcccaggaaagcccagcatagagaaatctatagagacgggaagtataccagtggctgcttagggctgggggagggggaggggagtcaggagggtaatagctcaagaatacaggatttctttttgactgtagtgatggttgcagaactctgtgacatactaaaaccactgaattgtaggccgggcgcggtggctcacgcctgtaatcccagcactttggaaggcctaggcgggcagatcacctgaagtcaggagttcaagaccagcctggccaacatggtgaaaccccgtatctactaaaaatacaaaaattagccaggtatgggggcacacatctgtaatcccagctacttgggtggctgaggcacgagaattgcccaggaggcagaggttgctgtgagccaagatcacaccactgcattccagcctgggcaacagagggagactctgtcttggaatgagaataagaaaagtgctcataataaaacattttaggaagtccagaaatgcatcttaaaagggggggaagtctcctattatccccaaggagagggatagaagtcttgatgaccgagatacccagcaaagcaggagctgtgagcatgttaaggaagggagggaagatcttacccaaggggagataacaggagtcttccctgcccaactcacagccctgcatcttcctccctgcaatgacctcctccccatccataggcaaggacaccaccttcttccagcagcaagtctgtctagacccttggacctgtgagagtctctcttccttttgtaccttctttttttttttttttttttgagatggagtctcactctgtcgcccagactggagtgcagtggcacgatctcggctcactacaagttccgcctcccgggttcacgccattctcctgcctcagcctcttgagtagctgggactacaggcgcccgccaccacgcccggctaattttttttttgtattttcagtggaaacggggtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagcaaaatctattttctttcttttccagtctccccattcggaacatctgtgtgctccatgatgaccagagccaaggatctcaccgtgggaatctcccattgtctctaacacggggctgggcacctaacaggtgctcactaagcacacattgatttttagaagggaaaaaagtacatgtcacctaaaccagaagaaaatcccccaatcatggatatttggatttggagtatatgtttatgattacagttgccttttggaacaaactatagtaccaggctaggggaattgtcttgtctcttctttcttttctcttttttttttgtgagatggggtcttgctcagtcacccaggctggagtacagtggcgtgatctcagcttgctgcaatctctgcctcctgggttcaaatgattctcatgcctcagcctcctgagtagctgggactacaggcacttgccaccacgcccagctaatttttgtatttttagtacagacagggttttaccatgttggcaaggctggtcttgaactcctgacctcaagcaatccgcccgcctcagcctcctacattgctgggattacagccatgagccactgcaccaggccttgtctattctttttttcttaagtttgtgatcagattcctacttccccagggaggaggggaataatgttccttaactggctgagtcagtgccatgctagactgcggctgccggccacatgtggctgtttacatttatactaaaattacttgaaatgaaataaaatttaaaatgcagctcctcggctgcactagccatatctcgggtgctcatgagccacaaggctgggggctgctggactggatggtgcagagaccgcttccatcactgcagaaagctctttgagcccagtggttctcaagcaggggcaatctaccccacctcccctgggcacatgtggcaatgtccagagaccccgcgactggagcgggtgctgtggcatgtagagggtgggggccagggatgcagctgaatatcctataatgcataaggtaggcccccacaacaaagaatggtccatccccaaatgttaatagtgctgagattgagaatcctgtcctggcctcctgtggttcagcctagctgggcaagcagaggaggccgtagaaggaagtaagggaaaataattttacttaggaataaaaatataggctgggcacagtggctcacgcctataatcccagtactttgggaggctgaggcaggaggattgcttgagcctcggagttcaagaccagcctgggcaacatggtgagacttctttaccaaaaaataaaaaaattagctgggtgtggtggcacacacctgtagttgatctcagcactttgggaggctgaggcgagaggatcacttgaccccaggagatcgaggttgcagtgagtcatgatcgcactccagcctgggaaacagagcaagactttgtctcaaaaaaaaaaaaaacaaaccaaaaaactataaacaaagagatgcaacaataaacaaaatgtgctacattcatacaatgaaatattattcatccttaaaaagtaaggacattttgggccgggtgtggtggctcacgcctgtaatcccaacactttgggaggctgaggtgggcggatcacctgaggtcagaagttggagaccagcctggtcaacgtggtgaaaccctgtctgtactaaaaatacaaaaaaaaattagccaggtgtggtggcgtgtgcctataatcccagctacttgagaggctgaggcaggagaatcgcttgaacctgggaagcggaggttgcagtgagccgagatagtgccattgcaccccagcctgggaaatagagcgagactctgtctcaaaaacaaaaaaaagagtaaggaaattctgatgtatgctgtaacgtgaacgaaccttgaaaacatgatgctactgaaataagccagacagagaggacaaacactgcagggttccacccatgtgaggcccctggagtagtcaaatccacagagacagaaagtaaaatggaggtgggccaaggctgaggaagagagaagggggagttagtgtttaacggggacggagttttggtttgggaagatgtggagacagatggtggtgatggttgcacaatagcgaatgtatctaatgccactgaagtgtacacttgaaaatggttggccgggcgcggtggctcgcgcctgtaatcctgccactttgggaggccgaggtgggtggatcacctgaggtcaggagttcgagaccagcctgaccaacacggtagaaccccatctctactaaaaatacaaaaattagctgggcgtggtggcgtgtgcctgtaatcccaactactcgggaggctgaggcaggagaatcgcttgaacccaggaggtggaggttgcagtaagccaagatcgcaccactgcactccagcctgggcgacagagcgacactctgtctcaaaaaaaaagaaagaaagaaagaaagaaagaaagaaaatggttaattaacatggctacattttgttacgtattattttaccacaataaaaaaaggagacagatgaatgaataagtcaagcaggtctcgtgcatagtatccacagatgttacgcgagcttttggccctcccgacggcagaaagggtttctctgccctgcatgtctccagcatcccgcactcgcctcccttttaggaacaaaaggcaaaaatgctcccttttttttgtccaccaatctcaaatttcccaggaaattggcaggtagtgaacattcactagcattctctgacgggaagtggccgagagggctccgtaccctgcctcactgttcctcagctactccgcctccccaccccccgagcctgggaaacgagccctggaccgcgtctaggaacagccccacttctgtgccagcctccggctgatggccccactcatacacacctgcaatgagatattccttctttcctccaacgtccagcgagaccccacacactgccgaggagggggccgtgtagataaactctatatccttctcaggccctttgaacatctggaaagacaaggaggaggacatgtaagcagagggaggccacacagttggtgaattccgttcccatccagaacaccctgggcggcacaacctgtagctggggtacagccagcacccaagaggaccaggaagtgcaaatacatgggttaggaaaagaccgttccagctgggctcagggctcatggctgtagtcccagcactttgggaggctgaggtgggcaggtcgcttgaggtcaggagtttgagaccagcctggccaacgtagcaaaaccctgtttctactaaaaatacaaaaattagctgagcatggtggcaagcgcctgtaatcccagctatgtgggaggctgaggcaggagaatcgcttgaacctgcgaggtggaggttgcagtgagctgagatggcgccactgtactcctacctgtatgacagagtaagactccgtcaaaaaaaaaaaaaaaaaaaaagaaaagaaaaagacttcttatagcaaagtgattctttggagtcactcaacttttagtgtggcagatcacagcaggtgagcacaagactcatctgtgccgggcgaagtggctcacaccagtaatcccagcactttgggaggccgaggcaggcagatcacgaggtcagaagatcgacaccatcctggctaacatggtgaaaccctgtctctactaaaaatacagaaatttagctgggcgtggtggcgggcgcctgtagtcccagctactcgggaggctgaggcaggagaatggcgtgaacccaggaggcggagcttgcagtgagccatgatcgtgccactgcgctccagcctgggagacagcaagactccatctcaaaaaaaaaaaaaaagactgtcatctggagcatgacatcctcagacaacacctctgttccctcaccccccaccccaaagaggtcatttctgaatctatggggaggggcttttgtacctccacgtgactctggaccaccatgaaggaccatgacttttgcatatttccaggaattttttatttttttgagatagggtctcactctgttgctcaggctggggctgcaacctcaacttcccaggctcaagtgatcctcccacctcagcctcccgagtagctgggactataggcgcatgccaccatgcttggcttttttttttttttaattagcagagacgaggtctcgctctattacccaggctggtctcaaactcctgagctcaagcaatcctcctgcctcggcctcccaaagttctgggattacaggcataagtcactccacccaacctatatttccaggaattttggtcaaatattgtctacttgatggcaatgagagcagagaggcacctcaggaattaggacataactccatgggccagaagagtttgctttctcaacatgtgatttactcacagcctttcaggaacgcacctgctgcccaggtgaagaatggcattttctcagcactcagggaggctgtttttttccccccgaagagtttcaataagcaaacccaaatggaatggaagcatgcctgatgtcatgacaaatggcttgagagtgacactccagcttgtaccaggaaaggttatgttgatgctgtactaaatgacatcatttgccaaaaggctaaaagcatttcctgggcactggcactggccttttcacgacccctttatgaggtcgtaagagcagatcctctttcctgcttcgtaaagaaagagactcaggcactgagagactaggtcatccccttaaactgacatacatgtgatgatgaagcattccactgaccttctgataacattgattttcagctacttttttttttttctttttttgagatggagtttcgctcttgtcgcacaggctggaatgcagtggtgcaatctcagctcacggcaacctctgcctcccaggtttaagtgttctcctgcctcagcctcccaagtagctgggatcacaggcactcgccaccacgcccagctaatttttgtatttttagtagatacatggggtttctccatgttggccaggctggtcttgaactcctgacttcaggtgatccactcacctgggactatactcatgagacactgtgcctggtttactttttatttttaatgacaaaattaaatatcgatgactacaactaccaccatatcacacggctgtccctccacctgcgacatgaattttcgtctctcttacagaccatgttagttactgtcaatgacaatagcatcacctctcctgccccaggccaggccctgccctccctgccctccctgccacatattttttttttttttttttaatacaagctctcactctgtcacccaggctggaatacagtggtgagatgtctcactgcaacctctgcctcctgggcttaagcgattctcccacctcagcctcccgaatagctgggaccacaggtgggcgctaccatgcctggctggttttttgtagagatggattttcaccatgttgcccagactggtcttgaactcctgagctcaagtgatccgcccacctcggcctcccgaagtgctgggattacaggtgtgagccgcaacgcccggacaggtttctgaaggaattgaatttgtggggagcatgtcatctccacacaacttttcaggcattcgaggattaagggaaatcggatctatttgcagcttgatgacctcatcctctgctctagtccacaggtggccagatcgtgttccagggacccaggctctctgccaaccccaacaccccacagctgtgcccacagtgcagcccgggatgccggcagccactattacctttatctgcttgatctcatactggatcctcttgatagggttgccataaatgtcgtttccagagtccacttccttctcactgaccgctttggccctgatcactgcaaaacacaagacacagaggtgaggagagttcctgaaacacgctcctggggctaaggagagggataagacgtccaggcctgcgggaggtgctggggggttacagacagcagcaaggtgcgagacgggcaaggggcatggtgatcccagcccccggcatggcgtctcctcctccaggctgagagatgatgcccagcctcctcctcctccttccacgattcttcaacaagaatcccttctttgttgacaggggcccaagccagaagcccagagtcccttgtgaccaaggcagtttctgtaacagtgggaggcagtcattgatttgactgaagctcatctgttgatatcatgcttgagtgcttttggctttttttttccttctctccagtgggtactcactggtggctggggcaagcaggtaccccatggaactgacccacaatcccacacattccgcgaaggatgggacatttccccaccctccagccacggcctattggaaacaagcttttctgggctgagggcagagggggagttatccaccttaaaggggccttaaacgtacccggcatatttagctttgggggtcttacatctggaaaggtctatccagctcttctcatctttcctgacctggaaaatgttctatgagtaatttttgttgttgttgttattgagatggagtctcgcgctgttgcccaggctggagtgcagtggcaccgttttggctcactgcaacctctatctcccaggttcaagtgattctcctgcctcagcctctcaagtagctgggattacaggcgtctgtcaccacgcccggttaattttttttttttttcagacggagtctcactctgtcgtccaggctagagtgcagtggcatgatcttggctcactgcaacttctgcctcctgggttcaagaaattctcctgcctcagcttctcaagtagctctgattataggcagctgccaccacacccagctaatttttgtatttttagtagagaaagcgtttcgccatgttggccaggctggtcttgagctcctgacctcaggtgatccacctgcctcagcctcccaaagtgctgggattataggcatgagctacagtgcccaaccttaatttttgtatttttagtagagacagggtttcatcatgttggccaggctgttctcgaactcctgacttcaaatgatccacctgcttcggcctcccaaagtgctgagattacaggcgtgagccactgcgcccagcctgggtgattctttacagtaacacagagtctatcaggggcacaacaggggcaggggcaggaagtttcacccaaaggagacatcggcaggcacagctggcagacccaagggacagatgctgaggaaggacaaacagaaggaaagaggatcccaactaagccccaaccaaacagaaaggagttggggaagaggctgggctggggcaattccagaatattctggagcctgaggttgctgacaggccatgcaacacagggctttctcctagcaattaagccaggattctgttccactcctggtaacctgaggacaagcagatcagtagttcatgctgtcacttgggcagggttgggtagagccctccctttcttaatttcaaggccattagttggtgacatggtctgttttaatggctttaaaagctttgccctcccaaactcagctcttcagggtcactctgggtaagtgttatgttacggtggatatgagcaaaacagagaggtaaggagcagaccacgccaggctccaggcagcctcctagccccagccccagccccaccccacgtggtcggctcaaatctcttagaaccccttaggcagggctgtctcttcccacaggggcaaggaggctcaggcgtgtgggtgctccatctgtgtccatccccctgggccccaccaatgctctctggatcccaggctggcatcagagtcccacaccacagccccactgcctcgcctgggcacaaacccctttcttctttcttcttctgttggagctgagtcatgactggccaaggccacaggttcctgtttcccaggctaatccatgcctcatcctgaaaagccacatctaggaaatgtctcccggcaggccactccagaacagacggctttgccctgacggccccctatttccagtgccctcctaaccatcctctcatccaccgcaaccagctgtctttttttattcacgttcgtttctgctcaaacatcatccttggctgccccctgccctcccctaaaatatgagcgcctttgcaacctgaagtcagccaggggcctcagctgctgtgcccaacaccccccacccatgctcccactattctaccacttcataatacttgtctgccctgaacacgcccaggtgcatccacacctctgaacagacaagtttctttctttcttttttttttagacagagtcttgctctgtcatccccacccctgctaggctggagtgcagtggcgcaatctcagccatctcccaggttcaaatgactctcctgccttagcttcccaggtagctgggattacaggtgggcaccaccatgcctggctaattaccatatatatttttttgagacggagtttcacttttgtcacccaggctggagtgcaatggcttgatctcagctcactgcaacctccacctcccaggttcaagcaattctcctgcctcagcctcctgagtagctggggttacaggtaactgccaccttgccaggctaattttttttttttttggtatttttagtagagacagggttttagcatgttggccaggctggtctcgaactcctgacctcaagtgatccgcccactttggcctcccaaagtgctgggattacaggtgtgagccaccacacccagcctgaacaggcaagtttcttccgccccaaatgccatctcccctctctgcctggagaacttttcttcattcttcaagacccagctaaaatagcccttttctgtcttcctctgggaaatcctgtccttctgcagcacttggtatattccccatctcttttccatcctgctgtcagttcctgcacacctgtctgctcagggccctgggaggtcctaacaggttgaggctagattctgactgcagaacagttggtgctcactaactctttgccagatggagctgagatgacgctgacaactttgggctggtggcccaggtgcagtttgtccttggctctcttgctccctgcctaatctatataccttacgacaatgctgcaccaaaaatgtttatgcaaattagtcaatgtgccagattaacttggtcaaagtttgctcttcatgtagcagagtcaccagctcacaagcaaaccagggccaggcacggtggctcactcctataatcccagcacttcgggaggccgaggcgggcggatcacttgaggtcaggagtttgagaccagcctagccaacatggtgaaaccccatctctacaaaaaatacaaaaatcccagccacttgggaggctgaggcaggagaatcgcttgaacccaggaggtgaaagttgcagtgagctgagatcatgccactgcactccagcctgggcaacagagtgagactccgtcttttaaaaaaagaaaagaaagaaaaggaaaaaaagcaagccagcagaatccaaaggaatcaacagttccagtaggagcagcaagccggcctttattacagtctgctgaattctgtatgttattttggaaatttctggagctgcttttcttttctttctttcttttttttttttttgagatggagtctagctctgtcatccaggctggagtgcaatggtgcaatcttggcccactgcaacctccgcctcctgggttcaagcaattctcctgcctcagcctcccaagtagctgggattacaggcacgcgccaccatgcccggctaattttttgtatttattttagtagagacggggtttcaccatgctggccaggatggtcttgaactcctgacctcgtgatccgcctgcctcggcctcccaacgtgctgggattacaggcatgagctaccgcgcccggccttggagctgcctttcaatggtccactaagccgcacaatgcttaacgcacaataggcactcaacaagcatgtcactggagttcagaaaataagcaaagattacttcaaaacggccaaaatgttgcatcctaccatgggcattgaggttcacatgctgttctcttacaaaaacgcctaaggctcccaggtggcagctgggcacttatttgaaggaggcagcaagagacagagatcctgcattcacccctggatggctgcgtgatctttgagaagctccttgacttcactgagccacagttgttcacacctaagacagagacgatgacaacagtcttgacacttcacaaggtcgtggtgactgttagaggggctggtgtggaggctgcggtgcccgggaactaatgcgtgtacagttcaggaccacgagcatcgcatagacaagcagggcgaattctcccgctcccgtgggtgagggattgggacggtggcatcatgccactcaggtacacagacccggtcctggtcagcaggccacagactctcgatttgatgcagcttcccagcgtgctagctttgcctgggggctgcagattacacactttccttctttaaagtgtcagaaaagaggaggctggtcaaatcaagggtccagggtagccacgtggggttaggactagaaagtgaactggcgaggaggccgccagatgcctgcagggaagtgggggtgaggggcagggaagtgggggtgaggggcctggaggagcagagcctgagggcatctccatctcccctgggctgctttagtctgcccctggggaacagaattcagattcttcagggtccctttaaattgggggtgggcacctcctcccccactttgcaaaatgagaaattacatgaaagaaggaaaatgggaatcaagagaggcaaagaaggaccagttccacggcaaccttccccaaagcaccagcacgccgcagacatgaaggagaggggccagctgacagctctgatcggtgcacaccagttggcatagcgggatctgcaccgctgacctgctcagagcagcgggtacctgtcgggggttgttgcccagaggtgacagcaggtgaagagagggtacagggtgaatcctgcatacagcaggccttgcctgggaggagcatccaatccaggcaagatgacagacgatggataggaacacagagaaggagagtttccaatgcccagtggtggacagaggaggagggagagagagctctccggaatacatttccatgccaatggcaatggtccgcactctgagctccaggatggaccaccagttctgtaggggaaagcaggccacttcaaaagagggagggcctctccgagtcccaggccatgtgaagaacagggctggggaaagcgaagagacataaggaatctgggaagaaatgaaaattgtggcacagacacgtttactgaacacctactgggtgctgggcctggtgttaggcactggggtgggtgtcagcccatctcctgtccatgcccccgagaggggctgctctgctcctctgccccttccccaaggagccagaggcagctgcgagagggggagtctttataaagactctcgttctaactgccctgagcccagaaaccacggcctctccctgggcgtctcagatttcgtttttccttctttcccttctgctgtgaacacaacatctgggtttgagatcaagggtgatacactggctgatgaattcaccgccagatgccggctactggaatgtacaaccgtcggctgaattcaaagcacacgcaactgcagggtccccacccccacccctccagcccaggacaccatatgatgtcacttcccccctgcaaaaacaatcccgagcgcacccgccagagtggggacggaaaagaaccgggtgggcggaaaaccaaggtcgcgggagacgatccaaagaggatgggctacggtcagacttcgacagtcacaaccgcccctggaaaaccatcagaggccggaccggctgctgctgctctcggaggggagcagacagtgaagggggcttgctggagaacctggtgtcaccagcatgtgccagggccaagggctggccggaggggcggcactctccacagactccaaccacgccagccccaggcagagacgccacggcttctgtggcacggtcctcccttgttctctctcctcggtgtcccctctgctgccatcaacacgtgggtcctgcgtcctcacgtccccttcatacacccaccaacatctttccaatcctcctgtgtccacagaagtactatggaagttcctgcggaaaataagaacaagccatgcccacaattgggggagggagacagaccccaaaagaaaattgcctcgaaaggccgggtgcagtggctcacacttgtaatcccagcacttgggaggccaaggtggatgggttgcttgaagctaggagttcaagaccagcctgagcaacatagcaatacctcatctataaaaaacaaaatacaaaaaacaaaaacaaaaaaaaacaaaaattagctgggcgtggtggcatctgcctatagtcccagctactcaggagaattgtatgaactagatgttcaaggctgcagtgagctatgaatgcaccactgcacctcggtcctgggtgaaagaaccagaccctgcctttgaaagaaaaagaaaattgcctgtaagaaatgtacttattccacactcattgaattctctttattatcttgccaggggcccaactgctcgctggaggaatcccacatgctatatgtataaatataccatatagaacattttccacttgagccactctgccgggctcccaggcccaagtttgggacaggcaaaccggtggatatcaacacccaacgtctagaccactcacagcctctccccggggcactccacacactgtaacagcatagcgcctgtctcggctacgggacgtgctcaggcagcgggagaaggtggcccactgtccctcaaagtcacctgtctgcccagacgaggtgcagggatccctgggactcagaaacacattcggctgctaaatacaaagtcaaaacccggcccgatcatctgcaccttgtgtgcacactgactcggactgggagggtttgctcagtatcactggagggcactggcccctcccagccgtccaccctcttctgcaggctccagctttcacctggggaggggcgcccataggaccagcactggcagggaaagcgcctccttcccctctgtcctgtcctgcttatggcccagcggagaacgccaaggggtccccatgttctcaacatgggtcattcctgggagtcgggtgggggcttcacacatgtgccaaagaccctactggcccacatcactagtgggtggggggcattctgatgctgcagctgggtcagagtcagcccagagcacccacagtggcaatgaagaccagtggccactgcatgcatcccaggggccagccctggaggactccacactgcgtagacgcaaacgcggtaactgcaggccggagccgcagacgtcttctgagcgtcatttggttcatttggctctgggtggaattacatgccagtcatttcagaggaattatcaaagaaaccattttctctcccggatgaaacccaacctccacttactcctggggaggatccaatggcagttgcaggtggactcagctttgttctttcactgggaaaggactgtgacgttccacgccttgtctaaactctccagaaaagtggggtgccatgagtgccaatgtccacaccctcaaatcacacagttagtaacgcccttgctaacatctgtaactataacttggcgttgccattggggatgagagtctcttgtcccttttgggtggatgtaatgacaccatatggctggtcaacctggcaggggctccatatcctcttttttttttgagatagagtttcgctcttgtcgcccaggctggaatgcaatggcacgacgttggctcactgcaacctcggcctcctgggttcaagcgattctcctgcctcagcctctggagtagctgggattacaggtgcccgccaccatgcccggctgatttttattttgtgtatttttagtagagatggggtttcaccatgttggccaggctggtcttgaactcctgacctcacgtgatccacccatcttggcctcccagagtgctgggattacaggcgtgagccacctggcccggcctgaccattttgattaatatgtctaaagcgccagctgagggtgtaccaggggcccctctgccccagccacccacaagatcagagtctgaaaagggaggtgaagcccactttccccacttctggtgtctacaccctcagctcaggacagatgtccagtaacacagctgtggccctgccctgcaactgctgtaataaatgactatttttcatggccctgctctcagatcgctgtgggatccctaaatgtttgtgtgtaactaatctcgttgggcttcaggatcacagtaaagacagcttagaaacatggaagctctccattcgggcagcacctccttcttttagcaggatggggccgacctcgccagctggagcagcagaagtggccacaaacgccaccagggatggcagacggtgatccaggaaggggctgtgctcacaaggaccccagacctgctctagtcctctaggtttggaggccacgcctctcccaacggaactgcccaggggcacggggcaaggctgagcagccaggaagtgtcacaagtgttgtgaggtgacagtgagggttagctggtccagctcaccttcagcctctggcctcaagtgacacagccgggtgcccttggtgggcagtcagagggtctcccccgggcactgggctctgcccttcctcggccccttcatgccagccccttttggtcagcgggtgcggcagacctcctccaaattcactccttttagggaaatgagcagaaaagagggccgtgacttggtaattaaaaacagccctgtggtgctgggcaggaaccaggctcttcccgccctgcagctgctgtggaggccagacccaccctcaggtcctccaacctcctcggcccccggaagccagcaacggggccttctgggaagcaggaaagacctcagcagagggggcaccataggagcacactggacatccgtccccagttgagggtgtagacaccggaagtgaagacatggggcaccacctccctttccagactctgaccttgagagtttgtgggtggctgggacagagaggccccaggtccaccctcagtggtgacttgcagccctggtgcagggcgggaccgtgacatccagggtgaggacagaggacttggccagcatgactcaggccagggtgaaaaacgcctggaatgacaactactcagaaaagatattttgttggggagggtgcggaggagggtggggcagagaaggtaacagggtgcacaacagagatcagggaacagaagcgcagcctcagccggggccacaccgcctgccagcgggcacctgggggtgctccaggccctgccgccccagggaatgctccctccccggctgcctgagattctagtgcacgtgagctgctggccactgggtgcccgtctccatggagaccagctctcccatctcacttcctgcccattcgttttggctcctcttgggaaacagcatctatcagagcacctcagccacgcagagcaaagccgccctctctgcccagccttcctgccgccctccccaaccccagggccctgccccctccctctgcagctctgggaggacctcggggcccacgtcccgctgccctccctttccctggtgggccagcaggtctcatgccagagcctccggctcggcccttcccattcacgtgctgctgaatcacttgaaaacaatgcaccagaccccgggaggatttgctgagaacagtgcggctttgtggagggaagtgcagctctgcattttctccgtcaagacccacggaacagccaagctcagccctgcaaaccctaagccagagccggagcagggacaggagcaggaccgtgcagggcaggaggcagagggagcctggagaggcaccgaggaaacccctacccatccctgcaacccgcccccctacaacagatgagcagggggccagggtgacaactccggagccaggggcagcagcagattctctcctcgcactgttgctggggggctgcgacagcgcgaggtgggcagggcactgttcctcccaagccgatccatttttggggacgaacgtgaggtccgggcccaggcttcaggctcattggcactgactgtctttgagccctggctgttcgtcggacccagggtcatgtggcctgtgggctgagcctgacttgctgcatttctcaggagacagaaacagggacatgaaggacatgaaggctggaatcccagggtccacacacccaggaaagaatgaaagcaggggggctgaggtccccactcccctttcccttcctcctcagcacagcttcccaaacaagccccatgctgagcggcgcccccagactccctaagcttgtcctggggggtgtgcatctgtgtagccccgtctccagctggaggacttggcctgggctgtcacagcagctgcaagtgcaggctgcaccccagccctccgccccgtgtcttcttggagatctcgatataacccccttgccatttgcacgaactggaagaatgaccacaggtcagggagggtgctctacccacccgtccactctaaaaaccctatttccttttgtcttatgtgtcggagatcctggtcacacagggcttgaaggggaagggagatttgtgcggagagaagatggacgccccagggcagctctcagggtggggtcacatccaaagcccaactggccagcaggttgggggggagcaggccaggaggtgaacaggtagcacctgccagaccctgctggcccccctcagcccatggacagctgacctcggcagaaagcacaagcaacgctgctgctccccgtccaagcctcacggaccaacagggcgacccacgcaccactgctcagccacggaggccttcctgggtccctgtggtttggggagaaggacccacaaggcagggagcaaagatggggccggaggacgaaggttccagcaaatgcagagtgaggcgcgaacacggaatctgtcccccaagggtgggggcagaagcaccaaaccagagcagagctctagaaggtgcaaagtgttcggagcaggagaaccgtgcggggtacctggaagtgccttaggatgaaggtgaacacggccaccacatctgggatcctcaccgctgctggcatggcagtgctctctggaaacctcaggagccccacacccttccgggtggctccatcccttgttttacagtcaaatgaaggctgggcaagggctggggtgtgagtccagggggcacccctgagcccgccaacatagccctatgaggtgcctggcacttcggggaggatttaggctcgcaaggcagggggcaggccctgtgcacttgtgtccggaagagaggtggtgggaagagagatgctggaagctgggtgtgaggggtgtgaggggtgtgaggggcaggaggtggagggccaggccttggaggaagtgcagaaaccttaacactctgcccaggtcacctagctgctggcaaatggcagagccagggctccaaccccggcagtagggctctcaccagctcctggtggaggctctgggtggaggcatgggacggggtgagccaggggaagctggaggctgctccacagccctttctaccgcagtccagctgtgccaaggtgaccaaggggggaggggaacacaggcactgccaggccctgggatggaaagttactcatgacatctccgtaagaatcactggagggccatggttttgggtgtggacatcctggagggctgttttagtgcccacaccaatgccctagttaaagaaccaccctgtccccttagccttctgcaggacaggtgggaaagggccgggtgtctggtcctgctgccaggggacagtgcaggtgtgaccgtccgggcagagatgagtcaccctccacactgtcttgctgcccgtctccacgcctagttttagctcgtgtggtcaagaaggggcgattcctcacctagaacacatgggtcacaaatgctacctttgaaaatggaaacaaaaataacccactcaaaggcaggctggttcccccatcagactgtggcttccaggctaaggcaggaagacctcggctactcaatgtttgggccccattgtggccatggcttttaactcagtcatgccataacaccctctctgccctctcagacagaggtgatgctacactgacaggcggctacgctccaggtctccgtgtgcaaaaaatagctgggcacaaggcaagtgcagaaacagcaggagcacggtgacaccccaccccgagaaatctatgtggcttttgaaaaacagcagccctcctgacccccagtttccttcttaatcatgttgagcctatagcaaattgtggagtggctttgcaaccctagcccatgacattctggaagcagaggatagaaagaaaccaggctaagatcaaaattttcttcttctttttttttccccctaagacagggtctctgtcactgaagctggagtgcagcggcgcaatcacagctcactgcagcctcgacctcccaggttcaagagatcatcccacctcagcctccctagtagctggaactataggtgcacgccagtatgcctggctactttttgtttttatagagacacaatctcactatgttgcccaggctggtctcatattcctgggctcaagccatccacctgctttggcctcccagagtgctgggattacaggtgtgagccaccatgcccagcctcgaatttcctctacttggcctgaagcagaaagccacagacaacagagacctaagctactaatgattaaagaacccaaaagcaaaaacaaaagagtcttgtgggatgctactcccgccccgtccaaatgagcgtaacgcttgttggttccacgagcttcgcattcgccagggaagtccggcttgagtttctcagaggcgtgcacttggggtcccactgagcaccttgtcctgcacagccatagttccagcttttactcactcatcatctgcgtcctccaccagaacgggagtcctgtggttccatgtgtgtggctcactgctcatctctagtgactgggacagtgtctaggactcatatctgtaaatttatttatttattttgagatggagtctccctctgtccccaggctggagtgcagtggcatgatctcagctcactgcaacctccgcctcctgggttcaagcgattctcctgcctcagcctcccgaatagctgggactacaagtgcgcgccgccacgcccggctaatttccgtatttttagtagagacggggtttcaccctgttggccaggctggcctcgaactcatgacctcaagtgatccacctgcctcggcctctcacagtgctgggattacaggtatgagcaaacgcgcccagcctcatatttgtaaattaaatattttataagagcaggtcaatctttttctggggaaaaaaaaaaaaataggaaaaaaaaaaaaagagcaataaacgggatctttcccacacctacatcccagctgtgccaaaagcactttttgacacccggtcctttgattcaaatgcatcagagatatagtcctctttttggaaacaagcacgaaactggagaagctatgatcctggaaagaagctcatacacgcgatgaggatatgctgcagtgaaaatgagtaagaggcgtttgtgtgatgtggatgaattcagtaaccgtgccgaggccaaaaaacctagctttcaaaagactccacataatatcctttttataaagttcaaaaccaagtaaaactaaacactatgtttagcatacatatatggataaagatagggagggctaaaccccaagttcagcaggtatatatctttttgtttcttttttttttttttccttttttgagatggagtctcgctctgacacccaggctggagtgcagtggcgcaatcttggctcactgcaacctccacctcccggattcaagcaattctcctgcctcagcctcctgagtagctgggattacagatgccaccaccacgcccggctaattttttgtatttttagtagagacagcgtttcacagtgttgaccaggctgttctcaaactcctgacctcaagcaatccgcccgccttggcctcccaacgtgctgggattacaggtgtgagccaccgcgtccagtatctttttgtttctgagacagggtctcgctctgtcacccaggctggcagtggcgtgatcacagctccctgtgcggcctcagtctctggggctcaaatgaacctcttgcctcagcctcacgagtagctgggactgtaggtgcaggccgctatgctcagctaattttttattttttgtaggatagggtctccccatgttgcccacgctggtctcgaattcctgggctcaagtgatcctcctgcgctggcttcccaaaatgttgggattgtaggtgtgagccatcagcaggtatatgtccaaggaggcagcagggggatggaaaagggaggtagcgcacaggtagtgaatattctgggtcttgggtctgggtgatgggctcatggtacttcattatattgtctacaaaatatacataagtaaggccattcgtggaccaatgatactaatgtgtcatgaacaaagattggttgatctaagtcaatgtatctgaggttgttggaagggagggagagagacagactctgaaaccatcctagtacagggatcagcaaactatggcacaaagggcagatgccgctcaccacctatttttgtagagtctcattggaacctggccacgccctttcatttacatctcatctgtggctgcttctgagcagctgcagtagagctgggtaattaccacgggggctgcacagctggcaaaggctaaaatatttactctctggctctttgcagaaaaagtatgttgatccctgtgcctgtccctaagactgcaattggcagaagagaagctacccagtgtgaggtctccatggctctggtggatgccaggtcagtggcaaagctagcggggaggaaactgatcaaacacccaggtgccgacacccttgccagccccagagggaatcacccagcggggcgagggtggcttgtcttctcttttccgtctactctcttttctcttaaagttataagaatgtattaagcgacgtgctatttaaacaatgttggttttgttgtgactttgaaagactaagaggttttagctttggttcaatctccgttaatgtctcagccttggctaagcactaagtgatctatctcctgaaattgtgcccgtctgaccttgggtgcccctgaaaggccagtgtttatttggctaaaacatctgaagggcttaaatgacctggagtctccatctgtgcctgtggcccctgaaaacagactgtcacccaggctggaatgtagtgacatgatcggctctgggagatgcatccacagcacatgggctagacacacccactgaaacccacacgggttcctatttttgtatataggtggtttcccaaaagggacttcgttttaaaggcaagactaggccaggcgcggtggctcaagtctgtaatcccagcactttgggaggccaaggcaggcggatcacgagatcaggagttcaagaccagcctagccaacatggtgaaaccctgtgtctattaaaaatacaaaaaattagccaggcatggtggcaggcgcctataatcccagctactcgggaggctgaggcaggagaattgcttaagcccaggagacagaggtactgagtcgagactgcaccactgcactctagcctgggcaacagagcaagactccgtctcaatcaatcaatcaatcaataaaggcaagattagggaaagagtccctgtgagggaatgtgccctggaggacggtataatgacagattgctttttttttttttttttgagacgagtctcactctgtcacccaggctggagtacagtggtgcaatctcgactcactgcaacctccgcctcccaggttcaagtgattctcctgcctcaatttcctgagtagctgaggttacaggcacatgccatcacacccagctaatttttatatttttagtaaaaacggggtttcgccatgttggccaggctggtctcaaactcctgacctcaggtgatcctgaggccgacctcggcctcccaaagtgctgggattacaggcgtgcgccactgcacccggccccagattgcccattttaaagaggcctaatagtctctgaggcaatgacgcaaacacagatcttagagacccgggtaccagtgctggcagcaccattatcagtgatgtatttaccccgggtgggcctctcgcatttagcatatgttctgaaactcccgcaagcatttccgggcttcttcaagaaactgcttgtgcaacctgttttgctgtaagatctgctgctgctggtctcggatcatctgactgtgccggtcgtcgtcggcgaggctggtgcccgatggggaagtggtgctgagctcagatcctctctccctttcctgggctctcgtggaggaggacttcagatgggccagtcgagctcttctttgctccctcctctctttttctagctcagctttgtagtggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactcttccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatggaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcaggggtgtgtaggagtgtgtgtgcaggggtgtgtatgcaggggtgtgtgtgcataggggtgtgtgtgcaggggtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctacattacagctaacattaaccgtgcaggctcccctctgagcactgggcatgtatccgttcatcttttttacagtaatcctttgagatacgaagctcctaccccccccggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacaaagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagaggcacctgccctctctggttgcttagaatattctagaaggggcaggggtcctggcgctcctctgtcctccacatcctctgagtgttctgagcatcctgggctgctttggtgttttctactcccctgctgccctctggtcctgccaccccgagctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccctccacccaggcagcgtggaagtgccagggcccacagacagcacccccccgccccccgccggcctcctcaccccctccgaaggagactccaggcctgctgtgcactcctgtggcatcggggggcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtaacaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcacgtacacctctctccatctcaccgcctcaccataggaggtgaggcctattcctatccgcacaatctgacagggaaattgagactcagagaggttaagtaacttgcctaaggccacatagctcgtaatcagggcagcagggattccgggccgagcaggcaggcccctgatccaggctcctagcctgctgcccagggaggtcagagctggaaaccacttccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccatcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcaccccgtcctctcccgcactgcagcccagcgctgtctaactgagagacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccgcatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcagtgagccaagatcgcaccactgtactctagcctaggcaacagagcaagactccatttcaaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccagcccgacctcacctggccatgctaggaggcagtgggcaagcggcaacgctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattccacgcacgaggaaccgacgggcagacgtggagctaaatgatggtcaacagctacgaagtgcctgtgctctagaaatggccaatttgatcatgtcacgggataaagtttcaaaatcaataaaaccgtgatgaaatgatcaggaataaacctgtccagaactgttcaagacctaaaggagatgcacgggctgaagaacaaggagcaaatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagcgacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaggagggcaggaagcactgtctccagggctgtcttgaaatcactgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggtggcggggggacgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccactcgcctcggcctcccaaagtgctgggattccaggcatgagccaccatgcccagcctgcactgggttttggactggctgtgttagcatcacctggggcaggggtgggtcacgttagaatgagtcctggctaggcccacagcaggcttttccacccgaatactggggccacagctcatgaatctgtgtgtatccatatcctgggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaacaaccatattcatctccaacccagtcccaccagcttccctcactctccttcccatcacactgcctgtggggagccccgtggtgcagggactttgccgctggccttgcgaacccacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccgcctccacctgcagcccggcctctgccctggctggctactcatagcaggctgttgccatgggaacagcagagctgttgagctgtgacatcatggcaggggtgaggtcagggacagctgtgagccagccagggggcaagcgtgtaggttaggggatcaatcataaagatttggctcaagcagccgggagccatgggggcacctgaaggcactgtttaaggaggtgtgggtgaacaaggacagtgcaatgtacaaatgctcgtggccataccaggcagaggacatctttttgtccccagctggctgcatggagacctcccagggtgtcattctctctgagctgtcaggccattaaggaggtacacttcaaggtcagggttcctgacaacgcctgccatcccttctcctgtagggacagcatctgttcacgcttctaaacagctccagaaagccatcgttaaactgaaacccactggaggcgggggaagaaagaatcccgtcaaccacctgcccacacaggaggagaagccacacgtacttggcctcgtttgagggctagttccccacagacagtttgatcagaaggatgggcgagggaagctggcagggcgaggctggggatgaacatgggacactgggggagtctggccggtgcagggggtttccaggaagcaggagtagctgctggaaatgggggcccctgacctagtctgggtggttggcatcttaaggtctgtggtaaagtgatgactggcattgtcaagatatgttttttgtttgttttttagacagtcttgctctgttgcccaggctggagtacggtggcgcaatctcggctcactgcaacctctgcctcccgggttcagggattctagtgcctcagctttctgagtagctgggactacaggtgcatgccaccatgcccagctaatttatgtgtgtgtgtgtgtgttttagcagagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggttgttgtttcttgagagaagaaggtaaacagcaggaattcggctgaggtgtccaaatctcggggaggatgaattctcaggagagctgaacctgagacaaagccctttgtcctgggctggaaggaccctggaaaggttatctggtccctgactcagggaagggaggcattctccctgcaggaatgttctcgatcacagtccaccaccacccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaagaagatccctcctcgccaggtggggcaccatcactcaatctgttgaaagcccggacagaacaaagagacagaggcagaggcaggcaaaccctccctctgcaagagctgggacatccaggctgggcgcggtggctcacgcctgtaatcccagcactttgggaggccgaggcaggtggatcacctgagctcaagagtttgagaccaggccaacatggtgaaaccccatctctactaaaaatacaaaaatgacccgggcgtggtggcgcacacctacagtcccagctactcaggaggctaaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacgcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggaggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactggcctaaggccaactcagccttgagagtctgggtccatactattgttgactgcaattagaaccacatattagcaaatgctagcttttaaaaattacaggtacaggcagacctcagacatactgcgggttgagttcccacagaatcataataaagtgaatattgaaataaagtgagtcacatgactcttttggtttcccaaaccaatatatattcccaaatataaatgttatgtttacattgtacagtagcccagtaagtgtgcaataacattatgtcttatcaatgcacataccttaatttacaaatactttattggccggggcagtggctcacgcctgtcatcccagcactttaggaagccaaggcaggtagatggcttgaccccaggagtttcagaccagccaggcaacacagtgagatcctacctctataaaaaactaaaaatagccaggcatagtggtgcgtacctgcagtcccagctactcaggaggctgaggcaggaggatggcttaagcccagaagttcgaggctgcagtgagctaagatcatgccactgcactccagcctgagtgacagagcaaggtcctgcctcaaaaaaaagaaaaacccaaaacttgaagaaataaaaataaaaataaaaatattttattgcttgaaaatgctaacaatcatctcgacctagtgagtccagtctttttgctggtggagggtcttgcctccatgttgatggctgctgactgatcagggtggtggttgctgaagattggggttggctgtggcaatttcttttttttccttttcttttttatttttattattttttttgagacagagtctcgctctgttgcccaggctggagtacagtggtgcgatctcggctcactgcaacctccatctcccgggttcacgcgattcttgtgcctcagcctcccgagtagctgggattacaggcctgcgccaccacacctggctaatttttgtatttttggtagagacggggttttaccatgttggccaggctggtcttgaactcctgacctcaggtgatccccccgcctcagcctcccaaagtgctgggattacaggcgtgagccaccgtgtctggccggcaggcccactttcttattatttgtgtgatcacctggagtagcattttttaatttccttcacattcacaacttggctgtttggcacaaaaggcctagctgtcagcctaccttggctttcaacacgccttcctcactaagcttaatcactcctagcttttgatttaaagtaagagacgtctcgctctgtctgtcaagcttgaatgcaatggtgtgatctcggctcactgcagcctagaactctcaggctcaagtgatcctcccgcctcagcctcctgagtagctaggactacaggcatgtgccaccacacccagctaagttctttaattttttgtggagatggggtcttgtcgtgttgcccaggctggtctcgaactcctggcctcaaggtgatcctcccgcctcagcctcccaaagtgctggaattacaggcatgagtccccacgcccagtcccattatagggtaattaattggcctaatttcaatattgttgtgtctcaggaaagagggaggcctaggcagagagagagagaccagaagccgccagtcggccagttggtggagtcgtctgaacacagacaacatggatcaattaactttgccatctcatgtgggcacagttcatggtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacaatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggatcacttgagctcaggagtttgagaccggcctgaacaacatggcgaaaccccatctgtactaaaaatacaaaaacttagctgggcatagtggtgtgtgtctgtggtcccagctacttgggaggctgaggtgggaggattgcttcagcccagggagcagaggttgcagcgagtggagatcgcaccactgcactccagcctgggtgacaaagcgagacactgtctcaaaaacaaaaaagaaaagaaaaagctataccatgtgatgtctgcagagcatctgatgctgtgatttatttaaccacgcccctgctactgtatatataggtgtttctaacgtttccgtaagataagcaagacggagatgaatatccttcagctaaatacttccatgtgtcctaaattatttctctcagaaaaactccaagatatagggctgcctgatcaaagggaagacttatttttaaagtccttgatcactgctgccaaaatgcccttccatgcctctaaactactcaaattaaggcaaaatatacctgtcaccaaggccttctgaggacaacatgcctcttggccaaaaggagcaaagtgatgttaaatccaaagctgtgaaatctaatcttcttcccagagactcgagccaggatcattccccttggattcctggcactgccactctgtgggtgaccttgggcaagtcatcggctgctccccatccaaacacctgcctcacctcccccgcagagcctttgtaaataaggaagatgtgaagtcctttgtgctgaaaagccctcgacagtatttttatgcatttgcctggttgttttatccctgctttccagaactagtgcacagaagggaagaccaccacagactgttcctttattccctgccctggagccaactgggccaagtggacaagacctcacaagggagagtcaggccagcaatgctcatcccagctccaccctgaccccattcctcttggcatactcagtttctgcctgggctgggcaggctggtccttggcttctggggtcagctcaggattgaggatgaaatgagaggagcacccccagaagagaaagtgctgaaccagaagcccaggagagtcatgtgtgtgcgtgtccatctaagcctttgccccaaaacagtaggtaggtcaggtgcagtggctcatgcctgaaatcttagcactttgggaggctgagatgagaggatcacttgaacccaggagttcgagaccagactgggcaacatagcaagatctggtttctaaacacaaaagtaattttaaaaattagccaagcgtggtggcacacacctgcaatcccagctactcgggaggctgaagtgggaggactgcttgagcccaggtggttaaagctacagtgagctaggatcacgccactgcactccagcctgggcgacagagcaagaccctcatctctttaaaaaaaaaaaagataaatcaaggagcccacctgtccccagagctctcctgccacagtgtcagcacatgccttctgagcataataatccccccggacctgaagcccacgaatgacccccccacccagtcctttctccctcatgtcacgtcaagtgctgtgtcactgaagcaccccgtaccccatcacctggtgccagaggcctggccatggtgcagctggacccccagctgcccgtgtgaccgtgggcaaacggattatgtcaccttcccagtgttagagagacccagtggtgacaaacgtcctctgtacctagggtcaccgtaaggctcgggtctcatcgggtttctgtacatgctctagacgtgcagcgtcatgctaccgacactccaagtagccggccttgctggcactcctggctttctcccttattccaccccccgccccccacaacattacgggacccaggccgggcactgtgacccaggcagtgtggattctcaactagctggagcaaacagggaactagggcacagaaaaggcagagtcacacaaccggaggcggagtgtccgtctagtactgggacccggtgtgatgctttaaggaacacacctgccgtccttatgtgagctgggctgggcctttatttttaatggacacataattgtaatatttatggcatatatagtgatgtttagatacatacaatgtatagtgatcagatcagggtaattagcacagccatcatctcaagcatttctttctttgtggtaggaacattcaatgtcctccgagctatctgaaactatacaatatacttttgttaatttctttttcttttttttttttttgagacacggagtctcgctctgtagcccaggctagagtgtggtggcgtgatctcggctcgctgcaacctccacctcccgggttcaagcgattctcctgcctcagcctcctgagtaactgggatcacaggtacacaccaccaggcctggctaatttttatatttttagtagagacaaggtttcaccattttggccaggctggtctcaaactcctggcctcaggtgatccgcccaccttggcctcccaaagtgttgggattaaaggtgtgggccaccgcctggcctattgttaattacattaatccaacagtgacatggaacactataactcattcctcctatctagctgtaattttgtatcctttaacaaatctctccctctctcctcccccaacccttcccagactctagtattctctgttctacttttgacttcgatgagatcaacttttcttttttttagctttcccatatgagtgagaacatgccatgtttaactttctgttcctggcttatttcacttaacgtcttccagttccattcatgttgctgcaaatgacaagatttcattctgttttatggctgagtagtatttcattgtgtagatgtaccaacatccacaatgaaatactatttcattctttagccattcatctgttgttggacactgaggttgattccatatcttggctattgtgaacagtgctgccaggaccatgggggtgcaggtgtctctctgatgcactgattccctttcctttggataaatgcccagtcgtgggactgctggatcatatggccgttctatttgtagttttttgaggaacctccaccatagtgactgtactactttccattcccacccaccgcatatacgagttcccttttctccccttccttgcctgagctgggcctttctgatcatctgtccccgtcccttgaactcttgatctggactgagggaagaatggtggcagaggcgagctggggagcagggaggaaccaggctgtcgcaggagaaacagaatattgcgagccagccgtgtggaatggaaaggggaagctggtcttcctgccccacactcctgcctttcttccttaagggctccttggacagagactgcaggtttctcagaagcactgtccaggatctcaacattctagaagggtctaggacaaactaactaactattgagcccctccagtgcttttgttgtttttgttttttgttttttgttttttgagacagagtctcactctgtcacccacgctggagtgcagtggcgtgatctcagctcactgcaacctccgcctgggttcaagtgattctcctgcctcagcctcccgagtagctgggattacaggtacccgccaccatgcccagctaattttaaaaatatttttagtagagatggggtttcgccatgttggccaggcttgtttcaaattcctgacctcaagtgatccgcccaccttggcctccaaaagtgctgagattacaggcatgagccaccccacctggcctccatttgactcactcatcaaaaatttaatcttggcagggtgtggtggctcacgcctataatcccaatactttgggaggccatggcgggtggatcacttgaggtcaggagttcaagaccagccaggccaacatggtgaaaccctatctctactaaaaacacaccaaaaaaaaaaaaaaaaaaattgaactgggcatggtggcacacgcctgaaatcccagctactggggaggctgaggcaggagaattgcttgaagccgggagacagaggatgcagtgagccaagattgtgccactgcactccagcctggacaacagagtgagactctgtctcaaaaaaaaaatatgaatctcccatggcaccacactgaagagtctgatcttgcttttacagaagaggaaaccaaggctcagagaggcacacagtcgggattcagaaccagtcccacttgactccaaagcccaggctcttttctccaatacttttcatgtcgcctcttttctctgaaatgtccatttcctcattctgtccttggttaagcagcagctgttggcgggtgctctgtccaggcctccgctaccatgacgagccttggcaaagcctgccccactgccagtttgctttgccacgtctgtgtcaggaaagctcaatcaatctctcccgattacagatcagaaagggccaaataaactctcaacccaagccagattctgtccctgaagatgcagtaagggggtctcggtacccacagaacatcccaccacagaaagccaggctccagcctgaaagtccatcttccctgctctagcccacccgtgcgatgaagagcacagaagaggcgggtgaaggcattgcatcttcagcatcggcttggagaatgacaccctgcaggttccacttcttcccaggccacctgcttgcttctggaaagcagggaacaggcaatccggggagagaggagccagccacacaaggactgggaagcccagacctgtgccatcagcctgcgatgacttaggctggggatccgaaaaggtttctatgaacagccagctggtaagtaatttagactttgaggcccatacagtccttgatcaccgccattcaactctgttgttatagcacaaaagccacgtgggtttggccttaccagtgggcgtggctgtgttccaataaaactttatttgcactaggccaggcaccgtggcacaagcctgtaatcccagtactttgggaggccgaggcgggcagatcacctgaggttgggagttccagaccagcctggccaacatagtgaaaccctgtctctactaaaaatacaaaaattagccgggtgtggtggcaaaaagaaaaaaaaatatttacaacaacaggccatcagcccagcagtgggtctagtttgccaaccgctggaaaaagccaacaacattttgggaggccgactgccggctacaggacctcgccataccaacaagggctgagacccgcggctctgcagggctctaacaacagcgtttgacctgagtctatctggggaaacatcacgtgaacccacgttgaggccctactctggaagctgcaaaattagagatgatggctgtgcggctctgtgaatgtactcaaaccgctgaactgtgcactttagaggagtgacctcatggtatgtgaattacatctcaataaagcagctcaaaagcaggctgggtgcagtggttcacgcttgtaatcccagtgctttgggaggccgaggtgggaagacggcttgagcccaggcgttcaagaccagactgggcaacgtggcaaaacctcgtctcgacaaaaaatgtaaaaattagctgggtgtgctggtatggtcccatagttccagctacttgagaagctgaggtaggaggactgcttaagcccaggaggctgaggctgcagtgagccatgatcatgccactttactccagcctgggtgacagagcaagaacctgtctcagaaaaacaacaacaaaaaaaaacaaaaaacataggccgggcacagtggctcacacctgtaatcccagctactctggaggctgaggcaggagaattgcttaaacccaggaggcggaggttgcagcgaaccaagattgcaccactgcactccagcctgggccacggagcgaaactctgtctcggggaaaaaaaaaaaaaaaaaaaaattctaggcaatggatacaatcaggatgatttttcttgctttttgcttaagtgtcttttccatgattaacacatatagttgtgtaattattttaaagttagaaggcatttgggacgtgaatggagagacagagaagttttctttatgatggagagaggcggaagggacggcttcctctgcgagggtgcaagggctgacctgggagagcaggcagctgcgactaacgctggctggggcctgcctgacttccccttgagtcctcagaggcacaggttataacccaatgttttattgcttcttgagaacattattggcattcatctgccttcgaaattttggctattcatttatttatttatttatttatttatttatttatttgagatggagtctcgctctgtctcccaggctggatggagtacggtggcccgatctcggctcactgcaacctccacctcctgggttcaagtgattctcctgcctcagcctcttgaatagctgggattacaggcacccgccaccatgcccggctaatttttgtatttttagtagagatggggtttcatgatgttggccaggctggtctcgaactcctgacctcaggtgatccacccaccttggcctcccaaagcactgggattacagggatgagctactgcacccagccaagctgttttttttttctttatagacagagtcttgctctgtcccccaggctggtacaaccatagctcactgcagcctcaaactcctgggctccagtgatcctctcacttcagcctcccgagtaggtgggactacaggcacgtgccaccacccctggctaatttttaaaattttaatttattttatgtagagatgaggtcttgctatgttgcctaggctgatctggaactcctgggctcaagtgatcctcccgcctcagcctcccaaagtgctgggattacaggtgtaagccaccgcgcctggccagtctgggctttttctttttttttttttgagacggagtcttgctctgttgcccaggctggcatgcagtggcacgatctcggctcactgcaacctccgcctcccgggttcaagtgattctcctgcctcagcctactgagtagctgggattacaggtgcccgccaccacgcccagctaatttttgtatttttagtagagatggggtttcatgatgttggccaggctggtctcaaactcctgacctcaggtgatccacccacctcagcctcccaaagtgctgggattacaggcgtgagtcactgcaaccggcccagtctgggcttttgaaagtactgtgctctgaacatttttctaggtcataaacacaaatctgtaatatcatttgaaatgtctgctcactctgttgcggcagggagaaagattaattgatttagcttatctccagcagacaggcaaacctcatgaacaaggccagcctcaggagctcctctccctcctcagtggctccatccgtcacctgtagagcttcagcccagctccacagcctagaccattcatccccaagccagtatcagtctgaatcagcaccattctgttgatgtacctccttttaaaagccgtctctctctctttttttcttctttttttttttgagacagagtctcactctgtcacccaggcaggagtgcagtggtgcgatgtcggctcactgcaacctctgcttcccaggttcaagcgattctcatgcctcagcctcccgagtagctgggattacaggcgtgcaccaccacgcccagctaatttttttatttttagtagacatggagtttcaccatgttggcaaggctggtcttgaactcccgacctcaggcgatccacatgcctcggcctccccaagtgctgggattccaggcatgattccaccgtgcccggcctaaaaaccatctcttcttttactctgctatttcctagccagctaaccctgagcaggttccttagtgggcctgtgcctccgttggatcgtctgtacaatggggatgaggatagggaaggaaatgggttgacactagtgaagagcaagaacatacctccaagcccttggcacctctgccagctgttattgttgccatagtcattatcaccatgtcatgattcacctccctggctgctcccaggcctccctcagggcggggtggggaggaacaagaacacaaagacagggagagccagggtttgatgcagaaagagctggtgtcccccactagctccgagagcttcctgggaggcaggaaattcgcctctcctttttggaggtgtggaagtgggggcagagagaggccacctgtcccggatcgctctgctggactcaatctggggccagcatttgacccccgctcaccctgtttgctatgaatgtcagttcccctcgctactgctggctcccttccccctcaatgctccgtttcctgttccctccaaggccccgttacacaatttccactgtctgctgaagttctagctcaaatccctctcgccgagactttctggtcaccagattccagcagaactcaacagagacctctacccgcctgagctcctgaccaggttagagggcatctggctcccaggcactgggtcaagctccagaggcatctcctgtgtctgcccgcgacccatggccccgctcagggcctgccttccatctcctgggtcttccccagtgcaggtgggagctctgctcccctggtaactgcgagcctctcaacaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccaccccaggacctttcctcggggcttatcttagctctgataagatccacccctcagggcccacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaatacaaaaattagctgggcatggcagcacacacctgtaatcccagctactcgggaggctgaggcaggagaattgcttgaacccgggaggcggaggttgcagtgagccaagatcgcaccactgcattccagcctgggcgacagagcaaaactccgtctcagaaaactaaataattccttgacacacttgccatagtatttctgtgtacggtaggcacccaaattctattgtaaaacaaaatataaaaacacttaagtgaataaattctgtaagaagcaggtatctaagacatagacaccaggcccttcctaactggtgaggtctggagttccctcaggccatgtgtggtccagctgtgatcagagtttgagatcaaagagcagctgccgtctaccaaggacgtcttccccatggaagacaaccacagaacctcccaggtctttggagccatccctgagaccagctaggaggccaaaggacactgatggcatcctttccccagagctggttacaggtctgcctcggactcccctcgtggtggtagtgtctgagcggatcctggctgcccagggcggccgagtgcagaatgagggtggaagaggagagaaaggcaagatcgttaccatcgctcagctccgagactaggcagatactcacaagaaacagaagactcgaaacctataaaaagactccttttaaatggcagtgacttgacgtttggagggccacaggcacctttgagaagttggcggctgccactgtccacaaaaaaaacacgtacgcgtgcacacacaaacacacacacacacacacacacacacacacacacaacttcacttacagtttccgggcttgtgaccacccccaaacccgccaggcctatctctggctgggtgttcacacactctgggttaggacccctcttttataaagactgttcctcaatttgcttcttagcgtaaacacactctcaacctgacttgctggggctccggaagctttccctgggctccagtctgacctggctgactggggagtagctcagccctcagttgtaaggtgggaatcatcggggcggggtctctgtgcccttccctctgccgctgcacagccacgtcccagcaaatgcacgagggcaccagggcgtcagggcacaggctgcaggggtccaggcaggtgggccctgggaggtcctggggacaccagcttcatcctgcctgccactctgagacatccatgctcctgaccatctctccattgggaagtctgggtctgcccgccttccctcctcccagcaatctcagggcagctcatctgcctgcttactccaccccccgacactgaggtggtcagcctccacactttctgttcagacccacgggcaacaaaaacaaaaccttggccaagcactcacaatatcagatattcattaaaaaagtatatataggccgggcaccgtggctcacatctgtaatcccagcactttgggaggccaaggtgggcagatcacttgagctcaggagttcgagaccagcctgggcaacatggcgaaaccccatctctacaaaaaattaaaaaaattagctgggcgtggtggctgcttgggagactgaggtgggagaatcgcttgggccaggaaattgaagctgcagtgatctgtgattgcaccactgcactccagcctgggtgacacagcaagactccgtctcaaaaaaaaaaaaaaaaattatatttggagtacaactctgaatccatatgctaactattcataacattcttagcaccgaggctgtactgggcacccctccggagacgactggtctatgccaactttggcgggcggcagcagcacctggagagtcctgaaactccagtgccacccccaggcccgctccagcacgcggagttaggcggctgccttctaccaggctccctgggcaacgcccgctgtcattccacagccagaacatctttggtggctgcgtgggtcccgggatggaatgcagatgtcacatgacaagccagagccgtgacatttggccccaatctccttgtgggtccccctgaatccccaggctcctctttggcctactctgtacccagaactctcacctttcctggggcagttggtcccttggcttagaacacctgtgcacaccccaccctgctgccgctaaatgaccaggggttacggtccccagtgccgtcctccagatgcggcttcttcaccctcccttaccttgatttcttcactctgccctcccctcttgaaaaagaccatctgctgggtgcggtggctcaagcctgtaatctcaacactttgggaggccgaggtgggcggatcacgaggtcaggagatcgagaccatcccggctaacacggtgaaaccccgtctctaataaaaattcaaaaaaattagccgggcatggtggcgggcacctgtagtcccagctactcgggaggctgaggcaggagaatggcgtgaacccgggaggcggagcttgcagtgagccaagatagcgccactgcactccagcctggagacagagtgagactccatctcgaaaaaaaagaaaaagaaaagaagaccatcctagccatgcagccacttgccctccgtccctggtttgtgagcctgtgcgtgcaccgggggacagagagagtgtccagggcatgcacccctcctgcccctgccactgccacgtctgcctgtctttgcttccttcttatctcctcctccctgctgttgcatccctcctcgcagctgcctgggaagcctcgggcagacctctttgttgtttccgaacccaagacgttcacccctacacacgacccccactgcatcgagtcagtggttctgcatcaggactggagacggctgcccgcgcctctcagtctcccaggagtcatctatgccctgttctccatgtgctcagatgtcgccacagagtctgaacctctcagcccacaccagtggcatctacctagcaacctggctgcgacagcagggaggagggaggcagtacccaagcccacctgcagctcacaaacgacaggccaggactgcgtacgtggctctgcacccccagaagggtgcaaataggggaggcccgagaggctctgaggctggcactgtcctcagatcccagatagggagaaacgtgtgttgtccagagagctccttccagcacctgccatacctccaggctgtgcacagctctccctgctcttccagtccccctgccttgggagctgccagtaattcaggggtcagtgactcccctgacagatcctgtccctccaaggacgctgttcaaaaccaagccgaagagcctcagttctccccacagctccctcctcaacctaccatggggccttctatcctcacatcttgcaaatgcatttcacattgtcacatgattactcctgaattttggttatttcgaaagtttatctgttgttaattatttaccgaaaccacactgagtggactgactttataccacacctgggcagttgaggaggggaggcctgctcaccacgccgggcagcaggaacccccttccacaccgcctggtgccaagatgtaccaccccctgcatcccccaccacagggacaatgtcttgcttctcccttacatccccgggggcagaggcagccactccataattgcttgttgaaacacagacaagcccaatatgaaaatcaagatgaacaaaactgacaatacagatcgatcacatacttcgcacaacgagttgccaacagtttctttaaaaagcgccacgccgccccctcgcatggaaggcctgacccagctcacatgaatctgatgctgtgttgcttttcctgagcacgtgtcctgaagacagagccatttttgactgcgtgctgtgtgttttctggggtggcccctactatctgtctggtccctgtcactgtgtcccccaggaaccaggtcacccttggctgttcaccccagaaaatagcagttgttccccctcttggttgtggacccctctctagctggagctggagctcctcgggggatttgcagaggacagtttctggaggtgggaacatgtgaggaagatgtcatcgcagaggtcttctaggataatgtgtggccttaggtactgccacccaagccagaggagaggttttattctctgcatccagagagctcctggctttacccttgagtccagaaacgggcccaagcagcccgagtctgccaagtagctcagctggctaagtggctccaggcatgggactgcctgaatggtgagcccaaagctaatttccagccagatccctgtagctgtgcaggctggcagtagatgtgaaggatttcactgggtgagagggagccgggccagcagcgcatttgaacagtactgtaactgagacacaaaatgcttcccgtttgtgctggccttgctggaaaggacaaggacctggggccttccaggaagaaatcaggtcacctcttaccatcccttatcctaaacatcaccacctcatcatgaattatctttgccgaccacagttccggtcctaccaactgcaagagctgctagggagatacctcccagaaatcctcagccgggcagacagaaatctgactgtttcttaagccaattgcctcttgtagacaccaagccatttaacaaggctgcatgcagccaagagtaaaaggagccagcttgccacataacaagccagcctttattaacctccactgtaccccctttctgagacccctgggtcacagccctggttaaatcacctgtgggccttttaaaactgcaaaagccgaagtctgagcaagaccctctgtatctgcaaagggacctagacctgagcaatctttaagaatcttccaggcaattctgctctgagccagaatggggaaccattgctgagaaagtcacaaacctgcatcgcttcgaggagaatcgaacactggagaatagacaggccgctgtcgtccctgtgggatttgttccgggaccctaccctgggatgtcctgggttgtttatcccaagttggttgagcacggaaagggtgactgggaataagagaaggcagcctggtgtatgggctgaattacgtcccccctcaaatgcacatctagtcagatcctatgaatatgaccttatttggaaatagagtatttgttgatctatcaagatgaagtcatactggattagggtgggccctaaatccaatggctgctgtccttagaagaacagggcaatttggccgggcgcggtggctcacgcctataatcccagcactttgggaggctgaggcaggcggatcacctgaggccaggagttcgagaccagcctggccaacatggcgaattcctgtctctactaaaaatacaaaaaattagccgggtgtggtggcaggtgcctgtaaccccagctacttgggaggctgaggcaggagaattgctcgaacccaggaggcggaggctgcagcgagccgagattgcgccattgcactccagcctgctctccaaaaaaaaagaacagggaaatttggacacagagacacacgagagaaggccatgtgaagacaggcggaaatggaagtgatgtgttccttgaaaatggaaccaagcaacatcaaggagagaggcctggaagagattctccctcacagcccccagaaggaactggctctgtggacaccttttcagacttctggcctcctgagctacagagaatcgattcctgttcttttaagccctcccatttgtggtagtttgtcacagcggccacaggaagcgaatgccctgagctctgcagtgcaactctggcatctgactgggcctctgagccgggatggggtgaaaagttttagctacaggatgattttgatgcaaagatttagacacaaatgccaggcaacccagaagaggagagtgctgcgctgagcatgaaggaggcgggaggcacgcactgcagccctccaccctctgccatcctggatccacaccccacgcagaaacagctcccagctcagtggccgccttaacttatgccaagcaaggacagagtggctgcctggacattctcccacacagctgaggagtgtgtgtgtggggcggggtgggggggggggcgggagggggaggggtcccaaggcccaactcctacaaatccaactcccaggtccttttatccacagcctccttctgggccttggctacatcctgccccagcacgtgctggtgagccaaggagcctggacaggcctgcactcctcgtggacccccagagaaaggcccattatggctccctcatcaaaggaacctctccttcacccacaaatcttgctgagcaccaaggctaaactggagaaaagacctcatttcccccaaactgggttttgtggaaactgacacaggcacacaccaagccttccgcccaggtggcctgagccacctgagacctgtgatctcaatagattggtgcaactgaaaacttccccagctgggcacgcagctcctagggctaaccggggtggggcaagaagccgtgggcggggtatgggaagggcgtggctgacagcaggagaaacagaaagtcccacctccactctgggcaggtgagggggcccccgccttgctccatctgccctggacaggtcactcgactgagactcagacataagaaggaaggagggcagggggctccgagaccacctgccgtgtagccagacttgccccaggaaaaccatgctgaccagcaccagggctgcagaggcttgaggtgcaggaccagggtggaaacttcgagccagcgggttcctcccatttctgctggtcctccccctccatggatcagaacaaataactgggcccctcctgcctccctccatggcgcctgtcttttgggggctaggagtccggaggtcatgggtatttgctggggaatctgagcagcagcacagtcccacgtgccgggtccggtcaccaaagtctccagcttttgtggacgtcccgaaaaagcggaacattcgggggtcccggtccctgcccagccagtttgcagggcctcctgggcagggcgcaagcaaggagccacgccaggagacgccaccggctttttcacctgcccctctgggcctgtggaacctgcctcgggtagggcgggcttccatcccaccctggcttgatcggggagcccccaaatggggctggtgggagaagccccagcagagaagcccttccccacccagccccaagcccagagaagcccaactcccaccttatctgcgaaagtttcttcctggggtccccagtcctccagccccccgcccccacgccgtgtcccccacgctccccgcccccagcgctggcatcccagggcgcgccgcctgccaaaagccaaactggctccctttcctggggctggagctgcggcggaatttcggtggaattttgaggttgagacgcatctcggcaaagagagggaaagaaagggagaggagggaggggggaaagaaagtcggctctgggcgtccacttgcaggattcgagaaggcgccgagggaccaggaggcgggcgctggggtccctcggccagcggcgggcgggcggggcgtctgcgaaccctcggggtcgcgggggaggtggggccccgcgcgggggctggggtcgccgctccttacctacatctgcattgcaaaacgcctgttgcgggtgcaccggggagcagctgcaggcgtcggccgggcgaagcagcgtcgccagcagcaggaggccgagcgccagccgcagggtgcgggccgcggcgcccatggcgggccggggggctgggcgggcgggggccgccgctggggggtccgggcgctgctcgcggcggcgggctgggggcgcgggcgggggctgagccggggccgaggcgggcccctcccgcgcggctcaccctcctcacctgccccgctcggccgcgcaaactttctctcctctttgtctcgggggcgcgaggggaggggcgcggggcgcaattcgccgggcggggcggcggggtggggggcggcgggcgagcggcgctgcggttctcggcggccgcgctgccttctacggatgtgtttgctgcgggcttgggccgggccgcagttttattgcgctcggaggattttctgctcctcctcccggtggctggcggccaatgcaggctctgggcgctcccagcagccccctcctccccctccgcccgcgcctccccccagcccgcgcttttgttgtgcccggcctggcacgtcgggggcttcccgcaccacctggcgcccgcgacccgcacccgcgcgggggtccccggacgcccccagccccccgaccccggtccccgctgcgtggccttctgcgcccggggtccctgactcagcgcgggggactcgcgccccgttcttccaggacaccaggcgacccacccgctaccctttccccttcagctcgactctggagggctacgctgctccgtcccccgccaccccggggtcccttcgagcccagcctcggggcgagccaaggggtgtcctttggagcaggggccgttccctgtcgccacctccccgtttctgtgggcgggtggcctattgagaaactgacaggatccctttttcaaatggaggccttagaattttaagtgcgcctggccagtttagttggggggtggggggtgtggttactgtgaacaaaacaggattttatataaactggccatatttttgaccagccaacaagagacgggggtgggcccaggcgcccaggagccagtaggatcgcagcagaggcattggctgggttccgctcacagtttcctctcttagtccacaaatgtgggagccgaaggacttttcccaaaacagttttgtgttccaggaaagacccaggcatatgaagggatgaacatgtgtagggtggtgaggcgggcttcctggctgtgaacctgcctgtgcccggctgtgggcacccaccctgtacatttggtgtgtgccccgtggggctccatggacactgctgcactcaggtcagcactccagccctcaggtcagcattccagagtgtttgcagtccagctagggagagggaagcccaggaaaatgacacaggaagaatcagggcgggcacggtggcttgcgcctgtaatcccagcactttgggaggccgagacaggaggatcacttgaggccaggagtttgagaccagcctggctagcatttagtagagacagtgaaaccccgtctctactaaaaatacaaaaaattagccgggcttggtggtgggcgcctgtagtcccagctactcgggaggctgaggcaggagaatggcatgaacccaggaggcggagcttgcagtgagccgagatcatgccactgcactccagcctgggggacagagcgagactccatctcaaaagaaaaaaaaaaaaaaaaaaagcccgggtgcagtggctcatgcctgtaatcccagcactttgggaggctgaggtgggcgaatcacgaggtcaggagttcgagaccagcctggcggctaacacggtgaaaccccgtctctattaaaaacacaagaaattagccgggcgtggtggcgcgcgcctgtagtcccagctactcaggaggctgaggcaggagaatcgcttgaacccgagaggcggaggttgcagtgagccgagattgcgccactgcactccagcctgggcgacagagaaagactcttgtttttttttgttttttttttttttttttttaaaaagaattgcccactaaattgtgcggtgctgacttgaggtatgaaactttggaaaatagtgaaagaatggaaaaacagcttctttctgtttgtgtatgttttgtaacagacagttctgagaaaagttaaataagcaatgccgttatttttagcaccctgacaaatccaaagtcacttttttggtttttgttagcgtgaaatagagttgggtcgttcacaaaatgatgtttgaagctaacgtttaaaagtacagttaattcagaaaattgttatgtgctggctgccttcagccatttcatcgttttctttccttctttttggttacagggggaacaaaatgctgttgaacttgtgtttcaatttgtcagttcatgatagaaacaggtagcataggggctctcggtcttttagacaagctctacatataagtgatcaggtacatgttagggtgataaataccttagagcagttgtggtgctgacagccaagggggtggggccaatgtgggatgtacctgggaggaaaggggggcctgggctccagggttggggggcgtgagactggaacttccaacccaaggcctcgcacctgtatcctggactgccctccccgaagtcatccccaccagcacacaaacaggctggaattgctcccaggaaaagtgaagcagaaatcttgccaggtgcagtggctcacgcttgtaatcccaacactttgggaaactaaggtgggaggatcacttgaggccaggagtttgagaccagcctgaggaacatactgagaccccatctctacaaaaaaaaaattagctgggcgtgatggctcacacttgtagtcccagctacagggaagctgcggtgggaggatcgcttgagcctggggaagttgagtctgcagtgagccgagatcacaccactgcactccagccttggtgacagagtgagaccctgtctcaaaaaaaaaaaaaaaaatctctcccctcaattcccccaccagagagtactctacttttctgttccctctaccattatctcctccaaacaggtctctaaaccagaagtttccagctttcttttcctcccttttctcttggttctctctctctccctcctccctccatccatcaacaaatactcatttgagtatctgctgtagcctggacaccgtcctaagagtgagacattcagcgtctacagaacagaggaacatccctggaacagcaggtggaaacacgcaaggccccaaggttggacgatgctggacctggtggagcccatggtgtggcgaggagtgagaggaaggagggctgaggcaggaggccaggagcaggggctgggaggggacacggcggagggcagccaggctaccgggaggatgtgcattttgttctgagtgaggtgggagcctttggagggttctgagcagaggggcaggatcggacgcatcccctggaaggatgggactctggtgggtggcctgggtgggggcagggagcccagtgaaagggcaggtgctggagatgcagagactccagagtcacaaaacccctttctggtgcagtgccgtgaatggctgacctgcggctgcaaagtcagatgaagaggggactgaggtctgagggcccaaatgactctcccaagggcacagcagggaggggagaggacagtcccagcagccaggcctccctcgcagcccacagcccccagcttgctgacccagtcatctccctgctgcttggggccctcagggtcttggctcctgagccagcttctgtctcattaaccaccctccaccttctcttccagttagggtcctcacacttcaaaatcaaggaaactgaggcctcagaccaggaacctactgaagacagggagtagactggaatctggctcatggcagcacaaacccactttttctttcttttttcttttttttctttgtttgagagccggggtctcactctgtcacccagcctggagtgcagtggcttgatctcagctcactgcaacctctgcctcccgggctccagtgatcctcccacctcagcctcctttgtagctgggaccacaggtatgcgccaccacacctggctattttttgtattttttgtagagacacagcttctgcaagctgctccttctccttgtccttctctgtgctttgtggccaagagggcttgaccttgcaagcaaacttgaacatggggagggggctgccacccataagggaagtgacagggtccgcatgccccatgcccagggcaagagaggaaggaggaaggcagaccccgggctgggagctccctccactgcttcactgctttttttttgagacagagttttactctgtctcccgctggagtgcaatggcaccatctcggctcactgcaacctctgcctcctgagctcaagcaattctcatgtctcagcctcctgagtagctgggattacaggtgcccaccatcacacccggctaatttttgtattttaagtagagacagggtttcaccatgttgcccaggctggtctggaactcctgagctcaggtgatccgcccgcctcggcctcccacagtgctgggattacaggcgtgagccaccgcgcccaacccatggcttcactcctaaccagcccccttcacttctcatcttgatattggtgggtggactaccatagggaccataagcgacacccagcccagatgcagcctgggggaccctggcttggatcagcttaagagcagaggctctcagcctctcaggacagacaggagcacgagggagccctgtgaagtatgggggtgatttcagggccctcagaccacgctccaggggccaccgcttcccacgaggaacatcgtcttgctcccccaccccctcaaagagaccttcctggcagagagcacagcagagctgtcaggcgtgtgtgcaccctcgcctgaacacaccaggcgaacacctcccaggctggacctgatgaatcctgtccggggccggaggaagtgccaaggcctcctccctgtcgctcccgtctcaggccaccaggcaggacgccctccctgctgcgccgggctggcgggaggatgctgctcttctcggtggcctcgccctcccagtctggatgagagccatcttcccctgagcaggtcacgttctctctgtggagacagcttgaacggacccgaagcccccacgttctttctggcaggttcctagagagccagatgttctcatccagagacagcatggacgttggccccacacacccgggaaattgaccccctgccgatggctggaactccggccctcaggggagtgtccagggcagtctcaggggcagggagccggcagctgtagaggaaggtggggaccgtgtctgagtctggctgtctgggaggtgacacttcagtcaggtgacacgtggctgtcaagagtctgaggcccggctggatgggcaggcagcccatctgtgcctccccatccagccgggtctcagactcttggtcacaatgggcacccagcccacgtgtccgtccccaacatccactggtggggctgttcaccacaggacatcctgaagatgacaagaaggtgagtcaagagtgatggctgggcgtggtggctcacgcctgtaatcctaacactttgggaggccgaggtgggcagatcacttgaggtcaggagtttgagaccagcctggccaacatggtgacaccccatctttactaaaaatataaaaattagccggaattcacttgaaccagggaggcagaggttgcagtgagccaagatcctgccactgcactccagcctggtcaacagagcaagactcaatctcaaaaaaaaaaaatagagtgactgggacccactgtgcttgagacaagatacacaggcagcatgagcggctcatcgtgttctatggtggacgtgctgaagggcatttcaacatggatttcattagccatcttctttaggggccgggcttctccgccttggcacagttgacatttgggccagatccctctttgtggggggctgtcatgggcactgtagggtgttcagcaccatccctggccggacccactggatgccagcaccctctccaattgcaaccatcaaaaatgtctcaagacattgcaaaacggtcctggttggaaaccactaacaaaccaataaaagtctttggtcctgagcaaagcaaggtgcagagacataggaacaaacaggttctatagagaacaagaatgcagatgggagagtgaaggtccccacagcctggagaccaagacatgcaccatgctgccgacaccgattgtcaggggagagaggccaggcacagaatagaattttttttttcttttttgagacagagtctcgctctgtcgcctaagctggagtacagtggcacaatcttagctcactgcaacctccacctcccgggttcaagcaattctcctgcctcgccttccaagtagctggtattagaggttcccaccaccacgcccggctaatttttgtgtttttagtggtgacggggttttaccatgctggttgggctgatctcgaactcctacctcaagtgatctgcctgcctcggcctccctaaatgctgggcttacaggcatgagccaccgcacctggccgaaaaagattttttataagtgtccatggtatggacacagtgtcttgcacctgtaatctcagaactttgggaggctgaggcaggaggatcacctgacaccaggagtttgagaccagcctgggcaacacagtgagaccccatctcgacaaagaattaaagaaattaggtggtcaaggccaggtgcagtggctcatgcctgtaatcccagcactttgggaggccaaggaagctggatcacttgaggccaggagttccagagcagcctggccaacatagcgaaatcctgtctctactaaaaatacaaaaaattagctgggcatggtagcatgcctgtagtcccagctacccgggaggctgaggcacaagaattacttgaacccaggaggctgagtttgcagtgagccgagatcgtgcctgtacactccagcctgggcgacagagcgatactctgccaaaaaagaaaaggaaaagaaaaagaaagaaagaaattagctgtgcatggtggcatgtgcctgtagtctcagctttttgggaggctgaggcaggaggatcacttgaacccaagagttcaaggctttagtgagctctgattgggtcactgcactccagcctgggcaacagaacaagagcctgactcttaaaaaaaaaatttccataataaacagcatgtataatacttcatatatgtgaagtcaaatatgtgagtggatctagaaagaagtatacaggccaggcacggtggttcacgcctgtaatcctagcacttctggaggccacggcaggaggatcgcttgagcccaggagtttgagaccagccaggacaacatggcgaagccccatctctacaaaaaatacaaaaattagccgggcatgctggcacacgcctgcagttccagctacttggcaggctgaggcaggaggatcactcgaacccaggaggtggaggttgcagtgagccgagatcgtgccagtgcactccagcctgggcgacagagtgagaccctgtctcaaaaaaataaaaaataaaaaaaaagaagcatacaaaggtgttcacagaaaggttagtgggtgcgcctgggcaatgggaactcaggtaggtgggtgtcttctgtcctgttccgtgtggagcaggtaatgtaatattccgatgagggtccggccctgaaatgggcaggcctgggggaaggagcacagatgtttcccaccctttctgtataacactattaaagccttcttggccacagccatcagggtttactttttaaagatcctgctccaccttccagccactcttggttcacgcctccctttggttttcttgtttgcttgtttttgttttgttttttgagacagagtctccctctgttgcccaggctggagtgcagtggcacaatctcggctcactgcaacctctgcctcccaggttcaggcaattctccggcttcggcctcccaagtagctgggactacaagcatgcaccaccacgcccggccttccctttgggttttgtttggcagagtctgttgatctatttcatgccatcccacaggccatctttgagaaggtgggactttggcctctctccgtcacttccatctcctgtcaccccaacctaccgcccctccgcagacaggcacccctcagggcaaaagcagccatgagccagggcacctccctttagcaaacctgcttggattccagcctctgcacaccccttgtgcccggcacaaccttcacagccccaggcagcagccccaaagccagccctgttgccctggtcaagtctctagtgacaccagaaagaaaggaggagaggcagagaggttgtcctggtggtaagcaagaagcccatgacatcactggctctacagactgccacgggtaaacagcttagaccagatgactcaggctgaaagcatatgaacccttcctgcagggaggccgcccggatgcaacagtggtttcacccctgagccgggcagccttggcagaccttgcttcacgtgggctgaaatggcagtgtctctcctctttgtggccaggttttgcctcctctttgactcggaagcatctcctatcctgcaaggacagtttgagcagggcccccgggccctccttccaagaggcttctgcagctgtggacccccaagagtttatgccgctgagctctgctgtctctccccacctgctccccacctgtctgcccccacacctgcgactctggctctcctggatcctcctgtagactggttcctataagcacaaggaggaacatgcgagatgctgggattggatgctctgggcctggggctggtgtttcctcatgcccgggctatttccttttggccctgggcatgcagtcatgtgcttcctttcatgggcgggttggggaccagggccagcgagcagagacggtccccagggcttctccatcactggctctccccaggaagcagcctcagctggcgtgctggggaccggagctggccatgagggaggggtggacagtggaggaaccggctgcccagctcagcagggatttgtggaggctgacttgcatggtttcgggtttgccttgcctggaagcctggccaggggaggctcaggtttctcgccagctggccttcctcctcctcctccgtgtgagtgacgccccatggccatgatgtcatcacctcgtacaaacagaagggagactggcttggcggagctggcggctgtcccatgctgagtgcagcagtaaatttcatttcaaggctatgattaggtctgtgcccaagaatgtcccctctctcctcccctctccccaggcctgtttttctctctctgttcctgtcccgcctgcttttcctccttgccctcccctctggtccttcctctctctcctctggggatgcttcagtttctctgtgatatggaccctgtggccagcagcagcatcaggcccgagccagactctcattacctccagtttcaaactcagcctcacgtcctctggaaccggcttcctgaagcctgggacaggtctgagtccctggattcctcctggggaggatgggttggggtgaggggcagagttcctgaaggtcctcattcaaccttgagctggagtgctggacagcaggaagagcaggcttgggggtggctgtggtcactaccaccgagatcagaggcagtgaggcaggagaaaggtgagaaggagccaagcttcttggaaagcgattcagatccttctcgccattcccagctggtttctggagatttgagtctgactcgttaactcactttttggcatggccacccttcctctcagcccccagagggcccctaggctctgtggacacctgtgacagccctgtcacccatcacactctgccttgcctcttgcgtgactggctaccctggttctgtcctggtgctctccggcccaggaacaaggctgacggctcgtcacccctcagcgtcccctgcattcaccggcccctgcttgcctcccctcgaaggtgccacccagccagagccgtgttgctgtggatgcccatgaggaaggctccgatgtctgggcaggtggtgtcccaccgcacctgcactgggctgggctccctgctggggtagagggtgctctgggtcgctgtcggtgctgcctgtcctgtgggactgtggttctgaccccttgaaggaggtagcagaacgccctagatgtggc

SEQ ID NO: 1327 - DNA, 163868 bp, Homo sapiens
cccaggttcataacattctcctgcctcagcttcccgagtagctgggactacaggcgcccgccaccacgcccagctacttttttatatttttagtagagacggggtttcaccgtgttagtctggatggtctcgatctcctgaccttgtgatccacccaccttggcctcccaaagtgctgggattacaggcgtgaaccactgcggccggcctaaatttgttttaaaagtacgcataggaaggctgggggctgtggcttatgcctgtaatcacagcactttgggaggccaagacaggcagatcacgaggtcaggagatcgagaccatcctggctaacacagtgaaaccccgtctctccaaaaaaacaaaaaattatccaggcctagtggcacacgcctgtagtcccagctacttgggaggctgaggcaggagaatcgcttgaatctgggaggtggagggtgcagtgagccactgcactccagcctgggtgacagagcaaactaggtctcaaaaaaaaaaaaaaaaaaaagtacatgtgggggacaggtgcagtgtctcagcctgtaatcaatcccagcactttgggaggctgaggtgggtggatcacttgaggtcaggagttcaagaccagcctggccaacatggagaaaccccatctctactaaaaatacaaaaattcgctgggcgtggtggcgcacgtctgtagtcccagctactgggaagactaaagtgagagaactgcttgagcccagaggtcgaggctgtggtgagcggtgatttcaccacttcagtctagcctgggtgacagagagagaccctgtctcatataaacaaataaataaaagtttatttatttattacacatatttattacacattattacaagaccttgaactaacaacattaacatgcatttgttaaaggaaaataaattagctcagatgctactacttttcataatacttgcacgattgatttcaatccctgttcatctgaatggagagttgcaggtatactatgcagctattctacttatattctgttttttaatgtaacagtattatttcttgatgtctctacacattttatatcactttaatatttaataaaaacatctaccataagttctaaaatggtaaaaggaagaatagtcattagtactgtcactaccctgaatgaatacaaatacagtttgcactagggcttattttgctcctgtcctttgcctgtgcatttcatttttgcatcgtggtaatcatactgggtgaattttgtattctgtaatttcaactgaatattatatcataagtgttatctacaagttccatgaggaccaaatcttctccacctttttcaccattttacttagcatggtatagtaaagctggctcaataaatatttgctgattgaataaatgttgttacatgctcttcctgattaacatatatatacgcatatacaattttttagtgactgcattaatttacttcattttttcctaattgttggatatttcagttgccatttttttgcttttatgaataatgtgttgatgaaaagatttgtgcatatagttttctctgcatttggactattgtctttttttttttttttaaagatagagtcttgtgctgtcactcaggctgcaatgcagtggcgcaatctcggctcactgcaacctccacctcccgggttcaagctattctcctgcctcagcctcctgagtagctagaattacaggtgcccacgaccatgcccagctatttttgtatttttagtagagaaggggtttcaccatgttggccaggctggtctcgaactcctgacctcaggtggtcctcctgcctcggcctcccaaagtgctagaattacaggcatgagccaccaacgcccagccttgactattgtcttaagatagggtgaaattacaggatcaaatgatttggacagttttgcaagtcttaatgcattttaaattaaaatgctttttaaaaaagctgggacagccaggtgcggtggctcatgcatgtaatctcaactcaggaggctgaggcaggagaattgcttgaacctgggaggcagaggttgtggtgagctgagatcgcaccactgcactccagcctgggcaacaagagcaaaacttcgtcttaaaaacaaacaaaaaaagctgggacagtttacaatgggcaatagccatgtaccagctttaccacaccttcacctgccctggtttttttgttgtgtttttcaattgttgttattgatttaagtgaaagaatttttttttttttttattgatcattcttgggtgtttctcgcagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcaccacccttaatccgttcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccaccgttcccccctttctattctacaaaaccgccattgtcatcatggcctgttctcaatgagctgttgacagaatctcgctctgtcgcacaggctggagtgcagtggcgcgatctcggctccacctcccaggttcacgccattctcctgcctcagcctcccgagtagctggaactataggtgccgccaccatgcccggctaagtttttgtattttagcgtagagaccgggtttcaccatgttagccaggacggtcttaatctcctgacctcatgatctgcccgcctcggcctcccaaagtgctgggattacaggcgtgagccaccgtgcctggccaaatgaaagaatttttaatcaattagcctacttatataaccacagtttacatcacagggatactctgccaaataaatactcattaaaatgtgagcccattattttggtcatgtccctattatctctactattaccctatggataataagcaaagttgcaattcagctgtatctctaatttcaattattaacctatacgtataaataccagttgtattattacagaactatattattgttcacaactctttgaacatcacaatgagtaagtttttacattacgcactatcagtaatattaccttcattttctatgaaggcatccaatgaatatatctatgtgtatgtctatctatatctatatctgtatagctgtggctttctcactggaaattcataggtaatcccaacttcagagaaactatgcttttctatgtgaatttaaaattagttgtatttgccagaggcttaaataaaactacagtgatctttggactgttaacaaatggctaacacaaaatatttatttatgagttgtttgctaaagtccaaatgccataaagcaaacagtatgccacttacttgaactgatattttcttagaaaaactttttaaagatggctttaaaagagaaaaaaaaagcttgttaaaaatgtcttttaaagccattctagccatgaatctagaggtaaccactgactctaaactccatggagatttgtaaattgaatgacttacaacatcatgtcaaagtagagtggactgtaaagtgtgttaaagaggaccaaagtaatctttcacccagtgattgctgagcatggaggagggactgtcgttggctattcctctttcctttcttctcaacacctgactggtagtcacaggtcgggtgtttacctatttgtgccactgctcagagagaaggtggagcttcctgggaggagggacccaggttttctccaggctcaggagcagccctgccctcaggccaggcaggtgtggctggggaggggtaaggagtgccaaaagagcactcagcagtcatgtgacccttgtgaccttggccagcctgtttctgacaggtacagctgcccctatttagtcttcaggaagtaccagaacaccctaaaagcaacctctcactgggtccccttcaagactttctccatcccattaggatccctgcaagtgtcagccagtggtaactggcagatcttctagtccaccccattatgtttattttactgtatttggcttttaattaaattcaaaagagtacattattaaaaagtacaggtgtgggctgggtgtggtggctcaggtctgtaatcccagcactttgggaggcagaggtggatggatcacttaagcccaggagttggagaccaccctggccaacatagcaagaccctgtctccattaaaaataaataaatagccaggcgcggtggctcacacctataatcccagcactttggggggctgaggcaggcggatcacctgaggtggggagttcaagaccagcctaaccaatatagagaaaccccgtctctactaaaaatacaaaattagccaggcatggtggtgcatgtctgtaatcccagctactcgggaggctgagacaggagaattgcttgaacctgggaggcagtggttgtggtgaaccaagattgcaccattgcactccagcctgggcaacaagagtgaaactccatctcaacaaacaaataaataaataaataaagtacaggttcgtcttcaccactgttcccttactcccctaaataacgtctctcacctttccagttaaccactgttaaccaagatgctactcctctttccagcctttttcctacttattagcatatatgtgtatttactaaataaacaggtcaaactatatgtattgttttgcaaattgcctttttccttaaccatgtgtcttgaagaactttgcatattggcccatatggactagcttaccatttttaactaatggagagcattctttagagttggctggcagaaatacactaaaaagttgtgacccccaaatcaggaaaagccactaaagacaactaaaattcatttcaattcaatccccctccccaagtctttttttttttttttttttttttttttaagacagagtctcgttctgttgcccaggctggagtgcagtggtgcaatctcggctcactacaagctccacctcccgggttcatgccgttctcctgcctcagcctcctgagtagctgggactacaggcgtccgccaccccgcccgtctaatttttgtattttgtttttagtagagacggggtttcaccttgttagccaggatggtctcgatctcctaacctcgtgatccgcccgcctcggcctcccaaagtgctgggattacaggcgtgagccaccgcactcggcctttttttttaacatctgaaaacatatagactttaattacattttgttgaaaattcatgagccgggcacagtggctcacacctgtaatcccagcactttgggaggccgaggcaggcggatcatgaggtcaggagatcgagaccatcctggctaatacagtgaaaccccgtctctactaaaaatacaaaaaattagccaggcccctgtagtcccagctactcgggaggctgagtcaggagaatggtgtgaacctgggaggcggagcttgcagtgagctgagattgcaccactgcactccagcctgggtgacagaccaagactccatctcaaagaaaaaaaaaaaaaagaaaattcattcaactttggtgcttatccaaggacttataatgtaaatttctgacataaatcataaccctcagtacataatgtattttcaaaggaaacaagtcatcttaaagtaatatttttctatatgctaattgatacatttttatagtaaattgaaaattatgagtaaactgaaagtatgcttaacaacaaaataaatacagcatatatggttagcatatacatttcttagtgtaaaggcagcagtgaatttgtaccttacaacaaatctgtaactccagtagctttttttctggaatttatatggtgtctcaccatgttccacaatgctagaaaagtcttttttggcatcaatctatgcaaaaatttctgacattttccccaaatgacatgtaacttttttttaacttttccagaaaaatatggaaactttatcaaccacttcttaactgaacaaaaagttagagtactaccaaatgctcttttaattttgctctaacagatgttttaaaagttcagacatcgctgatgtttttaaggataactgcataaaacacactagatgattgctaaggatgaatcttagtatctgactcattcgagacatccttagtatccagaataaaatcagtagaaataaaagtaatataattttcaaagaattcatacatactggaagtcttagaaaaaccagcttctaaatgcaaggactaggagatttgcccatcgtactattaatagttacatacatttctcctcatgaagtaactgaagatttctggcttgtttgtggaactttagtttgtaggaaagcatattcatagggccaaatcttgttggtttctgttccagagaatgtttccaacaccccttttttctggtaatattccaggactggctttgtttgggtttcatgagcctttagtctcttgataaccgtctctggtttatcatcctcacgctgaatgagaggctccccagttagatcatcaatgcccacagttttgggagggttgaattcaatgccgtagacttggccactggtgggatgaatccccaaatttttatatagaaaaaatttcagccggacgcggtggctcacgcctgtaatcccagcactttgggaggctgagatgggcggaccacctgaggtcgggagttcgagaccagccttaccaacatggagaaaccctgtctctactaaaaataaaaaattagccgccattgtggcacatgcctgtaattccagctactcgggaggttgaggcaggagaattgtctgaacccaggaggcggaggttgcagtgagcagaggtcgcaccattgcactccagcctgggcaacaagagcaaaactctgtctccaaacaaaaaaaagggaaaaaaaaaaaggaaaaaatttcaaacataccaaatagtggaaagactaataaatgcccatatactttccactaggttgttaccacattcattgactgccattaatatctgatagggttttgtggttttaacatgagaagtatatgaaaagaagcagaactcatcaagtctcaaagtcttaagaattagaaagaaaaggcgcggtggctcatgtctgtaatcccagcactttgggaggccgagatgggcggatcacctgaagtccggagttcaagaccagcctgactaacatggaaaatcccccgtctgtactcaaaatacaaaattagctgggtgtggtggcgcatgcctgtaatcccagctattcgggaggctaaagcgggagaatcgcttgaacccaggaggcggaagttgcagttagctgcgattgcaccattgcactcgagcctgggcaacaagagcacaactctcgtctgaaagaaagaaagaaagagagagagagagagggagggagagaggaaggaaagacattatcaaatcataagagccaaaggaatgtaaaatccacttaatcgacctgggtggaaggtacaaatttctatgggtagaaaccaaattagtaatcctgggaggtgggctatatggttacccctttttgaaattatgaagcgatttaagtacaaacagggtttggtgagttccagccagatgtacttgctggtagctgtgcaacttcaaacatacttagaatgcaaaatccacaaattactggaatgatacatatatttgcttagtgagtgaaaagaagactcactcctatggtatacaaaatctaatcttgccgtcatctgaaatcttttctttaaagttcactaacaaagtagttgtctggccaagagtggtggcccacgcctgtaatcccagcactttgggagacttaggtgggtggatcacctgaggtcaggagttcgggaccagcttggtcaacatggtgaaatcctgtctctactaaaaatacaaaaattagctgggtgtggtggtgcatatctgcaatcccagctactcgtgaggctgaggcaggagaattgcctgaacacgggaggcaggggttgcagtgagccaggatggcatcactgcacttagcctggatgacagagtgagtgagattccatctcaaaaataaaatcaaaataaaataaaataaaattgaaggtaatcatccacctaggaggtgggcatctttttatccaaaggaaaatttatatatttatttataaatacataaaaataaaataaataaataaataaaaataaattttccgtgtcaggcatggtggcttacacctgtaatcctagcactttgggaggctgaggcgggcagatcacaaggtcaggagttcaagaccagcctggccaacatagtgaaaccccgtctctattaaaaatacaaaaattagctgggcatggtggcccatgcctgtagtcccagctacttgggaggctgaggcaggagaatcacttgaacctgggagttggaggctgcagtgagctgagattgtgccactgcactccagcttgggcaacagagtaacactttatctcaataaataaataaataaataaataaaaaagaaatacagctatatccaacaaccagaataaatcttggaaatataatttgcagtgaaaagagctggttgcagaagactacatagagtgtgattccatttttataaagaagctcaaaaccaagctaatccaaacaacatattgtttaggaagacatacatgtttgttaaaactgttttttttttttaaatgaatgcataatttaggatggtgattacctcgaaatggatggagaagatgggtttaggatttggaaggcacatggtagctttaaaagcaatggcaatgctttatgcataaattgtttggtgggttcatgtattcattttattatatactcctaagcttacagagatgttacttattttatatatatcaaatattgtataataaaatgtaagtgaaaaaatgctacttttataaaatggaataatcaagcaaacatgttaagttaaaacctagagaaagggttttagacttgtaactttaactaattggatactcattttggaaccaaagcaaacatctgaatagtccatacagaaaaacatttaacacatcatatagcgtaacattgtttatcctgccattcttttggtggctaaaaatgtaattttaatttttgctatttcagatacacaggaataagcatttttgaacttctttccttcttttttttttttttttgagacagagtttcactcttgttgcccaggctggagtgcaatggcatgatctcagctcactgcaacctccacctccggagttcaagcgattctcctgcctcagcctcccgagtaggtgggattacaggcacctgccaccatgcctggctaattttattattattattattattttagtagagatggggtttcatcatgttggtcaggctggtagcaaactcctgacctcaggtgatccacccgcctagcctatctttttcaatacttgtgtaagtattgttttttgagatagatgcttaagaatggagtgctgagtcaaagggtgaggagactgaagtgagactcggagaagttaaatgcataactcacatcacacaggcagcaggtggcaaagccaacagggctccttttggggctccacatcacccccattacaaagaaaacgatggttctggccgggcgcggtggctcacgcctgtaatctcagcactttgggaagctgagacgggcggatcacaaggtcaggagatcgagaccatcctggctaacacggtgaaaccccgtctctactacaaatacaaaaaaattagctgggcatggtggcgggtgcctgtagtcccagctactcgggaggctgaggtagaagaatggcgtgaacctgggaggcggagcttgcagtgagccgaggatcgcgccactgcactccagcctgggcgacagagcgtgagtccgtctaaaaaaaaaaagagaaaacactggtcctgcccagcacggtggtgcctgtagtcccagccactcaggatgctgaggtgggaggatcatttgatccctggagttcaagaccagcctgggcaacacagcaagaccccatttctaaggaaaagaaaatgaaaacattggtcctgtcaaaacgagtgctccactttccactttgatttgactctttcccattcttgtttgcccagactgcaggtgaagctcagtattgatttcaggacctcaggatacagaacacaagagctccctgtcacgagaggcacagaatagagctttgtctcttaaaaaggcttgattgcttctacgtgactgtcttgctgccagtggcagggagggaggctttgctgagcaccaagtcagaactcagagttcctgcgccatttttcatagtgctgcccttgtaacccaaggaggcgtcccattttatttccctgggcagattttgcaatgctcagtcgtcaaaatggaaatgtttattagctacggaaaatgctgttttgctgattacagaaaaacacagacaaagaaatacatacaacatggacctacaatgacaagaaaaacaaagatgtcagttaccacctatgcttgccagagtccctgtcttcctatctgaacacattccagaacaatccaattcttctttgaaatgttcattttatttcagatacagaaagaaattaaacaagattgggtgcggtggctcatgcctgtaatcccaggtcttttgaaggctgaggcaggccgatcacttgaagtcagaagttccagaccagcctggccaacatggcgaaacccccatctctactaaaaatacaaaaattagctgggcatggtggcaggtacctgtaatcccagctactcgagaggctgaggcaggagaatcacttgaacttgggaggcggaggttgcagtgaactgagatctcaccactgcactccagcctgggaaacagagggagactcctaaaaaaaacaaaacaaacaaaaaaaaaaacgccaggcgcggtggtggctcatgcctgtaatcccagcactttgggaggctaacgcgagcagatctcgaggtcaggagagatcgagatcatcctggctaacgcggtgaaaccacgtcgctactaaaaatacaaaaaaatttgcccggcaaggtgacaagcgcctgtagttgcagctactcgggaggcttaggcaggagaatggcgtgaatctgggaggcggagcttgcagcaagccaagatagcatcattgcactccagcctgggcgacagaatgagactccgtctcaaaagaaaaaaaaaaaaaaaaaaaaaagccaggtgcagtggctcacacctgtaatcccagcactttggggagggtgaggcgggtgaatcacctgaggtcaggagttcaagaccagcctgaccaacatggcgaaaacccgtctctactaaaaatacaaaaattagctgggcgtggtggccagcgcctgtaattccagctactcgggaggctgaggcaggataatctcttgaaactgggaggtggaggttgcagtgagccgagatcgtgccattgcgctccagcctgggtggcagagtgagactccgtctcaaaaaaaaaaaaaaaaaagaaaaattaaattagtatgccactcagacacaggtagtagcaacatcaactctatatactaaatcagtggtatgtgaataaaacatgccattaaataattttcctaaaatttttaccaacttagagaatatagaatttcttcaaatatctcataatttttcctagagttttttttttttaacccaagacccaaacaagatttacacattgtatttcactgatctctcttaagtattttagtctgtaggtttctcctccatctttttttttttttttttttttttttttttgagacggcgtttcgcttttgttgttcaggatggagtgcagtggcacgatctcggctcaccacaacttctgcctctcctgcctcagcctccagagtagctgggattacaggcatgtgtcaccacgcctgactaattttgtatttttagcagagatgtggtttctccacgtttgtcaggctcgtccccaactcctgacctcagatgatccacccaccttggcctcacaaagtgctgggattacaggtgtgagccaccacgcccagcctcctctatcttttttaatgccttgctgcatgttgaggaaactgggcgatttttcttttttctttttttttttttttttgagactgggtctcactctttcatccaggctggagtgcagtggcacgatcacaactcattgcagcttcaaccttcctaggctcaagtgatcctcccacctcatcttcccaagcagctgggaccacagcatgcactaccacatctggctaatttttttttttttttgagacagggtctcactattttgcccaggcttatcttgaactcctgtgctcacgtgatcctcctgcctcagcctcccaaagtgctgggattataggcaggggctatcacacccagcctgagtgatttttcttttagagttttttacatcctggacttcatttactgtacctagcagtagtgtagtgttgtttaacacattcctctatttcaagagtttttctaaacagttaattggatctagatgctgggtcagacactagtttgctctttttggcaagaatatgtcatttgtggttgtatatttctatcagatggtacataatgcctggtgatctccttttctgtgatgtgagtggctattcaatgaccactgcctggatctgttattttattagagttttacaaaatgctggtaattcaaatgtcattccttatttattgactgacataattccctcatcaagtcttcagttagttactctgagatacaagtggtacatacacatcttagcttgggtcttccaggaagcagagcctagagacaaaggcttgactggagaatgtggtgatcctagggaaagaagtgagggatggggaagcaggagagacaattcaagggagcctcactgaataggctgctgcttcaggttcctgaatggttggctgtgtgtgaccatatgagttgtatagaatgagtctcgggctccttcatcttgcggggaaaagggaggaagttttatcagttcctgtcccccactcgttaaaggttagaccatgaaacattaactcccccacacttcagggtgctgggttcatgggcaccctgatagcttccatagatccccacactgtcattaagagagaacccctggaatgggaggtaagaggtaaggattttttttgttttgttttttgagttggagtcttgctcttgtcacccaggctggagtgcaatgacacgatctcggctcactgcaacctctgcctcccgggttcaagcgattctcctgcctcagcctccttagtagctgggattacaggcacccaccagcctaggcctcccaaagtgctggagttacaggcatgagccactgtgtctggccaaatggtaaggttttttgttttttggttttttttttgagacggagtctcgctctgtcgcccaggctggagtgcaatggtgtgatctcagctcactgcaacctccgcctcccgggttcaagcgattctcctgcctcagcctgtcaagtagctgggactaacaggcgcgcgccaccacgcccagctaatttttgtatttttagtggagacggggtttcaccatgttggccagggtggtctcgatctcctgaccttgtgatctgcccgcctcggcctcccaaagtggtgggattacaggcatgagccaccgcacccagccaaccaagtggtaaggtttttaagggttgtccctgcatgaagtggtcagagcccccctggaacttgctgctgcagtagtggctggaataagataggtaaggccaagaagatctgaaatggtacataagaaatgttagatccagaaaaggcaggcaaaatgtgcaattcttttcctttatttaccatttgccagctttcaaaataatgaactagttctattgtatttccaaagttgagcaattaagatttttttaaaaatatcattatgactcatggatatacaaatatttgatatgtctcaatttattgctgtgatttttcttattgatgctcaaatttattccactttggccagcaggagtttctacaaattggttccagatgacatttcaaataaatttgtttctgagcgcttccttgctttctgaattggcaagatattccaggcttatttggcattcatcttactctagacctattatcaaccatgtctccaaggataagtagatccttttaagggaaaatggtattttgaaagcatagtgtgggatctgaggatacctattcctgtcaggttggttattgtttgttttcagtgagtagatcttggactttattaattttatttatttattttaagaaaagtacatcatgagttataagtaataattccaactcaaattttaatattgcttaacttctttgattttatatttatcttttacactgaaaagtcttggctgggcatggtggctcaagcctgtaatcccagcactttgggaggccgaggcgggcggatcacggggtcaggagatcaagaccacctggccaactggtgaaacctcgtctccactaaaaatataaaaattagccaggcgtggtggcgggcacttgtagtcccagctacttgggaggctgaggcaggagaatggggtgaacccaggaggcggagcttgcagtgaaccaagatcatgccactgtactccagcctgggcgaccgagcgagactccgtctcaaaaacagaaaaaaaaaaaaagaaaaaagaaaaatattgatatctaaggatattaacataattactgctaacattatgattattcaaaaaggttatagttttttttcttaaagttctctttgtccttagttatatccccaaaggctatagagtcaaataattgtggattttcttgttcagtcatccaggctgaagtggagttcagtggtgcgatctcggcttactgcaacctccacctcctgggctcaagcaattctcgtgcctcagcctccacacttggctaatttttgtatttttactttatttatttagagatggagtctggctctgtcgcccgggctggagtgcaatggcatgatctcggctcactgcaacctccgcctcccggttcaagtgattctcctgcctcagcctcctgagtagctgggattataggcaggcaccaccacacccggctaatgtatctttagtagagacggggtttcaccatgttggtcaggctggtctcgaactcctgacctcatgatcttcctgccttggcctcccaaagtgctgcgattacaagcttcagccactgcgcctggccttattttttgtatttttagtagagatggcctgttgaccaggctggtctcaaactcctggcgtcaagtgacctgcccaactcagcctcccgaagtgctgggatcaagagcatgagccctttgtccagcccaaataattaattgcgtctgtgtgtggttttttgttttcttttgagacagagtctgcctctattgcccaggctggagtgcagcggcctgatctgggctcactgcaacctctgcctccctggttcaagtgattgtcctgcctcagcctcctgagtagctgggattacaggcatgtgccaccacacttggctaatttttatattttttttagtagagatggggcttctccatgttgaccaggccggtctccaactcctgatgtcaggtgatccggccagctcggcctcccaaagtgctgggattacagggtgagccattgctcctggcaataattgtgttttaaaatcactttatataatttctcttcacactgttaagctaccaacttgataccagcattcatgtgttgcattttgctttttttaaatttaattttgtttcataagaatgtaaaaaacatttatatcattccaaagtcaaatccacaaaacacagtatattcttttttttttttttttttttttttgagacggagtcttgctctgtcacccaggctggagtgcagtggcgcgaccttggctcactgcaacgtctgcctcccgggttcaagcaattctctgcctcagcctcctgagtagctgggattacaggtgcccaccaccatgcctgggtaatttttttttgtatttttagtatttgtaatgattttgtatttttagtagagacagggtttcaccatcttggccaggttggtcttgaactcctgacctcatgatccacccgcctcagcctcccaaagtgctgggattacaggcatgagtcaccgcacctggccaaaacatggtatattctgagaagtctagcttcgatccttgtccttccatcctggtccctccctcccttataggtttccattttatttaataatttatccttccaaaaaaaaaagcaaatgtacttacgtgtgtttctgctttcctaggtaaacagtagcatcctacatacgcttttattactttgttaataccctagtttctgacaaattattgttcatctttcttaaaattgcagtgttcttcaggcttgatcttccctcttgttgaaataagttgttgatgggtatcatcagaagtctaacctaaatgaaaatgagtttttgtttttgttttgagacactgtcttgctctgtcaccaggctggagtgcagcggcacaatctcagctcactgcaacctctgcctcccaggttcaagcaattctcctgactcagcctcccaagtagctgggattacaggcatgcaccatcacgcttggctaattttgtacttttagtagagacggggtttcaccatattggccaagctggtctcgaactcctgacctcgtgatctgtccgccttggcctcccaaaacgctgggattacaggcgtgagccactatgtcaggcctgaacctgagttttataaaaagtactgttatccattctattacttctggcaaaagtttgcgtggggaagagtttggcagtcctaagcaaagttgtctggcgtgagtgatggcatcgatacccaggattttgtgtgtgtggtaaaatgtacatggcataaaatgtaccgttttaacttttttattttttgtttgagacggagtctcactgtgttgcccaggctggagtgcacagtgcaatggcaagatctcggctcactgcaacctccgcctcccaggttcaagcaattctcccgcctcagccttctgagtagctggtattacaggcatgcgccaccaggcctaggtaatttttgtatttagtggagacggggtttcaccacgttgaccagggtggtcttgaactcctcacctcaagtgatccacccgccttggcctcccaaagtgctgggagtacagtttgagccacccagcccagccctttttaaccttttgttttttttttttgttttttttttttgagacgtcgtctcgctctgtcgcccaggctggagtgcagtggcaccatctcggcttactgcaagctccctttcccgggttcacgccattctcctgcctcagcctcccgagtagctgggactacaggcgcctgccaccacgcccagctaaatttttttgtatttttagtagagacggggtttcaccatggtagccaggatggtctcgatctcctaacttcgtgatccgcccgcctcggcctcccaaagtactgggattacaggtgttagccaccaagcccggcccgttttaaccatttttaagtgtacagtgtaaggcactgaaaccgcctttgcaaaagtataactgaggaaattatgacagtgaaagaaatcagacctaactgactctatcttgcttctaacccttaagctgtccttgttcgttcctgggtgtaggcggaactaactttgggaaggaattccgttcatgatttgactctgaaacaaagttgctaacagccctttcctgaaaaagactcccttcttgcctggggtccagtctgcctttgcaggactaacaaattagctacaagattagaaattacagtttaggggtcttgctgcttccggatccaagagtctgaacctctccaaatttgctcctgtggataacatcactattgtaaaacctaagagcagtgcttgagatattttgcagaccctgcactcgatggatcagctgacaccacctggaccagtaacctggcccaaccagttctgccatcgcagataggaacagaagacatatgaaaacctaacttcgacccccgcctgattccatctccaacctgaccaatcagcactccccacttctcaagcccctacccgccaaattatctttaaaaactcagggcgggttgcggtggctcatgcctgtaatcccagcactttgggatgcgaggcgggtggatcacctgaggtcaggagtttgagaccagcctggccaacgtggtgaaatccttctccactaaaactactaaaattagctgggcgtggtggcgggcgcccctaatcccagctactcaggaggctgaggcgggacaatcgcttgaactcaggcgaaggttgcagtgggccgagatcgcccgtgccactgcactgcagtctgggcgacaagagcgaaactcggtctcaaacaaaacaaaacaaaaaaacccgaaaaccaaccaaacaaaatctgatccccgaatgctcgaagaaactgatttgagtaataataaaactccggtctcccgcacagctggctctgcgtgaattactctttcgccattggaattcccctgtcttgacaaatcggctgtctacgcagccggcaaggtggacccactgggcggttacagcattattaggtatattaacactgttgtgcaaacacccccactctcggtctccagaactttttgtcatcccacattgaaactctaccgattaagcactaagttcccattcccttcccagggtttttaacaaggccacgttaaacagaaggggcacctgcttgccaggtggaggcctgggcactggcagggttctgccctcccgactgagcaggggctcccgaggtgactaagcaggctctctgggtagtgctcccgccctcacctattgtccgggtggaggaaccggtatttccggatgggggcctcagacccagtgatcccggctaagggtgaggctggcgggggaggggaacggaagcgggtcgtaaaagttaactttacactaaaatcattaacttttctcacaccccccaataaaagcagtcacctcccccccccaagagccccccacgcacccacagtggcccacaaccatgcttcccgggggctttgaagggtagaggagctgacatcctccttgcccagaccctggaaaggattaggaagcggacctgggcacgaatagagaaagaagcccagcaaattcctcttgcaccagctctgggaggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctaggcaagtaccctcctctctctccctccccggcccaggtgctgcctgccgcacgccccgggagagccgccgaggcgcggcagcctgtgcccaggcgtcgccgggatgccttccctcctgtcccgactttggccagggaatgatttggtgggcgcgaattcgcgctggtgccctgggtcgtttgtgcaggcggggtgaggggcagcgcgagtaaacgggttgacatcccctaggtttctctgcagagtgcgctgtgtacttcatcgggcatttactttttcactgcttcctcatcgcccccggggcggcagcgcctcacagggtctctctgggggaatcatcaacaggtgtgcctgaacacgcacctgcggcagccacaggtgtctgggagccaccttttttcttctccctggcctggcaccctttcactcaagggatggaaactgtttcactttctgctgagcttctcttttacccgattaaaagggcctttgaatttctgttggcgcagccaactgcatcgggtgggggcaggagccggtgccttggagtgacgcgggcggagcgcggcgctggttattggaagctggtggggctgcttgagtgcccgctgagcctccgccgcggggcttgaaaactccgcactccagaaagcttgaccgtacagccctgggggtgctcgccctgcccgcgtggtccgcaaaacggggatctcctccgcctaacgcggcagagacttagaaaacatttaaacaacaaaaaaattttcactttctgacccatttgtaagggaggggccgagcttgtcagcatatacagggcgttgtaagtttcccagggctgcattgcaaggttcttctatagggagctctcagtcaaaaccgagttggagatctttatgttggaaaaaggccactgaattccaggcattcttcgagcttgagaagggcattttcaagactattttgaagtttgcacgagggctttctgcgcaactgagtatctcaactatccttattgtctgtggctacttcccagtcccagaggtgggcgagttccgtagggaggcctccgcaggcaggtcttctgtccaggtttctgaacgcatttccacaaacgtggtcggtaggtaagttaagcccttaaccaatccacttgagagatactacctatcctcttcgtttcctggtgaggaacctgttattctagttgctgatagggtgacattctgggtactttcaagtgttcacgtgtcttgccactttaaggtcacgggtgcattacctgtcgaccttttgaaatgcaggatctcaggccccacccagatctgctgaatcaggatcacccaagggatccgtttgcacattaacgtctgagaagtactggcctaggtatgttggagtgaagttttctgtccagtgtcaaggagtgctttacatttccatccggttatgtatttgaatctttgttttgcccaccaggacactctacagccgcatgggttagagcacctgcaccccagggtgacaggatatgtgattaacatactggccggtgatgtttttgattctgtggtaaaatatacataaagtaaaatgtagtattttagccgtttaaaaatggacccttaattcaatattgtgccaccatcaccactacccatttccagaactttttcatcatcccaaacagaaagccattagaataccttattttctcctttccccagcctctgggcttctggatacttttaattattattatattttttggagggaacagaagatgttgactaagaatgtacagtaaatgtctcaaaaaataagagaatgtatagtaaatgtgtagtagaatcacgctggcagaatatgaacaaacatttgggaattcctgggtagacaaaagcactatagctcaaggttcttagagtgcacgtactttctttaatagagacaactataaaccttcaagcgtttcctattttgactgaaatggaatggagttacccagtgctcaacctgctctaattaactaggcatagatgcttgatgatctgtaactctgtgattcttttaactggcctcattttaggtgtcctgttgatactgggtttagtttgtttttgttttttaattattttattttattttatttatttattttgagacggagtctcgctctgtcgcccaggctggagtgcagtggcgccatctcggctcactgcaagctccacctcccaggttcacgccattctcctgcctcagcctcccgagtagctgggactataggcacccgccaccacgcccggctaatttttttgaattttttttcttttttttagtagagacggggtttcaccgtgttagccaggatggtcttgatctcctgacctcgtgatccgcccacctcggccttccaaagtgctgggattacaggcctgagccacggcgcccagccttattttattttttgagacagagtcttgctgtgtttccaggctggagtgcagtggtgtaatcttggttcactgcagcttcaacctctcaggctcaagtgatcctcccacctcagcctcccaagtagctgggactacaggtgcaaactaccatgcctggctaattttgtttatttttgtagaggctagtttaaattattattattatttttttctgtagattgggttcttgctttgctgcccaggctagtcttgaactcctggctttaagccatcctcccgccttggcctcccaaagtgttgggattacaggtgtgagcccccgctattttttcttgacccttgcctcttcttgtgttacgactttcatcacaatgaggttatcaacttgtagtaagaatttacagcttcctttgattgaaaagtccctttgaaatggtgaatgaagataattcaaacggcaagatttggcagaacattctctcttaagaagactcctgcattcacagactttcagaatgttattacttccttttaattctagtaaggcaagagagaaaaggtttaccctcctatagtatgttctcttctgaacaatatagttcagagttttatttggtaaatggatgcattttgcaatctacatgagaaaacatttcttagaaaatgtccagtgaatggttttatcagtgatttcagtgatgtttggggaatcacctggtagcttaataaaaatggaaactctccaaatattccagatttattaagtcaaactctttttttgttgttgttgagatggagtttcgctcttgtcacccaggctggagtgcaacggcgcgatcttggcttactgcaacctctgcttcccaggttcaagcgattttcgtgcctcagcctcccaagtagctgggtttacaggcatgtgccaccacgcttagctaatttttgtatttttagtagagatggggtttctccatgttggtcaggctggtctcaaactcctgacctcaggtgatccacccacctcgacctccaaaagtgctaggattacaggtgtgagccactgcgcccggccaagtcaaagtctttatactacaatctgtgcgtttaatagcaccctgagtgatttttttttttttttttttttgagatagagtctaactctgttatccgggttggagtgcactggtgccatctcagctcactgcaacctctgcctcctgggttcaagcaattctcgtgcctgagcctcccaagcagctgggactacaggcatgcaccacaatgcccagctaatttttagtagagacgggatttgtccatgttggccaggctggtcttgaactcctggcctcaagtgatctgcccacctcggcttccaccttccaaagtgctgagattacgggcatgagccattgcacctggctcaccttgattctgatatgtaattaggtttgggggtcactagaataaacacatgcacacacacacactcgaatgtgagtgcaaaccaagatataaaattaatctgaagttacaagataacacaattttatatacaacatgaaataaaattaacaatagtttcttccttataattaggtagacagttcaagtttggcaaatctaattggcaccttttgatattgatcatcactgaactttagaatccccagtgtccagaactactggtctccataggagatatcaaggtactggactagtatttgatttagcattaatgaacactagttgtgtacccattgtgaaacagggattttcagatatactgtcgttaaatctttacaacaaccttgagcatggtatttctttttttctcattttacggaagagaaaattgaggccactttgggtcttcttgcttgaaaccatggttcttttcctggtcctcccattgtagaataagaaattcctacctactcactccccttcacctccagcagttatattgagatgtaattcatgacaagctatgtacagtattcataaattcttcatgcaaatcttttggaacatcaggtactgtgctaggccctgaggcaaataaaaagatgagccaaaatggaaataaatttcaaaagagcaaaggactcaagagccaagggttcttttcatggtaccctgagacctctgatgagttagattatacttgaatggggtcttaggttggctgggccagctccccagaaaatcaagtcgtgggcatttgcttattgagatgggtcagaagtactctgcatgacagtacctacctggcaccctgaaatgccacacagtgtaaaagaaaggacccaggctttaggtgtggaagaactgacctctgctacaaccagctgaatgaaccacagtaaatctcataagctcgaagctgccacatgctggtatataaaataaaggaaataattatcttgctcctgaattatagtgaagactcaaaaagaccttatttgtacaagggcttgtaaaatgtaaaatgataacaaaggctacgcacctccatttgggagaaatttataatgcaaaggaaacagaaaaagccataaatttacctagcacttttcagtgtactttttagttaactgaggctgttgataattctcttttagctttggccatttttgttttaaacagttacattgagatataattcacatactatacaattcacttatttagtctacaattcaatgtcttttaggatatttgtggagttgttaaccatcaccactgtcaatattaagatattttcaaggctagatgtggtagctcatgcctgtaatcccagcagtttggaaggctgaggtggaaggattgcttgagcctgggagttcaagtccagcctgggcaacatagggagacccctgtctctctctctctttttttttttttgaggcaaagtctcactctatcgcccaggctggagtgcagtggtgcgatctcggctcactgcaagctctgcctcccgggttcacgccattctcctgcctcagcctcctgagtagctgggactacaggtgcccgccaccacgcccggctaattttttgtatttttagtagaaacggggtttcaccatgttagccaggatggtctcgatctcctgacctcgtgatccgcctgcctcagcctcccaaagtgttggaattacaggcgtcagccaccgcgcccggccgcaagggagacccctgtctctacaaaaactttaaaaattagctgggcatggtagtttatgcctatagtcccagctactcaggaggctgagttgggggatcacttgagcccaagagatcggggcttcgccaagctatgatcatgccactgggctctagcctgtgcgacacagtaagatcttgtctcaaaaaaaaaaaaaagatgtttttaatgccccctcagagaacattttccccagtaaaccccctctaccccttagctggctcctgtcaatattccccctctacccctgaccagggtaccaggaatctactttctgtccctatagattagcctattctgaacattttatataaatggaatcatagactatgtggcccttcattgtctggcttctttgacttagcatgtttgcaaggtttatctatgggagccgtggtttactccagtaatcccactcctttgggggaccgaggtgggaggatcacctgagtcctgggcaacatggtgactaaaggcttatgtacattgtagtatgtatctgttccttttttttttttgagtcaggatcttgctctgttgcccaggctggagtgcagtggcacaatcatggttcactgctgcagccttgaacttctggtctcaagcagtcctcctgtctcggcctcccaaagtgctaagattataggtgtgagccatcatgacaggccagtactttattctttctattgctgaataatcatccattgcatggacatgtcatagtttgcttatccattcatccattatgggcatctggattgtttctgctttctggctattatgaataatgttgttatgaacactcatgtacaagtttttatgtggacatacattttcatttgctagagtacatacctagaagtggaaaatatatggtaactccatatttaatattttcaggatttgccatactgttttttagagtggccatattcttctacagtcccatcagccaggtatttggagttccaatttcatgtctgcatccacatacattattactgttgtctgtctttttaaattttaaccacgctagttggtgtgtgattttggtttttacttctctgatggctaatgatgttgaatatttattttttcatgtgcttattagaccattttttttttttttttgagatggagtctggctctgtcgcccaggctggagtgcagtggagtgatctcgtttcactacaagctctgccttccgggttcacaccattctcctgcctcagcctcccgagtagctgggactacaggcgcccaacaccacgcccggctaatttttgttgttatttttcagtagagacggggtttcatcgtgttagccaggatggtctcaatctcctgacctcgtgatccgcccgcctcggcctcccaaagtcctgggattacaggcgtgagccactgcgcctggctattagattattattcctggacttttttcttgattcttttccaagggaaaaggacatagggaaagaggaaattctgttttgaataaattctccagtttcaatggtttagattagaagcatactgaaaatgtaaattgagccatttgctcttttggaatttattgcggcttaggcctctgggcctagtgtaatacctgatgttcctaaagatttgaatgaagaattaatgaatacgtagtttcttggggttgatggggagtacgtaagcagggacttactattctacctgctgatttaatgtccatgaaaataatcatacactaaaatgttaataatacatacacacaaacggactagtgtacatggtggacattttaaactctttcaccaaaatatttattgattaacatctgtcagggccagatgaggtggttcatgcctgtaataccagcactttgggcagatcacttgaatccaagagttcgagaccagcctggccaacatggtgaaacccagtctctactaaaaatatgaaaaattagccaggcatggtggcgtgtgctgtccttccagctactcaggaggctgaggtgggagaatccttttagcctgggaggtccaggctgcagtgagctgtgattgcaccactgcactccacctgggcaacagaacaagaacctgtcgcaaaaaacaaaaaaaaaccccgtcaattctacttactaaaatatacaataatatagtttaaaaatcatattaatacattgtctatatattttattagggtactctttattttattctcaagtactgccaaaagaagagtagactaaggctgggtgcgatgtctcacgcctggaatcctagcactttgggaggccgaggcgtgcggatcacttgaggtcaggagttcgagaccaaagccaggctcacgcctgtaatcccagcactttgggaagctgaggcaggaggatcacctgaggtcaggagttcgagaccagcctggccaacatggtgaaaccctgtctctactaaaaataaaaaaattagctgggcgtggtggcgtgcctgtaatcccagctgcttgggaggctgaggcaagaaaatcgcctgaacccgggaggcggaggttgcagtgagccaagatcacgccattgcactccagcctgggggacaagagcgaaactctgcctcaaaaaaaaaaaaaaaaagaaaaagaaaaaaaagaaaaagaaagtaaaaaaagagtagattaataagacatttttcacgagtcagtgcatttttgttccttgtttcccaagctgcacggcagtgtttttcctttgtagccacagagaattttcttcattctctacagtcacaagccagtattgagtttcttaaatatctgttgtgttttggaggctcgctataacctgacctcaggttatactgtttggatcttgtattatggggaaatgttggtaatagcagagaactagggaagtcagctggatttagaaaaagaaaacttccatttgagggttctttgagacagtagtgggataggtgagtggaagtgtgtagcgcagtgattctcaaacattagtttgcatctgaaccatctggaaggcttgtcaaaatacagattgcaggcccccctcctggagtttctgattgcgtagatctggggcgggggctcaagaatctgtgtctctaacgagtgcccacccaggtcatgctgctgctgctgctctgggaatcccgctttgagaaccagtgctttggaggcctttggaagtgcaggtctggaacttgcatgacggaaggggccgggcttgaggctggtctgggcatcctgtgtgtgcaggggcttggtggagctgtggaagtgggtaccagccaaagcagggcgcatagacaagtgctgaggacgaattgaggaatactgtggggaggggtggctgcgaggaagaacagagctgagagataaggaagaaatggacagagggttatgaggagacctgggtgagtgaagacccacaaactcctatgtaaaggttcaggagagtgaggacatgtatgggtattggtgtcaggggagggactgagtggtcacccggatggtaggtgttgtagctgtgcaggcctggcctttccaccattctttcaggaagggcagcatccccgggcagtgggatgtgctgcttgtggccacagagtcacatgtggactttcctgtaagaaagggaattcttttagtctttctggccgtagtcccagggatcatgactaagttctctccctctttctgcctgtcactgataattaacgtaaaaccaggatgagttttgcaaaccagaagcaagatttctttgtgcgaggagtgactgtcatctctaaaactggagtttgtgtccttgtgtgtatttgcctgctcagcttaatagctttaggcatgcagtcatcttagcataacttgatataagccgattctgagagtgggtgctgacatatggaagtgtttttgacagtccacgttgtgaaggtcaggaggtttgctacaggaaagaaatccaagaagggcagtggcccactggtgttgggtcctctgagagtgagctgtgttctactcttcccactcacgtcacaaagtcgagagaaacatcccctaatttgattgtatatttcattttaaaggaatcctcattgcgtctgaggatgtaaaatatttctcttgggtttcggaaagaggccaaagcctgccccaaggtgttctctgttatcatttggggcatctgttgttagtagagagcaaagtgatttaatatcagtgcttgtaaaccaactgcctggtgacttgctgtatggtcaggaactgagtagcagctccttagtttagactttccaatttgcctttgatcccactcagccctttgcacagatgaacattcctgctggcccctgtaggccctgggtgtgtgattcctctggttaatggacaggactggaaaggaaatatttcacaaccctgcatctgtggagagggagtgtcctggaatccccaagaccacccccagtttcaatgattcactaggaggactcacagtactcagcacagagttgtactcatggctatgatttattatggctcaaagatgcaaagcaaaataagccaaggggagaagtactggagcgaagtccaaggcaagcaggcacaagcttccaaggctcctctcccagtagagttacacatgatgtgcttaattccctggcaactagttgtgaccacacatgtgaaatgttatcaaccagggaagcttataagggactcactgccccgggtttttactgggggattgttacactggtgtcctctgcctaccagctacccaaatttcagactcacacaaggaaagcagctgttcagcataaaccacatggttgtacagtttaaggacagtgtgagactcttaccagtcctggcagtggtgggaatccaaattcccaggcatcagctgagagccaccttgtaagtgggtctttcaaaggataacagtcaggcttgctatgttaccttttggatggggatgagagtggcaggtgaggatggtggtggggacccctgaacttggagaagggatctgttaatgcagcctcggggcctggtgctgcaggagaaggtggaaggaagtgaactggggttttgcacctagatcctgggttcagaatgataactgggattcctgcactacacggatagagaagggtggaaaagagttcaaagtcctgtgcattcattcatccatttattcattcttaacaggcgcttatcaatgcctatgccctttgaggcactgtggcaaggtgctaaggataccacggtgagcagggtaaattctctgctctcatgagacccacttctagagggaatgaatgaggaaaggggcagttaaattcattgctatggggatataccaaaggccctagggtacctacctggtaggcttagtgggagttcagaaggcatgaattttataatcagaccaacctgggtaggaatcacacctctactacttattacctgtgtgccttgggcaagttacttagtcacctggtgcctagatttcttcatttcttcatctaaaaacagggagaatttattgccttttttttaagatagggtctcactgtgttgctcaggctggagtgcagtggtgcaatctcgactcactgcaacttctgcctcctggattcaagtgatcctcctacctcagcctcccaaacagctgggactacaggcatgtgccatcacacctggctaatttttgtattttttgtagagacagggttttaccatattgcccagcctggtctcgaacgcttgagctcaagcaaccctcctgcctcggcctcccaaagtgctgggattacaggcatgagccactgtgcccatcctttcttttaaggctgttgtgagaactaaacaaggccgtgtatgtagagtgcttatttcaggggctggcacagtagaaatgttcactaaataatggcttagcgacgcctagccaaggataggtgtgtattctccggaaagactggcgtctgctgcatcttcactctgcaagtcacttcagaggcatccccttcagccctgggctcatgggtgcacacaagcctgcattcctgccacactgctccgcttgctggtctaagaatgctttcctgtttcatttttctggctttttttttttttttttttttttgagacagggtctcgctctgtcacccaggctggagtacagtggcgcgatctcggctcactgcagcctctgcctcccgagttcaagcgattctcctgcctcagcctcctgagtagctgggactacagcgtgcaccatcatgcccagctaagttttatatttttagtacagacagtgtttcaccatgttgtccaggctggcctcgaattcctgacctcaagtgacccgcctgcctcagcctcccaacgtgctgggattacagatgtgagccaccatgcccagcctcatttttctggctcttgaacacacttttctctttacctggatgccccagatttcttttgtcagcctaaggaatatgtactcctattattaagacccaactcaagtactttctcttttctctctttctctttcccaagccaagtccctcggacaggattgctcatgctctcctatgtcctaccctggttccatggtcactcacatccgtattacagcatgctgggtcgcagttgcttgttgcagcattagactgggtgatttttgaaggcaaggatggcttggtattatttgaatctccagtgccaatcagactgtttgatagggaccagctcaggggatgtagagggagtgaatgaatgagtgtggagttggactggaacacccaacgtgaaatggatacaacgtcagcaaaataggtctctgccctcagagcagagcttacagtctggaggaggcagatggtgcacaggtaaacataaatataacaattagagactaagcagtgacacaagtcccacagcaggtgcagggagtctctcctgggaagagggagaaataggaagttggaatgttgataccctgggcaatgtggggctgttgtctggagtgtgagtggtgttggaggcctgaagggctggtcctgtggggtgcacacctggagagctaggaggcggatagtgaagcagtggtcactggcacctcagctgccagagggcaggattgcagcaagatctaagtgtccacttggaaggctgaagtgctccactcaagcaagacaaactgggttcgaggaacccagggtcaatagaggaagtaccacccagcgagctgaaagacctgtctgagctgggcctacgacctgtgtcttagtcagctcgggctgctataatgaagtaccaatgactgggtgggttaagtaacagacatttgtttctcagcgctctggagacatgaggtttgataccaggtgccaggatggtcaggttcgtggtgagaacccttttcctggcttgcagacagccaccatcttgctgtatgctcacatggcctttcctggatgcattgtgtatggagagagagggagaagagagaagaggagagagagagagagagaagagagaagaggagagagagagagagagagatctgtttctctcattctctctcttgttgtagggacactaatcctatcatgagagtcccaccctcatgacctcatctaaacctgattacctcccaaaagtcctatctccaaatagcatcacactggaggttagggcttcaacatatgaattttggggagatacaaacactcagtccttagcaacccaggccaataacgatttgctgagtaaataatcatggctggcactcttaatagctctttgaatgggacaggacctaaatgttttgcatatagtcattaaaattcattctcaaacaatctcactaggtatggccattatttattatccccggtttacagatgaggaaacccaggccctgaagaatttaagtgatttgctaattaagtgtgaagctgggattctgaccaggcagtctgcttctagggtctaggattttgttgttgttgttgtttgttttttgaggcagagtctcgctctgtcacccaggctggagtacagtgacacgatctcagctcactgcaacctctgcctcccggattcaggtgattctcctgcctcagccccctgagtggctgggattacaggcatgcaccaccacacctagctgattttttttttttcttttgagacggagttttactcttttgccaggctggagtgcagtggcgtgatctcggctcactgcaacctccacctcccgggttcaagcaattctcctgcctcagcctcccaagtagctgggactataggctcgcgccatcacgcccagctaatttttgtatttttagtagagatggtgtttcaccatgttggccaggctgggctcaaactcctggcctcatgtgatccatttgcctcagcctcccgaagtgctgagattacaggcgtgagtcaccgtgcccagccaagtgtagggtcttaatcattatacttgcctgactcttaattaagaagtaaactctaatattattggacgtcagtcaagtgctagttcctgagtgaggagagatattagagatagaaggatgactatgacatcatacctaccttttaggctatctcagaatgctcaaagagatattatttcttgatgtcaattcaaatttgataccaccaagaaacttttatctttgtcttgtaactgtggtccatagaaccaatagcagaggaaagtgttttgcaatttcaaatgtgtctcgtggctgaactgctgacaaaaaaatatgttttttaagaataatgggtgcagtggctcatgtctataatcccagcactttgggaggccaaagcgggaggatcacttgagaccagaagtttgagaccagtctgggtgacatagtgagacttcatctctactgaaaaaaatgaataaataatgagctgagtcatcaagttaaaatgtacagttcattttagtagagtgtatactataatgacaataacttcaatgatggtaaaaggtatcctaaaatttataatactaatcaaatcataatacagtttgagaaaatatagaaccatttatgtaaaaaagtttttttttagctaaaaataaatgtagatgatttggaaatattttacaggaaaatttagaacaaagtgtcttaaagactttgcggtgtttctggatcttgactactagggtcatgtgcaagctcagtgaatgcaggaggaaactacatccatttcctggttgggggtgtctgggaaaaactcagcccatgagggagaaggagaggatgaggaggacagcggccctttggtgagaagcctggtgatggtggtagggtgtgttcactcaggcttcctggagaaggagaaggaagaggatatcctcttgtcatgaactccacatttggattcactggaaacagatttgggaaagagcaggaggagagggaagaggttgggggtgtgggaccctcctgtctccgaggaagcagcaccactgctcagggcaacgctttgtgtgtgtcatcagatgctagaggatccacttccagaaggcactgagcagagtggaaggagtcagccctgctgcgtaggagctgtgcgatccaggccaggttccttagctctgcctgatccctgaattatgtggctcgagtttcattgttctgttggttattctctttctcaggtcggcagcctctcgtcatgagctgaggttttgtccagctgcccacactcttcaaccaatgatcatgagcttctttgttttctttccttctttctttctttctctctctctttctttctttctttctttctttttctttctttctttctttctttctttcttttcttttcttttcttttcttttcttttcttttttttttttgagacagggttttgctttgttgcccaggctggatggagtgtgcagtggtgtgatcacagctcactgcaacgtgtgcagtggtgtgatcacagctcactgcaatgtctgcctcccaggctcaaacgatcctctcgcctcagcctcctgagtagctggaaccacagatgcgcaccaccaggcccggccaatttttgtatttttttgttgagatggagttttgtcatgttgcccaggctggtctcgaactcctgggctcaagtgatctgcccgcttcggcctcccaaagtgctgggaatacaagcatgagccactgtactcagctgagctttttttttcaagggacagaatctggccttgagaagaagaaactttccagcttttcttcaaggtctttgaatctctttctgtgggtccccagatctcctggtcacagctcatcttgtcatttgcctcagatctttcctcctcttcctctactttgacaggtaatatctcagcaggctccatttctttctcgtgacaatgtgcagtcatttcatttcctctctccagaagactttgggcagctcaatccagacatcttaagatgcccctttgggtctgcttttctgttctgttcttccacagggttagtatagaattgatttttctctcccacttggttggtcagaggcatgcttgactttggaacatcaatcactttctggcctcatcgttctgcctgtcatcaacaggatctccatcctgattccaacttaacagccctgttctcttctccaagaggcattaccagttctctcatcttgaaccaacgttccgcccgttccatacccagaccctccatgctgtctggaggtcccatgtctttgtttgctcataatagttataagtgggttttagcttcttcctcttgagtttggatggatttggcttctgctgccagagcctagattgttctcacgtatcagacattggcttatcttgagggtggaggattttcttttcccagctggtttgctataaagtatataatgggctcagtcacagggctggacagatccaggccatcaggaacttctgggctttcacctttttccatcacaagacaaaactggatgagaactttacaaaaaaaaaaaaaagggccagggaccatggcttatgcttgtaatcccagcactttgggaggctgaggtgggcggatcacttgaggtcaggagttcgagaccagcctaaccaacacggcaaaatcctgtctctactaaaaatacaaaaattagccaggcagccgggaggctgggcatggtggcttacacctctagtcccagcactttgggaggccaaggcgggaggatcacctgaggtcgggagtttgagatcagcctgaccaacatggagaaaccccatctctactcaaaatacaaaattagccaggcatggtggagcatgcctgtaatcccagctacttgggagactgaggcaggagaattgcttgaacctgggaggcggatgttgtagtgagctgagatcgcaccactgcactccagcctgggtgacacagtgagattccatctcaaaaaaaataaagggggctgggtgcagtggctcgggcctataatcccagcattttgggaggccaaggcaggcagatcacctgaggtcaggagttcgagaccagtctggccaacatggtaaaactcctgtctctactaaaaatacaaaaaaattagctgagtgtggtggctcacacctgtaatcccagctgctggggaggctgaggtgggagaatcgcttgaaccctggaggcggaggttgcagtgagctgagattgagccactgcactccagcctgggtgatagagtgagacttcatctcaaaaaaaccaaccaaccaaacaaaatgttttactttagtcagtgttatgggttgaattatatttcccacctccaaaatttctatgttcaagtcctaacccccagttcctcagaatgtgcctttatttggagatgcggtgtttatagaggtaatcaagctaaaatgagatcattaaggtggcccctaatccaatctgttcttataagaggaggaaatttggacacagacacatacagagggaaggtaatgtgaagacatagagaaaagatgggccttcccaagccagagagagtggcctggagcagctccttccctcacagccctcgcaggacctaccttcccagcaccttggtcttggactcgcaggcatgagataatgaatttctgttgtttaagccacccagtctgtggtattttgttgtggcagccccaggaaactaattcaggcagaataagaaattctacctaaaaccaagagagctattaatgcagcagctcatggcacagccaccatctcccattgatgagcagtgagagcgagaccaggtctcccatagccaggtccttgtctcgaactcggccgtgtcttctaggtttaccaagagcaatagctctgtagcaggacaaagttcctccatagggccctatactgccacagagtcccctggggccttcctggccagcaggaaggtcacaacactgtggtcactgggcaggcttctgtctggagccaaaccttcgtctagagcaagtaggcgaccgctgccgtgagcgttgggggcaggcttagatcagtatggaactcaaacaccctcagagctgccctggcctccttctttcctcctcaggtgcttaaacacattttaagtcatcgtgttccagttttaattgatgaagcccaaagtatgtgagagggcagaataggaacaccaaacccagtctggggattcaacgaaagaaagctttttggaagaaatgaagccacaactagtcagcaaagaaattaaaatacacttacacggtgtatattatgtgctggatgttacatgtgctcagtgctttccatgtaataactggtgtaattttaaaaacaactctatgaggtaggcactattattagccctgctttacagataactgaggcagagacattgactcttccaaagccacacagctagtcagtgatggagctggacttcaatctcaggcagtgtggccccccaattcatgctacagagtgggaggggtgtgtcagcaggtgcagcgtgggatcatgtgaactactctctccagctgctgtcagccaactgctgtatctcaacacctcatacccggtatagtcactaccaagttcccagttctgatgtgaggggtgttcctttcctaaaattccagagcagaggtgactgatattcccctcacccaatgaatggccaggccacacttgtcttaaaccagctcctgccaagattctgaattctgtgcaacacctcatcgctcatgtgctcccaggcaagggaactgctagaatcctacaattctaggctcatagtagaaacagcgtaggatcaatttctaccaacagtaatagggagcggtgttccctcacataaggagttcaaagttttttatttctctttgtttttttgggagacggagtctcgctgtcgcccaggctggagtgcagtggtgcgatcttggctcactgccacctctgcctcccaagttcaagtgattctcctgccttagcttcccaggtagctgggactacaggcgtgcaccaccatacccagctaatttttgtatttttttagtagagatggggtttcactatgtgttggccaggctggtcttgaactcctgacctcaggtgatccacccgcctcagcctcccaaagtgctgggattacaggcgtgagccactgcacccggcctgaaagttttttatttcttaggactgagagtactcagagaatccatgaattattatatatatgcaagttgtttgggaagggcagtcaattaagtgattttaatgttggcttgaactattcagtagcaggggttaaaaatctaggacgtatcacaaccataagggagggcctccccagttggcccaccagagccaggcccctttcctctgctcccccgagcaggacccaggagcctactttcctttctttgtggtgttttccaccgcccactccagcccttgggtccctgtaccctccagccagcctgtctttcagtctcactgtttttcccacaaggaccactcttcctgaagaggcattaggaatggaaaaagaaggacagatgggagagaggaagggagggagggatgatatccaccgaatgtatatacattacggcattatttattaattcattttgagacagagtctcactctgtcactcaggctggagtgtagtgtcatgatcttggctcactgcaacctccacctcctggttcaagcgattcttatgcctcagcctcccgagtagctgggattacaggtgcccaccaccatgcccggcttttttgtatttttagtacagacagagtttcaccatgttggccaggcaggtcttgaactcctggcctcatgtgatccacccacctcggcctgccacagtgctgggattacaggcgtgagccacagcacctggctgcatttattatttaaaacaagccctgtgttgtggtcttagtctagctgtacgaatgatggaacagaggttcagaaaggtcagtaacttgttcaaggtcaccaggtcttaaacagtagaggtgggattcaaaccaagtctttcccctgtgtcatggggttggtatgactggggacacacaggaatggatgagggtgtcttcaaggtctcatgctgggtgaaccaggaggtggatgcacagaagccggaaaaggcaaggggcactgtagctggcgctgggcacatgggttatttccaatagatactgggttgtgccagaggacaggattggaacgataaatttgatgacatccagttgaaggtaatagtttaaacctagtagtgaatatgttctgaggatgaatgactctgaggagagaaggctagtttgggctgagcaggtgagtctaaaagagccacactaaactttattaactctttggtaattcttttacatcacgtaatctgcttttcttacagtgtattggtggggcatctgagtagcaaatatgtaaagatattatttatgagcatattaaggaggagagaaatgaaatgcttttttcagtagagctaaaaaagcaaaaacaaaaaaattgctgtttccctaactcttctacttttagttaaagcttttttcagctcctgaaaagcagaccacaccctataaaacagactgtacagggcattagttcatttccctttttatacttccaaagcacagtaactgttaaaacacccagtgaagaagcatggccactgtctttctccagaagaaataaagtagaaatattagttgaaaggaaatgtcagtctgatctgtgaagttttatgttcaattttaatcatccagaaagaaaacttgagcatcctgacttaaaagctttttttggatcatgtatatttaaaaacacttttaatagataaatgatttttagttaatagttccagttataaacaatttctagaattgtaagggaattaacccaatatatgcatatttctaaataatttctagaattatgaagtgtcatatctggaaggggtattttggctagatttgttatttcctgtgttattaaccttatgtataattatgagagattccacacaaagatgacaattttaaaaaatgaataaataaattagcaagttgaacagtctgatttatggaagaaaagcaaattctttctaatatttgctaaggcagaattattttcctaatgaaagacacaattttaattttatgtgaaatcatcatagataagaatcactttgtaagagctgcatgttaaatgcatcgaaaattccaataaaaaatgaaactttaaaacatcccatttgcaaaatatcatgtcacttttcactgcaggagaacagcttccaatgggtaacaagtttaagttgattttttcttgttgttagctcaggctttgttacttatttagagtgttgtatagtaatttttatcatgcgtcatcagaaatacaatttgttagaacaatgactgttgtgtgagtgtaattacatcttcctgtatgattaaatgagggctgtatgggacctttactcagaggtggcagctgtagccaaccaagttcagcctataaaagaattcctgggactaactggtactaattgtttgcagaacaaccagtgggagtaatattcatgaatactatggaaatgaaatattccaagaccaaatgctttagcccttgttttttactttattgtggtcagattatattaattgcataatcaggccaagtgaagtgggagctcttggtcttttgttgtttttggaagaaaacttagccttcatctattcagtcctctcatcttataaacagggaaattgaggcttagggagtagttgaagggttatttaaagtcaccaaactgtaatataccctgtcagagttttaagtacactcatatacccctgtcagatttttaagtacactctaccgtatacatgagtatattagtttgtaaatagtgtaccttattacaatttaaaagatattagttctcaaggtaaatattatgaatattcaaaacacaaacattcaattttattttttatttttttgagacagagtctctctctgtcacccaggctggaataaaatgacacgattatagcttactgcagcctcgaacttgtgggctcaagtgatcctcctgcctcagcctcctaaagtgctaggagtacagatgtgagccacgtgcccagcaacactcaaatttttaaagcatgagagaagaaaagaggaaatagatggcataatactttcttcccacatcccaaagattgttggtatgtgcacctcactttggagatttaggtcatttaggtcaaaagaaacttgctattgaggaaagagaatctgtagaagtagggtttaagatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataactgtaatctcctagggtgacagtggcctccggcatagctggatccagaagctcgagtgatgtcatgacatttttcttggtactgtttttctcaactattgtaatactagtgaagagccctctccatgtggcggggcacatgactactatcaagagctccaacttcctatcagccctggttagcaaatccaatggaaacaggacatttccctcctacagtcatctgttcaccccagggaagactggttgacccagtatgtggatcatgtgtaccatggcccattgagtgggccaccatgataggtggtccacctttacccatggacaaagggtaaggaagctcttcaaagccaagaggagacttaaagaaaatggagatgaggtagattctgaacctctccaaacgatatattttcatgatggcagggatcacacatgttgggttctagaggtatttaaaaagttgtttttaataataattttaaaaacccaccaaattgtttcttaattaattaatctttgctattgacccaagcaaggagtttatagtgcttagaaatgcattgctataaaatgacaactagaattccttcctcacttgtcaaagcacaggcttttagagagagagatatttgtagaaagagcaaatctgtttctgattttagttcatccagtggcaggcaggctttttggaccaattattaccagaccttgagataaatcacctcatgagccattagttcttgaaggattagcggcctcaaagatttatgtgcggattaattggagtgtacattagatcgccgtgtttaaaaccgcagtcattcctgcaaatcattttcattagtgctttattcagaattatttagccttgtataatactgccattgcagggaaatctgaaagacgttctctttatttgtggtctgcccccccatcaccacggttgtgtttaatagatctagctagggctacatagagaacatccaaaggaacagcagcttccattaaagattagttcagttgcttcaggtgaacagtgactgaaatttacaggaccttgtaccgagagagacaagatgaggtacaagaaatatatcggtattctggaagcagcagttggtattaccccacttaacaaaagagaacttctacctgagagcagaagacacgtgaacctttggcaacaacctgggtaagcagaggaggctggaagcttctcactatagatgtaaatactttttgtctgttttggggacccatatagaaaaaagggtcctctgtcttgtggggataataaatgagttcttcattaagaacttgtttcttcttggtggagaatggaactcctagactgatttaaaaataggaatgaaattgttggataatattctaatacccaagaagatgaataatgggtgtgtctagagcccatttttacaatctagacatttaattttctgattttgaaaatgtttttttaacatggtttacaaatgtagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacagaaaaataagggggaaaattacccattgtcctatctccccaagagaactactagaatcgtttaggtcagtggttgtcaacggggaggtggaaatagggaattttgctccccaggggacaattgtcaatgtctggggcattttttttgttgttatagcccaggggttgctattggcatctagttggtagagtctggggatactgcccaacatcccacaaggtacaggacagccccctgcaacaacgaattatccagcccacagtgtcaacggtgccactggtgagacatttgatttagataggttttcttcccatctgtaaaagggtacattttattagaaaaaaataaatatttctttgggaaatcttagagatgctttagaatggaattctgaggcaacattttaattatattattgttattctactgttattgtcttgaaagtaaatggaagtgtgtatatgcgtggagagggcagggggcatacagagactctatcagagtccatgtaggttaatgctgttcagccagggctgtggaaaacattgtaatgactaaactgagattctccaagtagcctctcgtgattgggcatgcggtagcctagaccttagtctcagaatgacgaaagtttagaactgggaggacctttgccagggatggcaaacaggtttcatgtggaagacaggtgccagttgatggttggctgcttggagtatctagctaggaggacctggaggccaaacctgggcttagcgggaaaggaatatcgcaactgattagggatgtttgttctgaacctatgattagggaattggggagatgcaagccgtggcctatatatttaccattcctgaattctagtttagtgttcgaattttacaagtgggaaactcagcctcattggagtcatcctgatcaagggcctggctctcagacagaaacgggatgttcttagtttctgcctcagggtctttcatgaagggattcggcctaaacaagctcccatgattcagatgtgcaagttgattgctagattattaatttttgttcagagataacctctactagcaattggaataagtaccctaaatagacctaaatagatctctgcttctcctcatttccccaaatcaaaccaaacagaagtcaaattattacaaagtagcccttaataagggaagttgaatgtgccttttttttgagagagagaacgtttccttaagctggatgaaatagcattggatcagaggacgaacaagatcttccttgtacctataatactctttgagttctgtgaatacacagggataaaacatttcactgatcacttttttttttttttttgagacagtatttagctcttgctgcccaggctggagtgcaatggcacaatcttggctcactgcaacctccgcctcccgggttccagagattctcttgcctcagcctcccgagtagcttggattacaggcatgcgccaccacgtctggctaattttgtatttttagtggacacggggtttctccacgttggtcagggtggtctcgaactccttaccttaggtgatctgcccatcttggcctcccaaagtgttaggattacaggcatgagccactgtgcctggccctttcttttttatattttttttaatttttttttttttttgagacacagtctcaaaaaaaaaaaagccacaattggaagtcaggttataatccagtatttaaaacctcaaggaattcattcattcttctcatgcttccccctctgtaatacttttttttttttttttgagacggagtcacactttgtcgcccaggaggctggagtacagtggcaggatcttggctcactgtaatctctgccttccgggttgaagcaattctcctgtctccacctcccaagtagctgggactacagataccaccatgcctagctatttttgtattctcagtagagatgcagttttaccatgttggccgggctagtctcgaactcctgaccccaagtgatccacccgcctcggcctcccaaagtgctgggattataggcatgagccaccgcccccctctgtaatactttttcttgctgtctgcaagcagggatgtgcttgggcttctattctgcaaactgtacagttgcatgattggccaaaacgaatggctaccaaccgacaattgactgagtattgcaagttcattgaaacagagattggatgatttacacatgtgtatatttgcccattgcccagcacatggtaggtgctcaacaaatattttccagtgctaactcggtttcagtatagccacaatggagaaagatagaataaaaataattgatacccaaatactaacctaaaatacccagccacctatgaatcttccttttgaaatctgtaaagtttttcagctttaactcatgttacctgacaattttacattatctctcaatactattgaaatccaagaatatattttatttctttctgccaaatgttcttttaatttagaggccctattcaataatagtgtattttagaaacaactgattgttattgggggtttgtatacatgaaaaaactccttggattattatagagaaagttaaagccaggatacattagaaatgcagaaaactccttaaattaaaaagcaagccattttaataaaagaaataagctctccttggagctgatacctgtagaaaagtttgcatatgaagccaaaagcataactaagtacctctcgatttgtaagccatttatttatctttggaagtaataatagaaaccatgtatgggctgggctttaatcccgttgcttgctttgtaggatgtccagatggcatagctttagcctttgcctacatttcctgctgatcctgggagaagggaaatgtgcctcccgcctgtacaaataaaactgacaccatcttttctttctatttcatcgtgtagggagtagagtgttttgcacagacgccacaatatcagtttgtctagcaaacagaagagtatgtccagaagtggtgagaggctgcattcttcctcccactgaaagtttttcctgtgactgcccgagtgaagctgccttcacaagctcaacccagaaaggagcttgcctccttgtggtattcgaaaggcacatgcaggcttcataagaatttgcagaaggggtatttcttgggttttcttggtcttaggggtaaaacgagaaagtatttgccatctttcctgctggtgagcaacccataaatataaacacaagcctaggccagttgcggtggctcatgcctgtaatcccagcactttaggaggccaaggtggatggatcacttgaggtcaggagttcgacaccagccgggccaacgtggtgaaaccctgtttctactgaaaatacaaaaattagccggccgtggtggcacgtgcctgtaatcccagctacctgagaggctgaggcaggaaaactgcttgaacccaggaggcggtggttgcagtgagccgagattgtgccactgcactccagcctgggcgacaagtgagactgtctcaaaaaacaaaaccataaacacaagccagtgttataaatgctatgaaaaacaaattcccttttggtttaaaatgttttctctgtagtatactttggaatggtaaattttatgttatgtgtattttactataataaaaaatttttttcttttctttttttttttttgagacaagagtttcactcttgtcgccaggctggaatgcagtggtgagatctcacctcactgcaacctctgcctcctgggttccagtgattctcctgcctcagcctcctgagtagctgggattacagcacctccccaccatgcccagctaatttttgtatttttagtagagatggggtttcaccatgttggccaggctggtcttgatcgaactcctggcctcaggtgatccacccgcctcagccttccaaagtgctgggattacaggcgtgagccaccatgcccagcctaaaatattttgttctagctattttctcacccgctgatatttgtttaacctgaaaggcgaattcttataagatcttgtttctcagagtgaccctcaggtggactggtgataccaaagtttaggtggcaattcactttctccattttttgaagactgaaaacaggggcagcaattccattatttctgagagaaatgaaaacatatgtccacataaacaattgtacacaagtgttcataatgaccaaagagtagaaacaacccaaacttccaccaactgaagaatagataataaaatgtggtatatccatacaatgtaatattatttggccataaaaaggaatgaagtgctgatgtatgctataacatcaatgaaccctgaatacattatgctaagtaaaagaaggcagtcacaaaaggcctcatatcatatgagtccattcatatgaaatatccagaatagataaatctatagagtaaaaaattagattggtggttgcctagggccaagaggcagagagagaattgggggctcagggaatgatggctaatggttatggggcttttcttgtggggttaatgaagatcttctaaaatggattgtgggccgggcgcagtggctgacgcctgtaatcccagcactttgggaagtcgaggtgggtggatcacctgaggtcgggagttcaagaccagcctgaccaacatggagaaaccccgtctctactaaaaatacaaaattagccgggcgtggtggcgcatgcctgtaatcccagctttccgggaggttgaggcaggagaattgcttgaaccagcaggcagaggttgcggtgagccgatatcacaccattgcactctagcctgggcaacaagagcaaaactccgtctcaaaaaaaaaaaaaaaggattgtggtgacagttgcataactctgtgaaggtactaaaagccatcctaaaaacgggcaaattgtatggtatgtggacttcagtgcatttcccaaaatcttaccattgcagggaatgagcatgttggatttttaacaacactgtcttttccagggtgcgaagtaccacattactgtcatctccctgtgagtgggattggcaccccggctgcagctccaggagcaagtactccaggaagcacagagctgtaccagtacacggcccacgttgccaggtatttgcttatttaatctctcatcaacctagttactggtctcccccaaaatttgttcgaatagttaccgttttcacattctagaggtagtcagagttaccatttttgatgttgctgatatatacattttcatagaaaatttaatggtaatgtcctatttaccaaagaatagaaacatcttacctgaattaatggactgaattgataggtataactttgccatggttggtgaatgcttattgaggatgacctttctggcatgtaagtaagtacaacttctgtggttcaaaataaatgcctaaattggcatttggtgctgatgatgtctgggattggaggtcattttaataggttatattttttcattatcattgaggtagtaaaattatataacagtggtaagcactttgatgaaaagataaaggacatcagtcacactggcttctaaagattaattatgtccaagcttttagtgaaagagctaggagcgagtattatctatttactgattcacttttaagagtgaatcaaatgagatttacaaggtcttaaattttgacagatgtgggatgcatttgttttttgttacactttgacctctgtttataggccaggccatggctagctggaatggggttgtaatttttttcatgtgcttgttttataattcctgtctgttgaagttggcagcccctacttgggtggattccagataaatgtgtgaactggagtttagtggagtgtgaatggcacactccagaagagcagatagtcgttcagatcctagtcctgctgccttctaattgtgtgatcttgggcacatgtcttaatgcttctgagcctcagatccttcatctgtaaaaagggaacgtcgacatgaaactaaatgagttaatgggcccagcaagtaccaggcccatgctaaggcctttctcagtgtctagttgtccaaatgaggacattcaagtgggggaagtcctcattttccactgaattaacagggctggatgtgggttttgtttactgaaatgttctctctggagctctttttttttttttttttttttttttttttttgagacggagtctcgctctgtcgcccaggctggagtgcagtggtgcgatctcggctcactgcaagctccgccctctggagctcttaaaggtcccagccaggcaaggcagctcatacctataatcccactgttttgggaagtagaggtgggaggatcgcttgaggccaagagtttgaaaccagcctaggcaacatagtgagaccctgtctctatttaaaaaaaaataataataataatttgctgggcatggtggtgtgctcctgtagtcctagctacatgagaagctgaggtgggaggatcgcttgagcccaggaattcgaggctgcagtgagctataattgcaccactgcaccccagcctgggcaacagagtgagactctatctcagcaacaaaaaaacgtcccaaacatgagaagacagatacctgctcagactccagaaattgttttccttgtctgggcgcggtggctcatgcctgtaatcccagcaatttgggaggccaatgtggaaggatggcttgagcccaggagtttgagaccagcccgggcaacatggcgaaaccccatctctgcaaaaaatacaaaatattagccaggcgtggtggtgcctgccagtaatcccagctactcgggaggctgaggcacgagaatcacttgaacccaggaggtggaggttacagtgagctgagatcgtgccactgcattccagccttgcgatacagagaaactgtctcaaaaaagaaaaaaattgttctcctaaaatctttagatttctagataggatctgttgattattcaaataaattggaggggtactatagagtatggcaaagagagattggagctagcattgtctgttggaggaaaggctctttctgactctagccagcccctcctgataaatacctcccttgttctggttccctgtacctgcactatgaactgcatgcctttccaacatcaatttgattgcctaagtcagtgccttactccagagttctttcatgtgtaaacacttaagcttggctttctgggacgaatcagccttgggtgagcttgagtgatgtggatttttttcccaggcatctcacgtcgccctagtttcagatccagcaaacactcattaagggccttttatgtgccaagcaaggggcaaggtgctttcacccatatggttcctcctcacaacaaccctaagaggaaagtattaactagctcccatttgtaaataaagaacttgagattcaaagattttaaatgattcctttgtggttgcacagcccctgacttccaagttcagtgagatttgtatttctatactaattctacagagcttgaagacttaactccttaactcagacgagtaaaaaggtttctctctaaggccagtttggatcaattgctaggtggctgcctggagttaaggatttgcaagtgccgctcaagtttgttgagcaagaatgttgtgatcgattggcaatgtccggcgtgggtggagcaggtgtctgccaaaccgctctggacctgaggtttctaatcatcagcctctactcattctgctctcctctgccattctggagtctctcctctgatgagcactgtttgcctgaggctggatttttgcaactttaaggggctttgattatcacctttctgacttggcaggatcatctttgccttcagaaataatgctaaggctttgggaggctgaggcgggaggatcgcttaagcccaggagttcaagagcacctgggcgacatagaccgaccctgtctccattaaaaaaaaaaaaagaaggccaggcatggtggttcgcacctataatcatagcactttcagaggctgaggcaggaggagcccttgagcccaggagttcaagaccaacctgggcaacataaggagaccctgtctctttttcaattttataattttatataaaaaaattaataaataaaaattaaaaaaaagatgctaatagtctggtgaagagcttcattttctagatacgaaatctcattgttaggcaatttagataccttaaagttatcactgactcaccccatcatataggcttagaaaagtgagttgaggttggggtcagtggctcacgcctgtaatcctagcactttgggaggccgatgtgggtggatcacctgaggtcaggagttccagaccagcctggccaacatggtgaaacctcatctctactaaaaatacaaaaattagcctggtgtggtgctgggcacctacaataccagctactcaggaggctgaggcaggagaatcacttgaacctggtgggccagagattgcagtgagccgagatcgtgccacttcactccagcctgggtgaaagggcgaaagagtgaaactccatttccaaaaaaaaaaaaaaaaaaaaaaggaaaagaaaacaaaagaagtgagttgaaggtgaaagctcgaaacttttacttctgtgcacctgggagcccctctatagcttctttccctcttccctaggggctcctcggtttacaggaattctcagggaaatcactccagcagccaaacttccatactgggatggacagacccagagcagtggcacatcggtatcgcctggagggcgtgttaaaacacggattcctgggccccacccccagggtttctgcttcaggcagtctggggtaagtcccaggaatttgcatgtctggtttccactactttgacaaccactaacctggagagtacttgtaatggctggtttagagcatgggcttgtttacagatggtgtgtgtggccagtttctctatctgtggggaagggattctgtcctcaaatatttaatgagcatctcgcactgtgctgctgagggaaatgtagaggaatattaagcttgtccctggtagactttggagcctaatttggaatcagtaaattgcattgctgtgtgtaaagtactgccctcacccccttaagaggatgtggcagaaggcctgaagcagtgactaagtcaggggaggattcctgcggcaggtgatatttgaaaggaaacctgaggctaaaaagttattggctatgtgcacttatgggggaagagaaactcggagcagagcctgtacattaaaagagtctggagatgctgcactaggtgagaagaaaaggtttgtgtttgttctgagaattccattgtgactcctatatgtaaaccagaaagtatcagagacaaagtctcaatcaacttagagagtttggccaggcagggtggctcacgcctgtaatcctagcactttgggaggcccaggctggaagatcgcttgaggccaggagtttgagaccagcctggccaacatggtgaaacaccatctctactaaaaatacaaaaattagctgggtatgtggtgtgcacctgtaatcccagcttcttgggaagctgaggcaccagaactgcttgaacctgggaggcagaggttgcggtgagctgagattgccactgcactccagcctgcgcaacagagtgagactctgtcccaaaaaaaaagaaaaatttagaaagtttattttgccaaggttacaggacatgcccataacacaggctcaggaggtcctaacgacatgtgcccagggtggtcagagtacagcttgcttttatacattttagggagacataatacatcaatcaatacatgtaagattttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtgtttttagtagagacggggtttcaccgtggtctcgatctcctgacctcgtgatccgcccgcctcggcctcccaaagtgctgggattacaggcgtgagccaccgcgcccggccaatacatgtaagatttactacattggttccatctggcagagcaggacaactcaaaaggggtagaggggctgccaggtcataggtactctactctaggggtacctaggggctgccaggtcataagtactgctattctaaagcctccaagtaacaggctttagagaataaactgtaaacatttcttatcagacttcaggtcagtgttgatgttaatattggaggggtatgatggggcatgtccaacccccacttcccttcatggcctgaaccagtctttcaggttaaattttagggttccccggccaaggaggaagtccattcagatggttgcaggggcccttcaaattttatttttggtttatagatatgaaataaagatgcaactgtataatgatcatgatgaaatgtgggtgcttactgtgtagttggtgctgtgctaaacatgttactcaaacatgttacttccatcgtcttatttctcatacccatcccatgaggtggaggtccaactctaatccccatttgtagtagtttgccgaagccacagtaacaaagcaccataaactgggtggcttaaacagaaattaacataaattattgtctcatggttctagaggctagaagtctgaactcaaggtgtctgcagagttggtttttttttttttgagacagagtctcactctgtcgcccaggctggattacagtagcatgatcttggctcattgcaacctccacctcccgggttcaagcaattctcctgcctcagcctcttgagtagctgggattagaggcacacgccaccatgcctagctaatttttgtatttttagtggagacgggtttcccattttggccaggctctaactcctgacctcaagtgatccatctgccttgacctcccaaagtgctgggattacaggtgtcagccaccacgcctggtccttattctttcttgctttctaatgacttaaagctaaacatattttccaaacagaaatcagagtgtgtgcttttttactcatgaaccaacaagacagagtgctggtcatttggcctatccttggaaatctgtgatgtctggacatcttaagcatagcatgtagatgagtaatactcaagctaggttctgaagcataatttaattatactcctgcatgtttaaaagaattcagaacctaagaattaaaagctgacccagaggcaggcacagtggctggccgggtgcggtgattcactcctgtaatcccagcactttgggaggctgaggcggtggatcacctgaggtcagagttccagaccagcctgaccaacatggtgaaaccccatctctactaaaaaacaaaaacaaaaaattagccgggcatggtggtgcacgcctgtaatcccagctatcccagctactcgggaggttgaggcaggagaatcgcttgaatccaggaggtggaggttgcagtgagcctagatggcgccactgcactccagcctgagggacagagcaagactttgcctcaaaaaaaaaaaaaaaaaaaaaaaaagctgacccagagccctagatctcttaacttttcacagccaaatcttaaaaggcttctctgtgctttttgttccttttcctcactatcacctgcccttctgacactttctcctctacctatgccagaaacttagaggcccagtaagtggtttcaggtgtcctatgggctgcgcacagcactaaataaaagcacttcccttagctcttcccttaaacgttgctgtttaaggaagcttattcttcttcttattttcaagacagggtcttgctctgttccccaggctggagtgcagtggcatggtcatagctcactgcagcctccatcccctggcctcaagcaatcctcctgcttcagcctcccaaagtgttgggattataggtgtgagccactgcaccaggctggaagcttatcttatgatttccatttcatctgataaaattgagatgaagaatttgcttctagttctggctggaatgggggggttcttcactcacatcggttttgattcttcactcatatcagttgaatggttggtgacaaaacttttcagttcagtcaaaatttttattcatttagaggtaatctgattgtgtagtgagattaggcaatccccttgggcaggattcaccgccccccccccatcaaaattatttgatatttgaaaaaaatatgccgggcacggtggtttacacctgtaatcccagcactttgggaggctgaggtgggcagattgcttgagctcaggagttcgagaccaacctgggcaacatggagaaactctgtctctacaaaaaataccaaaaagaaaaaaaaatagctgggtgtggtggcgggcgcctgtaatcccagctacttgggggtgctgaggcaggaagataacatcacttgcgaccaggaggtccagactgcaatgagccaagattacgccactgtactccagtctgggtgacaaagtgagaccctgtctccaaaaaaataaaatagtgatgtttgaaaaaatatatacaatttttattataattattgctgtttgatattgatatttgaaatataatattgatattgatatacaagtaatcaaacatttatgcatatataaaattatttttacttcacatcttaagactggttacttaaaataattaactctgtcaatacgctttgaaagaggctttgtaaattgttaaagttacatttgtctcttctgatagctttagctcagcagaataaatatggtaatagttggctgggtacagtggctcacgcctgtaatcccagcactttgggaggccaaggtgggcatatcaagaggtcaggagatcgagaccatcctggctaacacggtgaaaccccgtctctaccaaaaatgcaaaaaattagccaggtggtggaacgcgcctgtagtcccagctactcgggaggctgaggcaggagaatcacttgaacccgggtggcagaggttgcagtgagccactgcactccagcttgggcaacagagggagactctgtctcaaaaaaaaaaaaaaagaaagaaatatatacatatatatatatatgtgtgtgtgtgtgtttctttttttttcctagagtgtgtatatatatatagcaataaagagggatgctttcccaagacttagaacaagaaatcaaaatactttagcaactgaaggatgattcaagcaaaggcagaactcgatcaagaagggagaagatatgtaaaaaataaagtgtcattgggaagaatagctaggattggctctggaaaaaataatagaaaaacactctgcttatgtgatttagtgtttacaatgtaaatctgaaggacttctgaatcttttggaaataaacctggattgacttgtttaaaaacttagatcatgtctcagtgacagagctcagcaaaaaacaaaaacaaaaacaaaaaacagaaacaaacaaaaacttagcttatgactttggaggtaggaaaagctgaaagctccctacattcctgaaattaaatgaaagatttcactcttgtgtttaacctggccttcagatcctagattagcaaagaatttgatgtaccttctacaaacctgattttgttcattatgactccacaccttgcttgctttccttcactactctaggaatgtggaaaagtttagctggatgtagtcctggcctaccagcaagctctcccagagagcatgggacagaaaagctcagagaccaaaaccaggtgttaaaatcacacgattcactcaacttgaaaacatagtgagaagcaaggggaaaaagatggtgtattagtctattttcatgctgctgataaagacatacccaaggctgggcaatttacaaaagaaagaggtttaattggactcacagttccacatggctggggaggcctcacaatcatggcagaaggtaaaaagcacgtctcacatggcagcagacaagagaagagagcttgtgcagggaaactcccttttttaaaaccatcagatctcgtgagacttattcactatcatgagaacaggatgggagagacttgcccccttgattcaattacctcctactgggtccctcccataccttgtgggaattcaagatgagatttgggtggggacacagccaaaccatatcagatggagactaacaggtaggtgaggatacaaatggggtgagagatccacacttctggaaccctatgcttgcagtgtcagctttccctgctgatggtgtggtcacaaaaaccaaagttaaggttgaacaaggggcttcaacggatgggaagtatctgaagtcagcacatgcgtgctgtgtcggagggatgcaaggtagtatgcctggccaatagctgtaggtcatcagtgatgtgtgtgtgtgtgtgtgtgtgtgtgtgtttaagatggagtttcgctcttgttgcccaggctagagtgcaatggcatgatcttggctcaccgcaacctccgcctcctgggttcaagccattctcctgcctcagcctcccaagtagctggggctacaggcatgcgccaccacacccagctaatttttctatttttagtagagatggggtttcaccatcttggctaggcaggtctcgaactcctgacttcgtgatccatccgcttcagcctcccaaagtgctgggattacaggcatgagccactgcgcccggcctgatctgtgttttatctacattttggggcagagtatatgtggggccagaactgaacatgatggatgtcacctatgggtgatcaatttaggaatgacatagctgtcaatcttggggtaacatgagctgagcactattatatattattaatatttatgaagtgtctattattaacaatgtaaatcataatctagaaaaatactttatatataattatatattatataaacaatatataattgaccgggtgtggtggctcacgcctgtaatcctagcactttggaaggccgaggtgggtggatcacctgaggtcaggaatttgagaccagcctggccaacatggtggaaccctgtctgtactaaaaaatacaaaattagccggcgtggtggtgcatgcctgtaattccagctacttgggagggtgaggcagaattgcttgaactcaggaggcagaggttgcagtgaaccaagatcatgccatggtactccagtctgggtgacaagagcaaaaactccatctcaaataaataaataaataacagcatataattatacaaattatatttttataaaattgtattatataataaatataatttttatatattatatatgaatatatatgcctttatatattatatatatacataaagtataattttgtattatatattatatataaaatacaattataagttaaatatttattaactttactattaagtaaatattgtaagatttaaaatttatttcattcctccatttctttgtatgtataagtaaaactctcatttgtttcattcttttaatctatatttaacacaggaatattctattctgtttaacatcttacaggttattatcttacatgtcttacaacttactgtttacacttaacacatcttatgaattctgcgtgagtcttacaagctacttatttcctcattatctatgctaaatgaatcaggagtttcattcatctgatttttaaattgtcctctatactagtttgaaggagaactttaaatgaaagtatttattcagccaattatggtatattcatacaaatggaatattatgcagttagaaaagatgatgatagagatctagttcatgaaacaaatagtcaaactctattcttatgtagaaataggttgcaaaagagcaaatttggtgtatcccaagtgtataccccaggtgtctaagttgtgtacaatatgtacctacttgtctgtgcagagagatacctggaaaggtgctcagtagttggctctggatggtgacattttagttgtactttaccactttttggtgatctacttactgcatagtttgagtgaataaacaattatcacttatattaaaaactgaaatccaaatgtgtgtttgtacaaacatatgtaaataacataaaaagaattgtaagaccagacccttttcttctgaaaaacgtacacagcattttgcaaataattattttttaaaaagtatctttattttattttatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcacccttttagccgggatggtctcgatctcctgacctcgtgatccgcccgcctcggcctcccaaagtgctgggattacaggcgtgagccaccgcgcccggcctcagtatctttattttaaaacatttttagctgagtgcggtggctcaggcctgtaatccctgcactttgggaggccaaggcaggtggattgcctcagttcaggaattcaagaccagcctgggtaacatggcgaaaccccatctctacccaaaagacaaaaattagctgggcatggtggtgcacgcctatgttcccagttacttgagaggctgaggtgggaggatcacttgagcctgggaggcaatggttgcagtgacctgagattgtatcagtgcactccagcctgggcaaaagagtgagagaccctgtctccaaaaaaaaaaaaaaaattgagatggggtttcaccatgttgcccagactgaactcaaatccctgagctcaagccatccatccacctcagccctcccaaagtgctgggattacaggcgtgcgtgagctgccatgcccagctgcaaataattatttttttaaacttcaaaatgttttacctgacttcaaaattgtaatctttctgtcttgtgtcagagaattgtaatgatgtccctttagcagaatttcctaaacctctcccatgatgagaatcacctgggggggcatgtgaacgctgtcagatcccaacgcccttctcagacccactgaattggaatctctagcaagggacctaggacactggttttaacaagtgcctctggtgattcctatcatcagagaaatttaggacactgtcttatagaaccataaattttatgagccacgttttcaatttttattgaacatctcccggaggtgccttttccaggccagtttcctttgtttaaagaggcccatgcaaatttgcatggctaccctggaaagctatttgcttgcaggttttttctaaggccactttcagatccgaaaattctttgtgaatctaagatactcttcaactttaatctgtgttgatcgaggatcctgaattcttagagctagccgattctggtgataagttttttaaagcaattcaggaatgcagagggccctctggtttccccagagtactggacagtcccctgggccttgctcaccttatattccctcttagagcccctgagaggagggcctttttatttagtgaaaatttttgtttactgaagtgtttttcttaaagtattttgggggtgaagggagctctgaaactcagttagacaatagaacggcatttgaatcaaggattctctcgttggagtcaaatcgcatttgtggcattgacctttttaatatttcataggaagagtttcacaaacttgattccccagcattgcttggataaaactcactttagttgctgcgagagcaaaaatcgtcttgcattctgttaaaagaagctaaaaggaaagcaacaataacagccacacctctcctcccaccccatgcaattgttttactgggtagaggcaaagaatagaggggccggaaagccgggaagtgaatgggctttgaatctgacagacctggacctggattttttttcttttttttgagatggagtcttgctctgttgctcaggctggagtgtagtggtgcgatcttggctcactgcaaactccgcctcccaggttcaagcgattctcctgcctcagcttcccgagtagctgggattacaggcgcccatcattacgcccggctaatttttatatttttagtagagacggggtgtcaccacattggccaggctggtcttgaactcttggcctcaagtgttccgcctgccttggcctcccaaagtgctgggattacaggcttgagccacggcgcctggctggattctttctttttttgagacagggtctcagtctgtcactgaggctggagggcagtggcacaatcacggctactgcagcctcaacctcttggactcaagtgattcttctgtctcagcctctggagtagctgggacttcaggtgtgtgccatcacgctagctcatttacttttattatttttattttttgtagagacagggtcttcctatgttgcctaggctggtcttgaactcctgggctcatgtgatcctctcaccttggtctcccaaagtgctgtgattacaggtgtggccaccatgcccggtgggtttggattccatctgcttgaggacaaccatgggcaaactgctttctctgaagcatagtttcttcacgtataaagcaggggcaagaatactgactatatagtcactacattgaatgacttagtatagtatatgaaaagctcttggcacagaatatgcatttagtcaatcattgtttatcagagtttctccactgcttctcagtggagggctaacaaggggtctctatccccgaaaagagagtgtggctttcatatattctgcagtgtaaacagcagtaaaatagtaaaagctgtcatactttggagcaccttggagtgcctctgaggacccagggtgtcctgccaggaagaagtgctccctcctccatgttgcaaagcacgctccccagcaggtatgtctaaactagaacgtgtgccataggatgcttcttggctttccaggagtggatcagggttacgctctgcctcagccccaggcggagcaccaccgtggcctctgcccaccagcctgagcacacccagatgagccctataagtcacctaggagtctgcatgtggtcagcctagactacagtcatctccttccaacccaggactctccccaaacaccagtctagggcaccccagcttcttaatccgttcaggccatagctgactctgaattgcacagctaattcttttttatttttttttgaggcagggtcttgctctggcacccaggctggagtgcagtggtacgatctcggctaggcagcctctgctttccaggctcaagccatcctcttgcttcagcctcccaagtagctgggactacaggtgtgtaccaccaggcctagctgttttttgtagagatcaggtcttgctatgttgcccaaggctggtcttgaactcctgggctcaaacaatcctcccatcttggcctcccaaagtgctgggattacaggcgtgagccatctgcctaaccttatttactgtttttaaacagtaaacagtaaaacagttttaaacagtaaaacaacacagggccaggcaccgtggctcatgcctgtaatcacagcactttgggagaccaaggtaggaggatagctagaagccaggagtttgaggccagcctgtgcaacatagcaagacctcatctctactaaaaataatttttttttctgagtagctgggattacaggcatgcgccaccattcctggctaagttttgtatttttagtagagacggggtttcaccatgttggccaggctggtcttgaattcctggcctcaagtgatctgcctcccaaagtgctgggattacaggcgtgagccaccgtgcccagccttaaaaatatattttttaaaaaattagccaggcctggtggcatgggcctgtagtcccagctacttgggaggctgaggtggaaggactgcttgagcccaggagttggaggctgctgtgagctatgattgtgccactgcactccagcctgggccagagtgagactttttctgaaaaataaataaaataggctgggtgcagtggctcacgcccataatcctagcactttcggaggccaagacgggagaatcacttgaggtcaggagttcaaaaccagcctggccaacatggtgaaaccccgtctctacgaaaaaaaaaaccccagaaaaattagctgggcgtggtggcacatgtttgtaatcccagtttgggaggctgaggcaggataattgcttgaactcaggaggcggacgttgcagtgagcctagatcatgccactgcaccccagcctgggcaacagcaagactgtctcaaaaacataaaaataaaaataaataaataaaaataatactgtagtgggatctcatttttgtaaacatttttcgtttcttgataagtcatccatgtggtcttctgtctgtatatatgtctggaatgttcacctaatgtcgaagacaggtattaggactttagtttttaaatttcttggtgctcttctgaactcctcagatgctttataatgagcaccttattcttgcaaaactcagtggtctaaaaaattaacaaaaatgaaaatagtttttagtaactatggaacaatgtaaatagccttacaccttaagttacttgctttaataaatagaagaatgtctacctggcctggtgtggtggctcacgtctgtaatcccagcactttgggaggccaggaggctgaagcaagcagatcaattgaggctaggagttcaagaccagcttggccaacgtggtgaaactccacctctactaaaaatacaaaaattagccgggcatggtggcacatgcctgtaatcccagctacttgggaggctaaggcacgagaattgcttggacctgggaggcagaggttatggtgagccaagattgcaccactgcactccagcctgggcaagagagcgagagtctgtcaaaaaaaaaaaaaaaaagaagaagaagaagaatgtctgcgtgaaaatttgttctgttctttgagatactagaaacgtagatgccaacgtgttgggtttaatggcaaaaaccgcaattactgttgcaccaacctaaaataattgaaaagtggcaacttagagcagctttgttctttctacataatatcaagatgtgggaacaatcctgaagacaggtagtctgaaaattacttatgagtgatccactgaatgtttctaaaggaaaagcaagaatcttcagttgcccaaaagatggaggaggtctgagagttcttagagtggtttagaatgtgttcctctgtgctggaagatagcttgaaaatactttgctgtctttgtaatctttatacatctatgattgctataaagtcagctttgttctctatttctagaaccatcatgtattggaatgaggagcatctcaattcacaggtctattatttcttgggggtgggtgtcagagggcatatggcattagaagcagctctgtgtacaactgaaaacagtgtcgaagctatttaggatctgggaagtgtacaagttaattacccccaccctcaaaaaagaaaaaagaggaggactttaacaaactttgaaagtgatcatgagggcaggacgcggtggctcatgcctgtaatcccagcgctttgggaggctgaggcaggtggatcacctgaggtcaggagatcgagaccatcctggccaacacggtgaaaccccatctctactaaaaatacaaaaattagccaggtgtggtggtgggcgcctgtagtcccagctactcaggaggctgaggcaggagaatcgcttgaacctgggaggcagaggttgcagtgagctaagacggcgccattgcacattgcaatccagcctgagcaacaagcgcgaaactgtctcaaaaaaaaaaaaaaaagaaaaaagaaagtaatatataataactaaaagtgaaagcataagggggaagcagaacgttagatgccgctctcctggaggtaatcacaggggccattgagtggggtgattattgtgggaggaagcctgcaggtgaaccgggtggttattgttaactggtgtttggactgaggaagatgggtggagccaggagaggagatgaggctacctggaagtgggggcggggacgggggaggacacaaggcctttactgaaaaaacatcaggtccttctggcggagttttagctgctgcctcagcactttagtcatctctgtagttgagcaattctcctaacgtgtcacaatgtgtttacatatcgttgtcttcaacacactgtgagcaggctcccttttataaattgtcattatcttctgtatagctaccccagggtatatggtaggcattcaagaaaggtttgttaaaggagagttacgattccagtctactttacagtgtacacgttaactaaattgtttggtgaacctgtaaacttttctctttttttttttttttgggggggggatggagtttcactcttgtcgcccaggctggagtgcagtggcgtgatctcggcttactgaaacccccacctcccaagttcaagtgattctcctgcctcagtctcccaagtagctgggactacaggcgcctgctaccatgccagctaatttttttgtatttttagtagagacggggtttcaccatgttagtcagggtggtctcgaactcctgatctcagttgatccatccgcctcggcctcccaaagttttgggattacaggcgtgagccaccgtacccggctgaacttgtaaacttttcagtgttagttttctttgctcccagttgatgatactttataaccatattgcagatatatacatatatatatatacacacacacagatatgtttcttaagatctccacattcttgagaaaatatgactaaaaggcatttagtttatctcattaaggtcttctgaccaacttatttcttattttttgagacagtgtctctctctgtcacctaggctgcagtatagtggtgcagtcatagcttactgcagcctcaaattcctgggctcaagcaatcctctcccctcagtcctcgagtagctgggactacaggcacatgctaccatgcccaggtaattttattttattattagtttttgtagagacagaatctcactatgttgtccaggctggactcaaatccctaggctcaagcaatcctcctgtctagcctcccaaagtgctgggattacaagcatgagcccctgcacctagctgaccaacctatttcagagaccttatatattgtaatatacactgaaaagttgaaaaaaattgtccattgcacaaacaataactaaatttaaaaagaaaaatatatgcacaagcctgtcttttcatgaagtcatttttttgcatactttccagtttttattttttttataattttatcactgtcatcatcatacattagatgtaatttgtgtttttttgttgataattatagcattatcattctccttgttgtatagacttccttattacaattttaaatgatggtctgctatgccaattatgttgatttactgtaatttaatagcccagcccaccatcattggacattggtggtttccatcattcattattagatacaggcatatagtgaagtgctgcctcatacctagtcatccactgtaatctaacctccagtcgtatctttccattgaaaagctctggccaagataagcagtggtcctccacttaatgaacatcatcagttcttaccttaattgacctcctcgaaattccatgttgttggcctctccctctttcctgaagtttgttctttccttggctttttggacactctcctccagaagcgttttctttcctttctggcagctcctctttggtctctgttctggcaactcaagtctgccccctaaatattggcattcccagagatgagtcctgtccttagtcctctcttggcttaatctacatcacgtctctgaatgtgggattgtcccctcccaagacttcaacttttatgatacattgatgatacccaaatcactcccaaatctctctcctcaaatactcatcagtgcctagcacataggagacacttgatacatatttgttaaattactgaacatcttcacctggatgacccatagcacttgaaaatcagtctgtaactaaactcatcatctttcttcaagctcctcccaagatctgctcccactcctgtgttctgttttgataaaagccaccgtcatctcctttaagtaagccagaaacctgagagtcagcgtaggctcacttcccgctcgcgtctccccatatctagtcaggcagtcatccagcctgctgatctacttccttagtttctctagaatctggctcccttttgtctaacactgcctaacttcatagccacgtcatctctcacctgcattcccacaaaaatgcatttttggccggtcttgtcattcttactaacattctcctcccccaccaacccctgtcccccaccaactgtcaaatccatctttatacttgcctgggcaacttcaccttctggcacctcaagagtaagcctgctgtctcttccttccttacttctctctgtgttatttattccccttacctggaaggcttttttccttctttgtgtcttaaaaactcattccgacctctcctttagaatgtataagcaaccccatctctggaaagccttccctaagtctctcctgctagaccactctgagcctgccaggaatctcagtgcttacacagtttatcattacttgttgattgtctactgcaatagactgagtttcctaaggcaggatcctgagtattttatcaaggggttgacagaggtgttcagtaagtacctgttgagtagaagaatttttttttttttttttttttttttgagacggaatctcgctctgtcaccaggctggagtgcagtggtgcaatctcgtctcactgtaacctccgcctcttgggttcaagcgattctcctgcctcagcctcctgaacagctgggactacaggcgtgcgccaccacgcccagctaatttttgttatttttagtagagacggggtctcaccatgttggccaggatggtcttgatttcttgacctcgcgatctgtccgcctcgacctcccaaagtgctgggattacaggcatgagccaccgcgccctgcggagtagaagttctttggataaacacattctaggagtggggtcaaaatgtgcaaacccacacgtgaagaagatgactaataaattgtttctccaaagagttgtattgatttacactgccaccagcaaaaaagctaatatatcaactgaaccgtgtttctaacaaccatttactgaatgcttatcatctgtcaggtgttgtgccagaagaatggagtttgtctataaatatttcatcatttcgagtagtgcagtccaacagaactttctgcattgatggaaatattctatatttgcactgtccaatagggtagctattagccacatgtggcttctgagcccttgaaatgagacaagtgtgactgaagaactgaatttgtcatttcctctaattttagttaatttacatgtaaatgtaaacacttactggtggcaagtggtcatcttattgaacagtgccgctctagagagaaaaaaggaaatcagtcagtagatgtaactgccacattctggattattttttaaatgttagtggctctaagcccacatcattaaggtgtggccacctttcaagtgctatcatttttattagtcagcaccacctaatttgggaaatattttatttttttttccttttttttgattaaaacaatttttaaaaaatagagatggggtctcactatgttgcccagactggtctcaaactcgtgggctcaagtgattctcctgccttgccttcccaaagtgctgggattacaggcatgagccaccgtgcctggccagatttgggaaacattttataaataggtgcttagatcaggagagcaatgccttacatcaggaatacaaccaaaatgtctaagtccggagactcgaggcaaagtgggaaacgttactcacagtgctttttatccagaggcgtggacttagttactccaaaggagtccagaagcataacacttctggagaggcatctactggacttgtttttccacgaaacttctagacttgttttgatcaggcaggaagtgaagcaacttttcagggagagagcccagcatctgcatctcctctgggacagaccacaccttttaccttctacttgtgagcctaggacgagttttgctttccaattaagggaagagcagggcaggcaaaactattctcttacaagatggttttttaagatttcaaacccaaggttatatttttaatcggtacctgtttggattctccaaattaatttatatgctcttaaaataaagacacttaacgtcactgcacaattctttgcacatggaggacttcgaaaggaataagcacactgaattgcattagatgaatcctgtcagataagcacttgtgacctactggcaaccttttataagctgatgatgggagaggagtttcaatctctttattggagttgttggaaatgtgccaaagagataacctggaatatattgtcctgaaaagtcctgttttaatatttaatacgaacatcttataaccctcggaattcgggtaggcagttgttgggctgagaaatgtggggtacaaggccgtgtatgtgttggttagccgggcaggcctctagacaggacctaaaactttgaggttttcccagttcgactcttcgtaggagaactgaagctgcctgtgtgaggccctgcgaacctcgccaaaaagtcttcctacaggatgcccccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggctgagtgaggtctgaatgaaatgacagagagtacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatccctcatgtattaaatgacttgactttccctacaaaagaagcgaaccagtttcccagtaaacatcccaccccataactatttttgaggcattcataggcttaagaccaatgaatttttacatcacccccgggggaattgcatttgcaatgacttctgcctacatttaacttttgatctagttctttgtacactgacaaaagttcacagccaaccatttctcttcaggacaagtgtgagaactttctgcatactgctgaaggcaagggagattttgagtttagcaaggttttctctccttaagaaggttatctttttacgagacacaagttattgaaactaggcggggccactttagtcctgtgtacaataatatgtgtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggatggtcttgatctcctgacctcgtgatccacccgcctcggcctcccaaagtgctgggattagaggtgtgagccaccgcgcccggctgaaagtgaatctcttaatggatcttccatgaatcaaatatttgtgttttagtaagttaggctgaccaaaagatttcgaatcatacctttaatcatggcaaggatcttatgtcacattcttgagtacacatgttcactaaattttacctatatgtgtatgtgaacatggacttcagaattaattagtgtggtaattattatttctattgtagactttaatcagccatattaaatatatgcattatgttcacagagaaaacatggtatcatctttggaaactttacagtatgctctatattatagataccctatataactatggtactaaacacacgagttagtgacaagtcaggcatttggagggaatgtttgtaacccattgtgggagagagttattagaatagttattcttactggtaggtaacagttatggctgtaatgaatagaatgtgactaaaatccagttatgcctttgccatcgtattaaaagctttggtggagacgtgagaacattgcagatactttggattttgtcacttgagttgaaggtaaacagagaaaacagtactttctagtcatcagtaggaattaactcttccaggacatgtagcttcaaggaccttctaggttcttctgagggggaaataatgttccacttggggccatttttttccatttgttgagagtcatttgttttcagagtattaaaggaagtgttccgagttctaggttgtgtttctttgatgcctactaaagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaagattctgaaggttttgaagtttgagtataaagcctagagaacattctaaattatttccattggttcttctcatcttaaaatgtttttgtgctccttaaactacgtttgtgtttgcttgcttgctttcttttttttttagagatccagtggattatctctgaaaagcattttttaaaaagacagagtccaagagtggctggtagttgttttgctcataaagtgatggaaagatctattattcagttgcagcttaaattatgtaccagcaccacgtgtgctggattctcttccttactttgcagcttaagccagcaactgcaaccatcttgcagagcttcttgagaatccttcttcctcttcctcttcctctccacccccatggacttctccccgggcctcattgcctgtgacatacgcttggaaggaggggcaggcctgcagctgggagccctttctgatttgttcttcacaaatgtgttgaagatgagcctactggtcactgctgcaaaaaaccacattgttcactggtgtaaaatcactgctgtcatctgagtttcagcataacttcaggcatgttggagtttttcaacgtcacctcaggcagagcactttgccttccttgggctggtctgtttagtgtctgggtgagttttaagagaggagagacattgtggcatcttagacactcactgaaattttccagaaatggagctggaaacatttgtgcgtttccttctggtgttattgttaaagcctaaaaacaagggcaagtggcaacacattgaaatgaagaagccccaagtttgcaacacattgaaaggaagaggccccaagttcgttttgagcctaaattgaattttaatcaaaggtctgagagaaatatttagtctacttatactatttaagtgcacagtttggcagatgactttgggcagtgaaggatctggaagaggcaggaaaggtagactcaatctgccagacttagagctaaaaaaatttgcctggtatgtttccatgaagaaaattttcctgtagaagcagtggcacgacctctgttacaagtctgcttattgataatgaagctttttctgtgttatcaatttcgttgaatttatatgtatgtatatacatatacacacacacaaatctcaagtagagagcttgatgaatttctttttttttttttttttgagatggagtttcactcttgttgcccaggctgaagtgcagtggtgccatctcggctcaccacaacctgtgccctccaggttcaagcaattctccggcctcagcctcccgagtagttgggactacaggtgcgcaccaccatgcccggctaattttgtattttttttttttttagtagagacaaggtttcttcatgttggtcaggctgatctcgaactcctgatctcgggtgatccacctgcctcagcctcccaaagtgctggaattacaggcgtgagccattgtgcctggccagggaattttatttattgtggtaaagtacacataacattaagtgtaccattttaaccattttaaagtataaaattcaatggcatttaatacactcacagtattttgtaaacaccatcactctctagttccagaggtaggtgaatttttacatgaatgtattcacctgcatgattaccacctagattaaaaactagaattttccatcactctggaaggttctctcttgccacttttccaatgattaccacacctacctaaaagagaacttctcttctgacttctctcaccgtggaacacttttgcttgaacttgggagaggacccatatataaataaaatcaacattttatgtctgtcatctttcactcaacctaacctctgtgaaattcatccgtatttgttgcgtgagattcagtagttcttttttgccactgagtcgtattccatttatatgcatctgtcacatttggcttatctcttctgttgataggtatttgggttattttcagtgtttttgctattatgaataaagctgccatgaaaagcacctacacattgccttgtggacatgtacacccatttctcttgtgtgaattcctaggaccataggttagggattttttaaaaaacttattttagattaaaaaaaatattttttgagacagtctcactctgtcacccaggctggagtgcagtggcatgatctcagctcattgcgacctgtgcctcccaggttcaagtgattctcctgcttcagcctcccaagtagctgggattacaggcatgcgccactacacctagctaatttttgtatttttagtagagacaggtttctcttcaactcctgagttcaagcagtctgcccaccttggcctcccaaaatgctgggattataaatgcgagccaccacgcccagccaggttacagatgtttaactttgattctttacctctgaagtcaaataaacctgggtgtgaattcttttgtcctgccacttgcttgcttgactttgagcaatttacctttttctcatgttcagttttctcagttgtaaaataggcctaccctatcagtcatggttcagtcaagaagacatgtcattctagctatttcaaggagaaggggattcaatacagagtattagttgccttcaggacaaagaaaaggcgagatgcgcaaaaaatggaagcccaccgctggctttctgatttgccgcaaaaaaagttagaaagctgctgccacccagagaagactcagaaggtcttgcttgaccttccaccttctcagcatctccagccttgaggctggtgaaagggcagggaatctggacatgctgtaaagctcatgtctgaggaatccaacttttgcctgctactgctgctgtctgtaggaagaagaaaaacaaatggcttctgctttccttcatccttccaaatctcaaacacgtgtacctcgctggtagaaccctgttggcaagagagatgggggatctctggtagaaacagaaactcagtgccagcaaagaagaaatggcatagatgccacctggggttgctttgaggtgctcagtaaatggcagtggttataatttattattttcatcattcctcaagaactgctgctgcagttcagactgatttctctctctctctcttcttttttttttttttttttgagacgggcttgctctgtcacccaggctggagtgcagtggtgccgtcacagctcactgcagcctcgacttccctggctcaagtgatcctctcacctcagcctccgattagctgtaaccacgggcatgcgccaccatacctggctaatttttaaatattttgtagagatgaggtctgtctatgttgcccaggtgggccttgaactcctgggctcaggcgatcctcctacctcggcctcccgaagtgctaggattataggcgtgagtcaccacgcttgggcagcagactgatttcttttttttttttttttgagacagagtcttgctgtgttgcccaggctggaatgcagtggtgcaatctcagcttactgcgacctctgcctcccggattcaagcaattctcctgcctcagcctcccgagtagctgggattacaggtgggtgccaccacacccggctaatttttgtatttttagtagaggcagggtttcaccatgttggccaggctggtctcgaactcctgacctcaggtgatctgcctgccttggcctcccaaagtgctgggattataggcgtgagccaccgtgtccgacccagactgatttctgtaacggatgttcattcttttcactttatagtcacatggatgccactgtaagagctccgtgtcacataaggtgttgtttttctggaagggccttccagattctgtatctattgctctgtgattctaggtacttttctaaaggtataagcttgagaaattagttttcaagtctgtaagttaatgtagagctgaaaggtgacttaattctaagagttgctgctttaatgtataattttatggaacctaatgagtgttttctttttaaagtcattccactttattattaataaaataaaaggtaatatataaatctggctgatagatggggttacttttttccctgtctttagcttcctttgtgttctgataaatgagatggaagatttttatcatattttgtacctcaaatctctcgcggagggaacactgtagtctaccaaaacagctggcagaagtgtctgtcctattataagtttattttatgaaacatgagctataatgtagtcctttttttttttttttctttttttggagacggagtctcggttgcgcctggctaattttttgtattttttagtagagatggggtttcaccgtgttagccaggatggcctcgatctcctgacctcatgatccgcctgccttggcctcccaaagtgctgggattacaggtgtgagccgccgcgcccggccaatgtagtggttttaagacatttaaaaatcttgaaccaatgttggcaacagcctgtctgtaatgatgtcacatgtggaaagaaccgagtttttcttaactttagaatgtgaattttttcctccttcaaatactttttcctataacccagacctattttactttccagggaccctactattactgccctaaggtaatttgctagaaatggagtggtcaagatgtattgattaacgttttaggcatacttctgtagtactacttccgaaggctccttgcagagaaatttgaagtgataaggaaggcaaatattcgaaatggaaagataagtataaccagtgactatttcagccactggtttagcagttcaagtgagctggctgtttgtaaagcttgcttagtaaatgaatgtgctagaaatatattgacagaatttggttttatctctttttctccagacttttagtcggccagggctaacaatggatgtccaaacagtttacagtggctgatacacaatgcacaaagggcttcactgtttggagactggaaaatagagccagaggggagcttcttatgggcattgacctaattcactccttttggcaaaaatgcttggttttaaatcaatgtatgtatttctgacccaaatatctataaatatttcagctagtagtgttacagctggaggaagggacccgtggtgttgcttcgtgtattttgatttgacaatattctttagaaataaattgtcaagtgaactaatattacacaaaagttagggaaagttaagagaggcagctgaaattccatcagtttcctccttagtccctggaacctccccacaatcaggaatttgttagtcacctggtttttaaagataaatttctctgtgggcgtttctgctgagaaatgtggggaaacaggactgggctaaaaataaaattagttcaggcattgctaaacttctaagtatcatgtttgtgatgtacttttccaggaaacataaattggcaatatttttgctcctttttactaccacagaaagaatatttgcagtcagcatgcacggcctgaaagaatctctctcgcctattaatagaacagaaggaacatacacatgtctatgtgggggaaaaacatctcatttggcttagtagtaagctccaaataacaattgcattgttgttctgaattgtctttgagtgtgattggatgattaaatataaatgttgacctgattggattatatcacagcaatgaactgtcctgaaaaaacagctgtaacataccactccagactgttaccagacttagtcggctggctttatatttgtgttgtcaaaactgggatgctgtcatttctgtttctctgtctctttcgtctgttccaatttgagatatactgactatgttagtgtagtctgctacatggatagtcctttatctttcagcaacataagcaacataagctttttgactgagacgagcgtaatcaaaaggaatgctgggaaacagtgaactgtaaaaaatgtcctcaattagatacaggcttcagtgcatgggtttatcctttcagaagatcggtgtgttttcagtgagggtctaaacccactggcctggattccacctcttgttggatgggtggtcagttttaacattagggggtgttgattgtgagctcttgagagcagggctggttctttgcattcctaggtaggcatgatgtagagtagttgctcagtaaataggggaaggtgaaaggaagagaagggagaaggtgagtctcaaaagactggaatgtgataagcacacgtttatcacactgggggtgtattctctcccttttcttagagtattccttgcctcctgaaaaaagcactttgcaggaaatatggagatcttctgaacctgtggctttgtgttattggactgagaagtccaaaatgtgcattagcggagcttatagaactgctctgagaatgtgttcttgagttctacaaatattatggggtgcgttgggggctggctcactccagctcagttcccatgtgttaagtggaacttctgatctgttgaatgcctaaccatgacggagcccaggagacaaagtaaggtgtggtttgttttgctgtaagaccacgtttggttagcttttctctagcaaagctggggaaggagatcacagggctgatgtggtggtaggcccttggtgtagatctcactgacttttcccagtcaactaggagtaaatgttaaccctattttataggtgggaaacggaggctcagaaacattaagtaaattgcccagtgtcacacggcttgtgtgacagggaggggatttgagccaaggtccatttgatgaatttgaaacctgtagattctgtcaattccaccagtctctgctttttagaatcacagtggcaagaaaataggagaagctcaaggccctgtgttgattattaggagtttaaacatcatcgctgaaagtgcatagaaatatttgtattcctagagaatcttaagtaaaagtaacatatcaatgttgtcaagagatgtcttcattcatcagagacctctgtgtgttcattactgtatgagaccccaaagactctaagttgcctctaagacacagccttacagggaggtattaagtgattatgtatacagctagctaaaaccacaactttattatagaaatattaagaatatgtcttatcatgtgagagtattctttcttcaagtccatagcctccagttagaaatggctgtgttgtcccatcaaccccttcactcaaaaactatcattaatatcaggaaaaacttatggttacaaactcctgggttatagaattggaaggaaaaacttagatatgctgtgtttgggagcttgccttgaggattggaattccattgcaagttaccttggggtcaaagtacatcccctaaaacatcaaatacctccaagaggttttaggctatcagacagccacactttaatgtggagtagactagtcagctttcttctactatctaactgacaccatacacattgttaaagagataattttgattgggaatgaagatagggaattttgaagccagaacattctggtgatggagcagatactgccgagatgttggcctcgggacagcctggaggaggaggacactgataaacagagcaaccagcccaaggggtggaaagacctaggaagtctccacatacaaattttgcttctttcctgtttctccactgaaccctgggaagggtgcttatttctctcctcactgtctttccccaggacccagaattgataggttagttgagtttctgtgggcagtctaaggtagtgttactatttaaaatgttagtaacattttcagattcactgagattcttgctgagtgtggtggcatatgcctgtggtcccaactacttggagactgaggcaggcaggaggatcgcttgagcccaggagttggaggctacagtgagttctgattgtcctgtgaataggaatagccactgcagtccagcctgagcaccacagtggagactccactttttttttttttttaagtttaaaaaagttaaaaaaaaaaaaagacaaagaaaaaggaaagttgatttttggttctaactcagttgtgacaaacggtggatatatggttctgaccacattctaaattggacttgatggtgggcaagggaaacttccaatgcctatcccctcactttaaaaaaacttctcctgggccaggcacggtggctcatgcctgtaatcccagcactttgggaggccgaggtggacggatcatgaggtcaggagatcgagatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgagcactgacagacaggtttgcttctggtttcaatgtagtaaggtgacctgataacaagggccacttgagaagttgcaaatgcagatttcctccgtgttaggtggtgaccaataaaagcatattttgtttttaggatgtagaaaggctataaaactgcaatgtctttgtatcatcaaacatttctgtgtttctgatgtttcagatgttcctatttctctggattgcaggatttcaactttgcaacatgtactgttgtgtttctgagttgttgactatttcagttccaaacagttcgttatttcctgtcagaggaaacttcagagtaacaataaagtgctggtgtggcttcaaaggcttggagaaatgaaaagcagtggagaaattttgtgaggttcctttggcttagaaggttcagaaaggctttgagcgaatgaatgtatgtatcagtcactgttactccaggtccgttagctgtttccagacctttctgtgtcctaaaaacaaacatcattttgagggtggggactgtgtcctatgttgacaggtctttgttttcaaagtctgatgtacaatagagactaaacgttcaatgactgaatgcagttcatttttaaaatttttttttttttgagacagagtctcactctgttgcccaggctggagtgcagtggcatgatctcagctcattgcaacctccacctcccaggttcaagcgattttcctgcctcagtctcctgactacctgggattataggcacgtaccaccacgcctggctaatttttgtatatttagtagagacagggtttttgccttgttagccaggctggtctcgaactcctaacctcaggtgatccacctgcctctgtctcccaaagtgctgggattacaggcgtgagccaccatgcccagccgtatgttttaaatcttatattaagcttataccactgttgattgccgttgctacagtggggcttatattaatattagaaacacccctcatttgagtggtactttacagtttatagcaacctctacataaagctgggcatggtggcacatgcctgtaattccagctgcttgggagactgaggcaggaggattgctccagcccagaagtttaagaccagcatgggcaacatagcaagaacttgtatcaaaaaaagaaaaaaaaaactttcatgttaaattctcacttgatcctcaccaagaaccctgtgaggtgagtgttattcactggatgcttagagaacctagagatcatacagctggctagtgcgtaccaggaacttgaactacttataaactggagcagtcggagaaagcttggtgtgtttgacattgtctgtctcttggtctccaggccccaagaggaagcaaaagcctaattcatcttggcaaatgctgtagaagttcttgcttggattttctttcgctagacagtttttggtggtggtttgttgctctccttcagataaacatttcttgatagtgcagtttcttccttcaatatgttcttattctggtgtgtacatccgtttctcagaatgtttagtaaacatttctgttgcataccctaatgccagtttcttacctactcctcagtagcgtgctgcagcagtggctttgggacctggtgtagacattatgggttgctttattcattcctcacagtgacaaggggatcttgattggtgctaagtccttggatggttcccttggcctcagtgactctgagagagccatcactgcaggtgtgatcagtgccagggtcttcctttcttccttctctctcactttttttttttttttttttgagatgtggtctcactctgtcacccaggctagtgtccagtggcacagtctcagctcacttgagcctcctgggctcaagctgtcctctcacctcaatctcctgagtagctggcactacaggcgtgcgccaccacacctggctaatttttgtatttttagtagagacagggtttcaccatgttgcccaggctggtcttgaactcttgagctcagacgattcacccaccttggcctcccaaagtgctgggattacaggcatgagccaccgtgcctggcttttattgtaatttttaaagtctatttctaatttcatctaaattatgttttgaaattttcaattcgtagggaaccggcagtctctccctttttatttctgcatgactgcaccacctagtggataatacatctgttaccaggcagtggcctttgatgatttcctatagctacaaattctacaaaaaggaaaattgggtgcctttttatgctttgaaatcacatataatttctgccagtaatttttgtttctaggcaagtacggactttttgagaggagcttaataacgtttaattcagaattaaaaaaaaaaacgtcagcccatacctgaagtttcccgtgtcaccaatggactaaggatgcagactgtcagtttcactcagtttatgtgataatggcatacaagatagaataatgaggtctttttctaagtttagaaacaaggctatttcaaacacctgaactttttttttttttttataacttgcttgaatttcatctgctgtgttttattaagtcaaaagaattaggaaggcttgttgatttttgcatggctttggctccacatttgatacaggaaacctcacctttcccctccctgtctcttgtctttgctgccccctgcctggatggagtatgttccagtatgatggagcaattgtttctttttgtctgttgatttccattaggtgcagtgggcattggtcattgtgctaagtataccatgcaagaacacattcagttattacgtttatggtattttaaatatgtaacatacttatgcagttgaaaccataaattgtaagatttttagtcttgtccatagattaacggtttaaaataaaattattgtgtctcttactgacagctggttaaatcagtattttcaaagtatcaatttactaagttttgtcatgtgcctctataaggaattcacagtcttcctctgcgctcccacagcctttttatttttccttcccaggaaaaattttagagacaccaaaaggattcttaaagtataaaaatgaatttcactgtttttgaaaataagtactatttttttcttaatacctggcattctgctcatggttgcagcactgtaaattgctgaaagttataggtcattacacatgaagaggcttaaaaatgccgtttgatctatagttaactacaaaatatggagggggagctatatgcacacagtgtctgccatagcattagttatactagcaaaaaaaaggaaatggcttaaatgactgctagggatatggttaattatatagtaaatattgctatttacaaatttaaattaactaaaattaaacattgcattcttcagttgcagtagccacatttcacatgttcagtagccacatgtggctagtggttactgtgttggacagcacagctatagaacatcgtcaccatggtagaaacttctgttggagagtactgctagacaggtgcttctcaaacattattttccccgtcacctccctgatgggaggtgcttctcaaacgttaatgtgcatattaatcacataggggctctagttagaatgcatatttttatcagtaggtccaagttagggcttgagattctgtatttttaacaggctcccaggggttggctacgtaatacccaaagggtggggttcttgcctttattctccaattctaataggaaaggcatgtgtttgaagctcaggactccgtatgtaggctcactggctttatgggattaaccaggctcattgctaggtggtactaatgtgtccctcttttctgtgggaaccatcatctgatggtgccccaggtctgggagggaacgattgaccttgtgtgtttcctatggggccaaccttgatggtgacatttagctgagcagctctaataattgttttttcaacctgcctttttgacaaagccgtttatgattatctttatcttggtgcctattatgggggtggtggtttgtatgtatgtttgtttttttaaagtgaagctatgttttagtgttatataagtttagtcaggtttaaaattatagggtacacagggctgtgcctgtgttgccaaattagcaccttccttttggcttattaatggcttctttgtaattacaaataagaatgatctgtttatagcttagcttagtgtatcagaactaggaacatagaggtcttaaatgtaactatcagctgatttttttttttttggtctcatatcttatgaaaattggactcatgcaaatttgcattcaaattgtgaccaggcacctgttagctgtggggccttgccatgggcaagttccttgagatctcaggccttctatttttgtatgtgaaaaaagcaggagtagggttagggtatagggtttttggaggattaataggcaatagccataaaatacttagcacggtgtctggcatattgttaatgtccaatcagtgatgatgtgtttcaggcccccccttttccatggtgttcacaaaggcgtaggcattagggagcttgtgcatatataccaaagctgactgttcaaacagccagaaataaaatccgactcgactccctttctgcaccctcttcttaccaactcactgcagaagacttattgggctgtgttgactggacccaggccagtggtgtggaaatagctatcatgcttgtgaagatgttctgagttgtcagagtgattgaatccatgattggtctggtgcccaagcaccaacaatcatgtttttgtttgtgtgtttgttttttaagagacagggcctcactctgtcacccaggctagagtgcagtggtgccatcatagctcactgcagtctcaaactcctgggttcaagcagtgctctctccacagcctcccaatgtgctgggattacaggcatgagacactgagcccagctgggatttcttttggtgtgaaggccagtgatcagtcactagtaggttttggaaggcacaataggtgtatagtggagaggcaaggttcttcagtggaaaggatataagctttctagtcacaccagcctgagttagaatctgtcctctgccactttttacttgtatgacctcaatcaacttactttacttctgacttcagtgtcctttctgtaaaatgagtctattaataatgatattgataatagctaaaattgagcatgtactatgtgccaggcattaccttgatttctctacatgcactgtctgattaaattctcacaacaaccttagagaggtgggtcttgttactgctactgcctctgctttacagatggaggaaactgaggcaaggagaaattaagtaactcgcccaaggtaaagggtggagcatggatttgaatccacactttctgactacagactctacgatgtgatcttttttttaaaaacagctttattgagatataattcatataccatacaataaaagtgtgcaaccagtggcttttagtactgtatattcacagagttgtgtggccatcaccacaattcattttagaacattttcttcaccccaaaaggaaactgcatacccattagcagtcactcctcatttcccccaaactcccatagtcttagggaaccagtaatctttcagcctctgtggatttgcccctccttgacatttcacataaatttgtcattttatgtcacataatttgtcattttatgtctgatttcttttgcttgttttatatatatatgtgtgtgtgtgtgtgtgtacacacacacacacacacacacacacacacatgttttctggaggcagagtctcactctgtcgcccaggttggagtgcagtggcacaatctgggttcactgcaacctccgcctccccagttcaagtgattatcctgcttcaccctccccagcagctgggattacaagtgccaccacacctggctaattttttgtgtttttagtagagatggggttttaccaggctggtcttgaactcctgaactcaagtgatccacctgcctcgacctcccacagtgctgagattacaggcgtgagccatcgtgcttggccctgcttatattatttttaaggatcatccatgttgtagcatgtgtagatactttggtccaccttattgttgagtaacagttcattgtatggatataccacatttcgtttatccagtcatcagttgatggacatttgggctgtttccacttgtttgctattttaaataatactgttatgaacatttgtatacaagttgttgtgtacacatgtattttcaattttcttgagttctgtgatgtacttgttggttttgtttttctttttttctaccatgtgttcgtaatgctcttctgagaggaagaaaacagactttcttacttgggagtggtcagcttatttgctgctacaatattaatgatggaaaacccttatcaagagtgcttatcctgtgatgggtactgagcaatgctctccagaagcattactttattcagttctcagaattctaatagggtagggatcttgacctcattttgcagataggcaaccaagtcttaccaagtgaactgttccagatcacagagcttggagagtgtgtagggggactgagcttagacccaggtgtgtgtgacggcctccagaactcctgccactgtgttatgtggacaccattgtctacctcccactggaaggtttaccagcctggattttacagagtgctttcatggggtttgcctggtttcaccctgtgaaatgggtgatgatgccatcgtttgatgaagcagcagtggaattgagtgagcgcccaagctcatgggtgaattgaggcgcagtcttggatggaggtctgtttttggagtttaaatttattgctgtttgcatttcaacacaactgctttgaaagctacaggttgcctcaggcaccctgtcatcctttcccaattcttttttttttttttttttgagactgagtttcactctgtcacccaggctggagtgcagtgacactatctcagctcagtgcagcctctgcatcccaggttcaagcgattctcttgcctcagcctccagagtagctgggactacaggcatgtgccactacacccagcgaatttttttattttcagtagagatggggtttcaccatgttggccaggctggtcttgatctcctgacctcaggtcatctgcccgccttggcctcccaaggtgctgggattacaggcgtgagccaccatgcccggccacctttctcaattctttattatctatttaaatgcacgctaaaaaatttaccttaggtaaataaaggagaatgtggttaaaaaacacaactcagtaaacctggcactcttcagtagtaggtctgggatctagttgtgttgattctggtgacctatcacaaacccctctctaagcttattgctttttgctgttaaacttggtcataagcaagctgtgtccattgtgaagtgtgtgctgtgagcacatcgcatacactagatttaatcatccactgccggcactcagtgcattgtgaagggagggtaaggagctggtgaaatcacatgtgaaactgaaatacttgtggaataaacgatgaaagggttttgtttgtaaaacaaacgctacagaaagtattgttggatgcggtggcaactagtttattgctaccaagaggggtttaagtttgaatagaccacaggtaagtgccctgaagccaaaaggacttggtttataatgttaaaaattattcgtttttggaagaacaagagttgaactcattttctgccttctctgggaaaaagcatttcctgttttgttattagacagctgtttcaaagttttgtccagtaagcagaattttgactaaattcttcacaatagttaaaaccaatttcctgggggcaggtggggaactataaaagtcctcttttcatctggaggtaggtttacctaccagcctaggccagctagctgtttctttacactatccctttctaaggatttgagttcgtttgtaaaatgacatagcagacacaacataataccagagggggctgaacgtggtggctcacatctgtaatcccagcactttgggaagccaaggcaggaagagtctcaggagttcgagaccagcctgggcaacatagcgagaccttgtctctactaaaattaaaaaaaattagccaggtgtggtggcatgtgcctttaagtcccagctactccggggctgaggcaggaggaccgcttgagcccaggaggttgaggctgcagtgagccctgattgtgccactgcactccagcctgggcgacagaacaagatcctgtctcagacatacacacacacacacgcatgcacgtacgcacgcaccagagggaaacatcatgcagaaaaccattggcccatttattggatggtgtcctcccgaagtttcacatctgctgtttggagctactgagaacctggctgatttcatttagtgctccctctgtcttactttgtctttccttcctttctttcctttctccctcctttccttctttccagctatccagtaacatgtattaaggactcagcatgtggaaagcacgcatgacattgttcatggagacgagggtctggagtcaggcagcagctcggatcccatctctgacagtggtgggctgtgtacactctctggcctcagcttccctatttgtaaaatggggatggtggtgctaactcacagggttgtgggcattcagggaaaaattgtatatttagtactgggtgtggtgccctgccaaatgttaatgacttccttcctctccagttttcacacttaccttgtctcccatttctgaggtgaatatgcattttaaggctcccaagccatagattaagctgttttgacatgtctgtccctgctgagaacgtgaaatcctgtgtgtgttattaaacagtttactgcccggccgcactgagtactcgcaatgtcttgaacacccttgcaggttacccctcctggctctgaacgggctgttccctctatgcagaatgcccacccacctgaccagttagtcatccttcagcatggagctgtgggagagggagcctccctgtggttgggacatacctccctccaccccaggcctctcatcctcagttaacaacccgcctgtgccatcaattacactgttttgtggttttttacacctttttttctagacacaggatctcactgtattgccaaggctggagtgtggtggcatgatcatagctcactgtagcctccaactcctgtgctcaagtgatcctcctgcctcagtgtcctgagcagctaggactataggcacatgccactgcacctggctagattttaacatttttctttttgtagagataggatcttgctttgttgcctagcccagtcttgaactcctgggctcaactgatgctcccacttcagcctcttaaagtgctgggattataggcttgagccaccatgggggctggcctcgcttcacattttatgtagttgctataaccccaccactcaccctgctccagcccatgtcaccttttctctttcctaaatgtactaagcttgtttcccaccccagggcctttgcatttgctgttcccgcagcaatctggagagctgttcagattttcctaggattaattcttcccagtctgccatcccatggcacttattactacctgagatgatgatatatattgactcttgtctgctttctctgctaaaatcctccctgtgaggaaacgagtttggcacatatcccctggcagcatctgacatggcataagtactcagggagtatatgtcgaatgaatgagcctcttggtgggctcttgtacttgcactgaattgtaattgcttgtttacacatcccacctccccactgggctgtgtgacttcctttgcatcataacttggggtgatttgtctttctgtccacagggccaggtgcatggttgcttttgggtctgtaagtatggaagctaggaatctttgagaaggcacatccttaaacccataagctcttctcatggaggtagctgtccaccacaaaatgtccttctgatgccattggtagaacaagtactggttggagcaggctgcagttgttcttacgttctgatggccatcctctactgtcccctcccccttttctttgtcaggtctttgccctgtgctgttctttggaccctgaacaaacccttctccccaccccgctaatcctgtcctttccttcagacctcatctcggtgtccctggctcatggaaaccctccctggccaacctgccttgatcagatgctggctcctgcaaagcttcctgagggcagtgctttatttgttttgctcttcatttgttcctcagagcacattgcacttggtcgacatttgttgaatgaatgagtaaagaattagtgatggcatatttacatacccatgttcatggcagcgtttttcactatagccaagaggtgaaagtaacccaagtgtctgttgacagatgagtggataaacaaaatatgtcatatacatacaatggaatattattcagccttagaaagggaggaacttctgacatacgccgccaccacgtagacgaaccttgaggacattatgctatgtgaagtaagccaatcacaggaagacaaatcttgtgtgagtccacttatatgatgtgtctaatgtagtcaaattcatagaatcacaaaacagaatggtggttgccaggagctgaggggagagggaaatggggagttgtttgataggcatgagtttcagttttgcaagatgaagagttcttgagttcagtatattctgaagtgtgaatatactactgtcttagtcaattcctactcctgtaactgggaagtttataaaaaacagaaatttatttgcccacagttttggctgggaagttgaagatcaaggcaacagcagatttggcatctggtgagggcagctctctccttccaagatggtgtcttgttgctgtatccttacatgacagaagaggtggaaagcaagggggtttagctcagtccctccagcccttttgtaagagcacaaatcccattcatgaggttggagccctcttaatcacctcctaaaagctcctccccttaacacttactgtattgggtcttaggttccagcacatgagttttggtgggacacatacattcaaaccttagcaggtgctacactgtataccctagaaaaatgagaggttaggagtgccgaccctcacacagtcaaaaatccatgtataacttttgactcccccaaaacttaactaatagcttgctgtttaccagaaaacttaccataacataaacagtcaatgaacgcattttatatgctatatgtattatatactgttttgtcacagtaaagtaagctagggaagagaaaatacatttattactcactaagtggaagtggatagtcctaaaggacttcatcctgattgtcttcatgttgagtaggctgaggaagatgacggtttggtcctgctgtgcccaggcggcagaggcggaagaggtggaggaggtgaaggggaggcaggggaggcaggcacactctgtataacttttattgaaaaaaacccatggataagtggaccagggcagttcaaaccttgctgttcaagggccaactgtacttagaaatggttaagataataaattttaggttatatattcttcagcacaattaaaaaaaagaattactgctgctagaaactatgacctctggaaatcactgtagaagaatctggaattcttaaattctaggacacctctgacttctgggtagtatgcatgaacttaagggaaagaagtatttatttcctcatgaggataagctcaggtgttttccttaggactgtcagagtgaaggagtgggctggcctgaaccctccccgagttgcctgggttctcaggctcctctgcacctggagctagtgagccagcccatgggctgaacctggctggtgtgtacagagcctgcacatgtctgcatagcctaggttgaggtttggacacttgcttagattccaaggtcctcctttgtacccatttatttatataataaataatttattattatttttttgagacggagttcactcttgttgcctaggctggagtgcaatggtgggatcttggctcactgcaggagaagtgattctcctgcctcagtctcctgggtagctggggttacaggcacccgccaacatgcccggattttttgtgtgtgtttttagtagagacgaggtttcaacatgttggccaggctggtcttgaactcctggcctcaggtgatcctcccacctcagcctcccaaagtgctgggattataggcatgagccacggtgcccagcctggattttttttttttttttttttttttgagacagggtctcgctctatggcccaggctggaatgcagtggcccgatctcaggtcactgcaacctccgcctcctgggctcaggtgatcctcctacctcagcctcccaagtatctgggactacaggtgtgcacaaccatgcccagctaatttttctatttttagtagagatggggtttcaccatgttggccaggctggtcttgaacttctggctcaagcgatctgcccatctcagcctcccaaagtgctaggattacaggcgtgagtgactgcgcctggcaaagtgtaggatttgaaacataaacttgtattcatttttgatctcatttaactgtcataacatgaagaactcaactcttagggaaggacacacatttcccagtgcctgtccagcaccagcacgagtgctttgtagagattgcctcatttcttgccgacattgcccttctgaagtgtagatggttttatcgccactgtataaagaagggtatagtgtatccaacgccccacagctaagtgacaggacaaggatctcactccagatcttgtgactttaaaaatcactttcttggctctgcttctccttgtttcctagatggtggccatctcatggtccagatttatatacatctcagcctcaaatcaaatggcacactttacatttgcacgctgtttggccaagcccattggcatataacatacactatggtagcaagaattggccagaggctccccaagaccagacttctgaattcctaaccccagctcccaagccccaggcatcccataaaatctttgctagatgttcagaaacctaaaatttgcttctccacccctcccttctccccaagtggtaaagacaaagaacagacggcagggctctttgttattcttttatctgctaagtttacaaaaaggttagacagtggaactttgctgagcaagcattctgtccctgagttgtctctgagcagcaccaaatgagtcttatcttccccttgttatctccaaggacgtaaaacattttcttttcatgctttttaatttctgtgtaacattagccattcagttgacctgaaacattgctagtttatttctagctggcgtgtgtgtgtgtgtatcagagggtctatactgtataaatacttctctaaatattcttttccataatgttgctctaaagtgtctcatttactcaattctgtcaacttagatgctgaatcattttatgtgcttaaaagaaatatctactcggatgctctagttccctggcaagggagagagagggagagaaagaaagctgttgaagtggtgcaaatccaaactgctttcttttttgctcataagtagtgcttttcaaagcgtttggcatccctgccatatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtaggatatggggaaagggtgggaccagcaggaaaccagcaagcagagtgcccagtggttcattctttcactcttattcttttcttttttaattaccacagatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaagtcacattttcttgtggccattcttttgttttttttggagacagagtgactgtcgcccaggctgaagtgcactggtgcaatctcagctcactgcaacctccgtctctcaggttcaagcgattctcgtgcctcagcctcccgggtagctgggattacaggtgtgtgccaccatatccagctagtttttgtatttttaatagagacagggtttcaccatgttggccaggctggtctcaaactcctgacctccgcccgcctcggcctcccaaagtgctaggattacaggtgtgaaccactgtacccagcctcttgtggccattctgactggaagctgaagtctagttttccagtgatagaaaactggaaacaaatttcttctttaccagctgagtggtaacacagtcaaccaggttgcctctggcaacaaagagttcttggttatgatggactgaaactggcagagacctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaattttctttgtggtggatttgtatgctacttcctatttttaaatgcaacttttatttcagttactaatcatagaagtgattactaacctccttgtcgaacattggaaaatggaaacgtgaaaaagaaaattatacccataatcccatccctcagataattttggtgtattttctccaattacgtatttgtggatgtctgtgtgtatgatacttgagggtgtactgtgtttgtagttctatttcctattttttctgtttatcattctatcactaacatttctcaagtggttacaactgtgcagcaaggtatttaaagcgtggtgtacacatcatcattaacaaccacagagcaatatatcccatggctgcttcataagtgaacaattctgttgttggctgttcggattatttccagttgtttgccttttttttttttttttttttttttaaacatgaaatgcacctctttgtatgtaatccagttttgtatatcattgatcagcatttcagtatttttctgcaggcaagttctcagaagtagaattactgagtaaaagaataggaacatttttaaggcccttgatgtttactgccaaatagcttcctagaaaagttgcatcaatttacacccccacatccactcttcctcttcctcttcttcctcctcctcctcctcttctttcttttcctttcctttcttttcctttctttcctcctcccttcccccctccctcccccccttccttccttctttccttccttcctccctccctcccttctctctctctctttctttctctctttccctttttttttttttttgacagggtcttgctttgctgcccccaggctggtcctgttcttgaactcctttagcaatcctcccacctcagcttcccaaagtgctgggattacaggcgtgagccactatgcccaaacaccacttacattcttgaagtactaaaataaatttagaatttaagcaagacagattaggaatttcggcttgtattaataaaaagaacaatgaatttggaaaaggagaaaagagtcttggttccattaagggtcttttatgatatgaattgacacaaaggagttaggcttgtgttttagtggtggcagaaatttggcttactggtaactgagttatactataaaggtgcccttgcttatgtctcttccaatatgggtgctgtcacttataaatcatttaatgtatctcgaatttctgaacactcctcagggcattgactaaaatttgcatattccataaataaaagccaccttttgtgaacaggagaaaaatgtactagttaactatatgataagactgtttgtttgtgttctttaaatccaggaatgagccctttgcaaacataggtggggaggcgaggaggctttcagcaggagctgggttgtcgtctggttccagcaattttgtgatgcgggcagtgccactgttcctcagaatgtccagcagtgtgcctgatggacccccagtgccttcaccacccctttttattcatatcctcctttgttctgggaaagatttaaagctgcctacagtatacatggaacataatgaaaaaaaaaaaatgatgctaagcaaatgaagaaacagggagaagagtatcagtagagggaagatagagccatgagtgagagccgtgttcattttctgcgccgtcaggactctgcagctctccagaagccagtgtggccccagcggcacctgcatctatgatagaattatgcctgtgcttctagcccagtgagatagatgagcgatgggtcttccagaatgacatcagatgctactgatgtcactaacatcagtagtaatttgacactaacaaatttctttatatgaagtaaagttggttaggaacagtccatttaagcaatcgcagctgtcttttaagagaaaggttcccagtcaatcttctccctccttttcgaacctcttttcagttggggtcattttgccagttctagctttcatatacatatgtgaagagaaagagatttattttaatgaattggcatacagggttgtaggggattggtaagtctaaaatctgaagggtagaccagcaggctggagacccaggggagagatgcaatccaatcctcctagctggtgtgaggtcagtctttgttctgttttaaggccttcaactgattggatgaggccgacctacatttcagagggcaatctgctttactcaaagtccaccaatttgagtgttaatctcctaaataaaacaacaacaacaacgaaacttttactgaaacaaccataataatgtttgaccaaatatttgggcatcatggcccggccaagttgatgcataaaaattaaccatcgcagtccctcatcctgtttaccatgtaggccaccctacagccatcctttttgtttagtgttaaagcatgagtgaatgaatgaaccagaaaaagggagaattatttacatacatatacacgtatgtataggttttgtacaatatatatactctggatatacatgtattataaattttgtttttgttttattattttttgagacacagtttcactgacccaggcttaagtgcagtggtacagtcacaactcactgcagcttcgatctcctggattcaagcagtcctctcacctcagcctcccaagtagctgggactacaggtgtgtgccagcatgcccagctaatttttgtattttttttgtagagaagaggtttcaccatgttgcccagactggtcttgaactcctgggctcaagcgatccatccactttggcctcccaaagtgctggaactacagactacagaactacagagccaccgcacccggcctatattttgttttaaataaagatgagcaaatttgatgaatagaaaagcattaaaaatgggctggcgtggtggcttatgcctgtaatcccagcattttgggatgccaaggcaggtggatcatctaaggttaggggttcgagaccagcctggccaacatggtgagccaccgtctctactaaaaatacagaaaattagctgggcgtggtggcgggtgcctgtaatcccagctacttgagaggctgaagcaggagaatcgcttgaactcgagaggcagaggttgcagtgagccgagatggctccattgtactccagcctggacaacaagagcaaaactctgtctcaaaaaaaaaaaaaaagaaaagccttaaaaatgaagaaacaaaaatgaatgaaatttgaataatagagctgaaactccaataaaaataaaaatacttcatatttaaaaataatatttagtgaaataaatgagacaaaaggctgaatggcaaataatatgtatatatgtttgtgtatatatacagagacagataaaacatatttccatcctgctttttattttaaatctcatttatatatacatagatagaaaattggcacattttatattccccacactagtgactgcaaaggcacttatagcactttggcatttattttgcgcaataagaagtggaatgtggtttgattgcttctgcactgtcctcggatgccgttccaccttcgagagtccaggttgctctgtctttctgagtttgagtctgtctaggaaggataactggggaagaagatcctgactgaaagtatcctggggccaggtgcggtggctcatgcctgtaatcccaccactttgagaggctgaggcaggtggatcacttgaggccaagagttcgagaccagcctggccaacacggtgaaaccctgtctctaagtaaaatacaaaaattagcagggcgtggtggcaagtacctgtaatcccagctactcaggaggctgaggcaggagaatcgcttgaacgcaggaggcagaggctgcagtaagctgagatcacaccactgcactccaccctgggcaacagagcgagactccgtctcaaaaaaaaaaaacaccaaaaagaggccgggcacggtgactcacgcctgtagtcccagcactttggaggccaaggggagtgaatcacctgaggtcaggagttcaagaccagcctggccaacatggcgaaaccccatctctactaaaaatacaaaaattagccaggtgtaatggtgcttgcttgtaatcccagctactcaggagactgaggctggagaatcgcttgaacctgggaggtggaggttgcagtgagccgagatcgcaccattgcactccagtctgggtgagaaaagcgaaactccatctcgaaaaacaaaaataaaaacagaaagaaagtatcccgagagacatgggttgagctttgaaaatgcagctgtcccttggtgtctgtggaggatgtttcctatgacctcccatggataccaaaatccagcgatgcccaggtctttgatataatggtgtggtaggccgagtacaatggctcatgcatgtaatcccagcattttggaaggctgagggggaaggatcgcttgaggccagttcacctgggcaacatagtgagacaccacctctaaaataaaaaataaattagctcagcatggtgtcgcgtgcctgtggtcccagcttctctggagactaaggtggaaagatggcttgagttcaagagtgtgaggctgcagtgagctatgatcacacctctgcactccagcctgggtggcagaacgagatgctgtctcaaaaaaataaataaaataaaatggtgtggtatttgcatataacctacatacatcctcctgtatactttaaatcatctccagattacttatagtagccaatacagtataaatactgggtaaatcgttgttatcttgtattgtttttctatttgtattttttattgtttttctttacccccggggaatatttttggtctgaggttggttgaatccgaggatgcagaacctgcaggtatagagggcccagtgtccaggagacccacctctgaggttcaggggagagaggaatggagagaacctggacctggaagaaaggaggggagggctggagcagggcaggagcttcccctctctcctccccctccttccctaatctcccaccacatgctctttcttttccgctttaattcccttccctctgcccccgttccattctcacacatttccattaggaagcacagaggggcccaccatagggtctgtgggaaatggaaatggtgactccacacaggaaacacggctccacctcatgagaagcctgggaaacgggcatgacagcaagacagtttggaagggtattaaaaagggaaccgctagatcctgaatgctgtccaaataaatgcacctttgagtcccagtgaaacatatgattttctgggcaaatctaatatgtaaattattcacaccagatattttaaaatattaaaatgatgttatacatctataaatacactggcattttattactcaaaataatatggtgagtcagaatataaaaaccacgaatgaagtccctatcccaaatcagatgttagttcctccccaaagctggttctcttattatccccatccttctgaggcagccacaaaaattatgaactcagattctgaaatcaaagtgactttcattcaaactccagctctgtcaggtacaagctgtaaaaccttgggcaacttacttaaatgttttaagcctcagttttctcatttatagaataggaatggaaaactataactaacatgatgccctaagttttttgtggcatgttaatcagatcgcatatataaaatgtttgcaatagtggctggcacaaagtaagtgctcaataaaagcagctagtattattatcactgtcaatggttttgccacatcaatttagaaacctgagtggtgtctttgattttcttactcttcctccaagtgatgacctactttattatacttaataactatttttaacttgtccctctgtcccttttcccacagccactaccctagttcagatggttgtaaactttctaatcctccactcagctagcaggcagaatcatctttctaacttagatctgagaatgtctccctcctgcttgaaaaacagtgatgacttccccttgcctagaaccaatttctttttctcttttctttttttttttttttttttctaagatggagtctcaccctgtcacccaggctggagtgcaatggcgctatctcagctcactgcaacctccgcctcctgggttcaagcgattctcctgcctcagcctcccgagtagctggggctacaggcgcgtgccaccacacccagctaattttttttatttttagtagagacagggtttcaccatgttagccaggatggtcttgatctcctgacctcatgatccacccgcctgggcctcccaaagtgctgggattataggcgtgagccaccgcacccggtctcaatttaatttttttacagcattcaaaatgattttccacaccatctgtccctatagtagacttcatcactggcttcagttcttcatccctctatgtcctctatgtatctgtgtcctctgtcctgtgactttacagctcctcccactaaaggtcagaagttatttctttgacccttggctttggattggccatatgacttgttgtcttgcacctctgctacccatgagaggtgctgtgtgcccagggcagcacgagagagatgtaaacagaagcactctagctgagtccagcctagatcagccaacccacagatgtatgagaaataataaacaagggttgttttaagccaccgagttggggggtgagttgttatgtaacaataaacctccaaatcctttccatgtaacttcgtcctgcaaaactcacgtatgctctgattatatggaagcactccctgaattctctgtggctccctccactggaggatatccttcctctttctttaccatcttttaaaaccctattatccttctaggtccagttactatgtcacattttctgtcaagccttctctgatgcccccaatcaaatttgtcattgacttcttcaaaaagctcccatatccctttatctatatcctctggcattctagttattgatgcacaaatctgcttcccactagctgcttctcctcctccttttcctcctcctcctcttcctccttctcctcctcctcctcatggagttttggtcttgtggcccaggctggagtgcaatggcacgatctcggctcactgcaacctctgcctcccgggttcaagcaattctctggcctcagcctcccgagtagctgggattacaggcacatgccaccatactcagctaatttttgtatttttagtagagatggcatttcaccatgtgggccaggctggtctcaaactcctgacctcaggtgatctacccgcctcgacctctcaaagtgttgggattacaggcgtgagccaccgcgcctggcccccacttgcttctaagttccattaagggaggtgtatctgtattcacctatgtattcttatcagtgccctatatgaaaaatggagtgaattaataaggagagaaataaattgaaattcactatttgcttttatgacaaaagagggttgatgacataatgattttctcacatcatgcctggtttaaacttcaacacttgacaccactgacacaaactggaaaacattagtagaagtggagaaaatctgctaagatcttaatttgaccagactaatgttaaagtgtaattttcaaaggggtgaaattattctcatgcaagtataaaatgaactcagtactaaaagagggaaccaatacaatgttaagactcgtttaaagcgcatttgaggaactaggtaatattaatataagcaatttaagaaatattcggataagaactttgagttgatacaaaattgattaattacctacagaacagtaaatgataacctttgtaaatatcttttccactagacagaaattatttgcatctctaccagacaaaaatttacacactgacatgtaatttcagtaagtctgggaattttgatcagtagttttagcactaatcagtcattatggaattattatgcttagtaatcacctaaactattttgttggtcatttaattctctagatttggattatagcaggaaggcatgttaagtcaattaaatatttattgactgcctctgtgtgcagataaacacaggcattatggactaaatatgacttattctctgccttcacgttcaacattgtaaattttttagtttgctctattctttagagtttacgataaaatttcctgaatagtttgatttgttctttgtaacagccctgcatagtaagaatggcaggtgtgactatgtccattttattagtaatccataccttagttctgtaacttggttggagtccttcagattataagtcacacatacagtctagattcaaaacagtttcgtgcttttgagtccagtttccctctctttccatctagagctcccttctggaggatctcttgaaacagtttgttgatcatgtcttatggttctctatttacatttttaaaaagcactttagagctgagtctgcaaactgacagaacccatggaactaacctagctcaaaatacgatttatttggcctgagtgaggtgatgacatttttaaatttaaaaatgaagtccagatttcggacttttctttttcttttcttttcttttttcttttgagatggagtctagctctgttgcccaggctggagtgccatggcgtgatctcagctcactgcaacctctgcctcccgggttcaagcgattctcctgcctcagcctcccaagtagctgggattacaggcagacgccaccaggaccagctaattttttgtatttttagtagagatggggtttcactgtgttggtcaggctggtctcaaactcctgacctcatgatccgcccaccttggcatcccaaagtgctaggattacaaacgtgagccactgtgcccagctgggacttttctttttaaaaatggtaagttttggcgggtcacagtggctcatgcctgtaatcccagcactttgggaggccgaggcaggctgatcacctgaggtcaggagtttgagaccagcctggccaacatggtgaaaccccgtctctactaaaaattaaaaaagccaggcgtggtggtgcatgcctataatcccagctactcggcaggctgaggcataagaatcgcttgaacccgggaggctgaggcatgagaatcacttgaacccaggaggcagaggttgcagtgagctgaaatcacaccactgcactccagcctgggcaacagagatagattccatattaaaaaaagaaaaacaaaaaaaaggtaagtttggtggtgctgggcatccatccttgcatgacaactgtaggctggagctgggtggctgctgctccgtacagacagcactcacccagactgactcactcatatggccctcctaatgtctctgggcattgagtttgcaacccttgctcacctctttgctgcttcctctttccccttcgagtcccatgcaacgtgcagcacccacacggccttaaggagagccagcattttgaaagtgcatgcagaaggaactctgtagctccctgcgtgggtctccggcttcctctggaagacgggctctgtcaccaggctctggtgggaactaatgagcatatgttttcaggtcctgttctctgtggctattacagtttaaatgggttgaaataagacatagagattcaggggaacatggggaatatatttttgtggtttagaattttatttcccaaagctgtgctttctgaaagattgctgttctgaaagattgctgtgttagcaaaggttaggttaggttaaattaggctagattaggttaggtttagcaaaggttaggttaggttaggtttgtggacatggtcctggaaaaagcattctgataattctctaaagaaatagaatgttctctagcacataagcaggagattagata

SEQ ID NO: 1328 - DNA, 23079 bp, Homo sapiens
tggtggaaatattgttatgtggcgcatgactgtatacacagaaacacacacacacacacacacacacacacacacacacaatggaatattatttagtctttaaaaaggaagaaattctgtcatttgctactacatagaggaatctgaaataaaataagccaggcatggaaagacaaataccgcatgatctcacttacatgtgaaatctaaaaaagttgaacttaacagaagtagagagtagaacagtgattaccagaggctgggggtgcggggtgggcaatggggagatgttgaccaaagagtacaaagtttctattaggaggaatcaattcttaatatatattgtacagtatggtgaccatgattaataatcatgtatcgtatatttcaaaattgctacaagaatagatgttaaatgttctcactatataaaaatgaccagtaaatgaggagatatgttaattagcttgatgtaatattccacaatgtgtgtatatatatatataaaacatcacaccatatcctatacacatatacaattattgtcaatttaaaataaaattttaaatttaaaaaagtattacatcaatgctgtaaaacaagagagacagagaatgtattgagataataattctgtgatattccatgtttcatcctatccccacagttctaaggacacaaagctggtttcatggtcttgaaacctatgcattcacacagggcctcaaaatggtttaatgttctgctgtcattgtcttgaaattcttaataatttctgaatacacagccctgcatattggtttttcataaattatgtggctatagctgaccctgtaagcatacaatatatgctgattaaatgcctctaaaataaaggagcaactcagagatattgtgggtttggttccagaccattacaataaggtgaatatcgctataaagtgagtcacacaactttttggtgcatataaaagttatatttacacaatactaatgtttattaagtgtgcaacagtatgtctaaaaaaagtacatttcttagtttaaaaatatttagttgctaaaaaatgctgatgatcatctgagccttcagtgaatcataatctctttgctagtggagggtcttgcctcagtgtggatggctgctgactgatcagtgtggtggatgctgaaggatgaaatagctgtggcaatttgttcacagggtctcactctgtcacccaggtgggagtgcagtggcctgaacacagctcactgtggcctcgacctcttgggctcaagcaattttcccacttcagcctcccaagtagctgggactacaggtgcttaccaccatgcccagctgatttttgtatttcttgtagagacagagctttacgatgttgcccatgctggtctccaactcttgggctcaagtgatcctcccaccttggcctccgaaagtgctgggactacaggcatgagccaccatgcctggcacaaatgtcttaatggcatctagaaaagtgaatccttttgggaaggttttcaatttactgtgcccagatccatcagaggaatcaccatctatggcagctatagctttacaatatactttaggccaggtgcagtggctcacgcatgtaatcccagcagtttgggaggttgaggcaggtagatcacttgaggtcaggagtttgagaccagcctggccatcatgatgaaaccccgtctctactaaaactacaaaaattagccaggtgttgtggcacgtgcctgtaatcccagctacttaggaggctgaggcagaagaatcacttgaacccaggaggcagaggttgcatgagccgagatcgcaccactgcactccagcctgggcgatagagtgagactctgtctcaaaatatatatatatatatatttatattatatatatatatatatatatatatatagatcatacatattatagatacataaatatatatatactttaaaaaatataggccagttgcagcggctcacacctgtaatcctagcactttgggaggttaaggcaggcagatagatgaagtcaggagtttgagaccagcctggccaacgcggcaaaagctcatctctactaaaaatacaaaaattagaaaattagctgggtgtggtggcaagcacctgtaatcccagctacttgggaggccgaggcatgagaatcgcttgaacccaggaggtggaggttgcagtgggccaaggttgcaccactgcactccagcctgggagacacagtgagactccatctcaaaaaatatatataatagatgggaaaaaaatattcttgcctataggattgactgggaagatatatgagggaactttctgggtgatagtaatgttttgtatcctgataggagtttgaattacacaaatgtatgtatataccaaaactcacggaatgacctacctaaaaatctgtgtttttcactgtaggcaaattttacttcaagggaaaaaaattaactataagcaaatattgaactcattacttctaaaataagttgcaaaataaaatcagaagagtattgacgtctgcaacttactttaaaatgaatcaaaaaataagatgcattgatggatggataaagggatgagtagatagaaaactagtataatgttaatgctaaaatctaggtggtgagtacacaggtgttcactgtaaaattcttatatatatgtgtatatatgtgcgtatagttatatgtatatacatatatacacatatatatacacacatatatacatatatatatatatatttttttttttttttgagacagggtcttactctgtcactcaggctggtgtgcagtggcccagtcttggctcactgcaacctctgctacctgagctcaagcgattctccagccttggcctcccatgtagctgggactataggcgtgagccaccaacacctggctaatttttgtattttttctagagacggggttccaccatgttgcccaggctggtctcgaactcctgagctcaaagcgatctgcccaccttagtctcccaaagtgctgggattacaggcatgagccaccatgcctggccccttttctgtatgcttttagtaattcataacaaaacggtctacacatattgatctacatatgttgataaggcacaatctccaacatatattgttaggtggaaaaagcaaaatataaagcattatctatggtatgctcccaaatgtataaagaaagagagcctgtatatattatgtttgcatatttatggtctctctctggggagggggtacccagaaatagttgggaaagagattgcctcatgggaacgggactgagagactgaggtttggggatataaaaaagacttactctttattataattttttccctgttgaattttatactaaaagtgtagatcattttttaattaactaaaataactatattttagtaatccatatatttaatttttatgtttgtttgtttgttttttgacgaagtctcgctctgttgcccaggctggagtacagtggcacgatctcagctcaatgcaacctctgcctcccgggttcaagtgattctcctgcctcagcctcccaagtagctgggactacaggtgcgtgccaccatgcccagctaatttttgtatttttagtagagacagggtttcactatgttggccaggctggtctcgaactcctgacctcatgatccacctgccttggcctcccaaaatgctgggattacaggcgtgagccaccatgcccggcacatacattaatactttttcagatactgtcttcttcttcttttttttaaagacaggatcttgccttgtcacccaggctggggtgtagtggcacagtcgtagttttctgcaacctcgaactcttgggctcagacaatcctcccccatcagcctcccaaagagctaggattacaggcaggcaacactgcacctggctaattttttaatgtttttttgtgtgtagagacagggtctcactatgttgcccaggctgtcagatactgtctttaattgttatttaattatttcatatgcatctcttatctctctacccatatcagaaaatcctggagaccacagtcaaatatgttacctctcctggatagatgcccttagaagttagcacagggctatgtacaatgtagttacaaacaaatgctccatggtgaaatcaggtcccagtgacaggatggtacccctcgctggtcccacacacagttgtgcacattacagtcagacccagactcactttggctgtagttccccaagctggaggagcagtgtgggaaaggggtgatatacgtgggtttattttcaccaatttacagattagtaaccgaagctcagaaaggttaagtaacttgcccaaggtcacactgctagtaagtggtagaaatgagatttgaaaaccagggttggccaaaacacatgtgcttaaactgcacggcctcctgtttgctagtatttacaggcatatccatgtgggactctgctgtcactatctgtagacatttctaacaaacacaatgctctttttgttgttgttgcttagcaacaactacactcaatttctcaaattccagaaggtttttgtggcttaatgccgagtatctgagctagactgactgcctcaaccccattgttcactcagttcttgtttagcgagctttgtacaatattaaaactagttgatggggtaagtgcatgtatttatccttacatactggaggatttattattttttgaaagcatttccatctagaaaatatcaatgttgctcacctatgtcatgataaaccatttatccaccttccttacacattttggagaagctgtgactaaggcaatttctgaaggggaaaacacacccagctgaattaaaaggtcaaggttctgagtttccttctaactaaagaaatcgtgtactttctctgagcttgtttcctctgtaaaatgaaagtgataatcaggcagcccaaatgattgttaataaggatcaaatgagatcgtgtatgtgggtccaatcaattgattctacacaaaggtatgtatctattgtcactgatatctttttagaagtcaccagcagtgtgttgtatgcttattcagtttaaactgatctattttttagttgtcttaatcagatgataaaaggtaagccttccaatacagagcttgcaatcttcatttccttatcctgccttatatgtcaataaccttaatttaccttctgatcatctccttggctgcccgtgctgtctgaaaatcagccttttcttaaaatggcaaatagtggggaaaagtagcatctaaccactcctccagagaagggcagaataatgattcagaatgcctctagtgttttgttaaattatcatttgagagcagcccaagagagcatttagagtgggatggtgtagtgcttaagagccaggattctgggttcagaccatgggttcaaatcctgaccccacccttaattagctacccacatacctcaagtttcttacctcatctataaaatggacataatcacagtaactacctcttagtatagcatacgtattttaaatcacttaatttgtgtaaagtatttaacacagtgaggagtatgcacaaaacattctacacatgttgatactataaagcactcccagattcagaaacacaaaaatcacagaaatacaaagccacagagacaagcacacagtgggaggcaataagcttgacttctcccttgttctccttgcccttccacttcccttcaccgtcaaccacccaaatgagctgggaagagtgggcaaggagaagtcattccatctccagtagggtttgtcaaaggcaggcaagtagaaagtggatgacaattgaattaagtgatgcattcctgttttgctaaggatattaagttgacgaagaaataaaggaaagcaaaacctttgggaagcaatttggccatatgcattcgggacaataaaaactttcctattgcttgtctcttgataatgacatttcttaaaattcatcctgaggaaataatccaaaacaaaaggaaaactatacataagatgtttattgcattagtttttaaacagttttcttaaggtgtgaaaggaaaataaatcttgggatcccaaacttactaagccagagggaaaagtcaagctgggaactgggtcatgcaaacctgcctcccattttggtttctttggttttttgttgtgttttgtttttgtttttgtttttgtgttttgagaccaagtctcactctgtcacccaggctggagtgcagtggcacaatctcggctcactgcaacctctgtctcccgggttcaagcaattctcctgcctcagcctcccgagtagctgggattacaggcacgcgccactacaccggctaatttttataattttagtagagatggggtttcatcacattagccaggctggtctcaaactcctgacctcgtgatcctgatctgcccacctcggcctcccaaagtgctgggattacaggcatgagccactgcacccagccccattttggtttccgaataagatggctacaaagatgaaaagctacacacctccctcacactttgcctacaaggaaattctttatggtaaccaagatctttaccctaaagcatttcagctaaggttcaccatggcaatgtaaattgatagcttatcttcacaggtgggggaacacaggacagaaatgaaagtcatccctctgcccactgagacaaatgcatatctgattgtttcctctgccctattatctacattatcttatgtaaaaatgcagattcactgagccagacaaaggcattaaatattgaagccaccaaaatcatctttaaaaaaaggcatagacttgtctcccgggtgcccttccttaactttggcaaatctcctaaaataattgagacttgcctcagtcattttccttgattgacaaaggtataattcatccttttaaagtgtacaatgcagtggggttttttaaagaattattcagagttgtgcaagcatcaccattatataattttagaaattttcaccaccccaatatgaaactcatttgcagttactctccatttcttcctctgcctccccacccctagcaaattctaatctactttctgtctcttgtattattattattattattattattattattatattaatttttgagacagggtctggaatgcagacaggctggaatgcaatggcatgatcacggctcactgaagcctcgacctccatgactcaagcaatccacccacctcagcctcctgtgtacctggaactataggcgtgtgccgccacctccagctaatttttgtatttttttgtggcatgatcacagctcactgcagcctcaacctccagggctcaagcggtcctcccacttcagcctcctgagtagctggaactataggcgtgcgccaccatacccagctaatttttgtatttttttttttttggagagacatggtttcgtcatgttgcccaggctggtctcaaactcctgtgctcaagcaatccgcccacctcagcctcccaaagtgttgggattacaggcatgagccactgcgcccagcctgcattattattattattattttttaattattttattttttgagacagagtttcactcttgttgcccaggctggagtgcaatggcgcaacctcggttcaccacaaccttcgcctcccgggtcccagttcaagcaattctcctgcctcagccgcccgagtagctgggattacaggcacacacctccatgcccagctcctttttgtatttttagtagagatggggtttcatcatgttggccaggctggtctcgaactcctgacctcgcgatagtccgcctcggcctcccaaagtactgggattacaggcgtgagccaccgcgcccggcaacctgcattattttaatggccaaaaatattgagtgaaataggctcagtgttattgagcaacgtatcatgagggtatattaatcaaattatggcatatcgattcaatgaaatattacatggctgtttgaaattactacaataaggtctttatcagggtgaaatatatacaatataaagtataaaactttttaaagatacaaagtggttagtatattctggtttgcatgtggacagtctggaagaaatatataaacgttttaaatggccgtgttaggataatgagaagatagacaatttttttttctttagcttttaaatattgtcatgttttttcttttaacaaatgcaatttttaaaaattgattttacattactggaattgagaatgtatgaacgggcacagccagccaccagtctagcctctccagttgggatccagttcttgtctatcgtactctccttccggcaaccaagagacttaagctacaaaggtccgcctctcccagactctccccttacacctcaggcccataccttttggccccgtgcctcttagcctacaccttcccattcccacaactcactccttaacaaaccccctttcctatcacacacaccaatgacccttggccaatttccttctattcatatgttaactgtagactgcagtcctgattccagctgtactttccccttatgagcagaacagtgaggaaattggctgaaacagaacaacaatcagcccccctcactcctgtgcctactttgcatagagacacacctcatttagactcccacagccttcctgttaatgtctccttcctctctctgctatcgatctggggctctgggacagagaatcttcaatatcccaccagtgcccacacttattaccactacagacacagttattctcattcccatactctctctctctctctctcacacacacacacacacacacaccctctcctatgcttccccaccccagctgtccctggggagcctggattggatttgtgcccacggtctgcagcttccctcggtctgtctgctggtcaccctctgaaggaacggggcccagttttgttcaccctctggctcaaggaccaagtatgcttctactcactctctacctccaagcacctaccctactccgacttaactgcctgacccacaactaaaaagaacagctctttgatcttcacaggtgtggtgaggcctggtgagaggggagccttctagttagtgacctaccacgtttcaggaaccatgttagtttccaggattcagagatgattaaaactaatcacgcaccttgagaaactcacagtggaaggaaaatcagtaagcagaaaaatgctacataaccaggtaaatgctgggacaaatttaggaaggaacgatgtggatacactggagcaggctccaaagcagcatcacctcggaggaggatcttgaagactcaagagttaactgggtcaagaaatatacacactaacacttctgacaggtctgcagaatacagggagtccataaaaatagcacttgggtaatggaagcaggacacaccattccatgcccacagcattactttctgtgtgcagtgcactgtgtgatgatctacagagattaaataagccgaggtctccgcttccagtcacttgggagagacgcacaaggtaaattacccaaatagaaggcaaactgcccagggctgtaattaacatacaatatgcgccgagagggaaaggttaatgctaactccggtcctaagtacaaagatcattgggagtcaggggtgcactctcattagggtacagcatgggtgggtggagagagtaaaaaccagaacaaatcaaggttcagcagttggaagtcagccttagggagaaaaggggcggagactgactgggccagaacagggattgggacagaaaaagagggtggggccagtgggctccacctacccgctccggcccttcccaccaccccccaccccatctactttctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggtaagtggggctccctcccctcttctctctaacggggctggattgagggcctctggctggggaggtgggggtggagatccagtaggagcaataacagaggaagggcagggcctgccccatcacctgaattccagagatgccagtgtgcactgaagccccaggcagggcgtgcccaggaccggatcctggatggtggtaagggacaaagctggaagggagactacagggaaggagaaaggaaagaaggcagagccatgacacagtcaacttacagaatggctgggagtcaaagctcctgggctggtttcctggctattccacacactccaagacatagagagaatttcggaactggaggggactctacagatgatttatttgagattgaagaacctagaaaccaaacaaagaaatatcatatggttactttggtatctgacacagccatgacaccaattgctagtgtagacacaatagctgtgtgtctttttgcaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacggtgagttaagggtgggcatcgtaagaggaatacaccttgggcccatcctccctctctccctgtagtctctgaggcagagagtctctggtttcctgtcattggcatcagcgggaggaggggtcagaggccaacagaggatcttttgcccacagcagacaaaaaaaagggaaaaagggcttctttcatggaagccaccaatggccttatttctcttccctcagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccacgcccgtctccgtgaagttatcgccataggccggccagggggcgcgagaggcaccggggtgatttccgcgggaatcgataaccaatcggattcccaggccgaacggagcacacccgcccgccctcgctctttccccgccctttgccccgccccgctccttcccctccttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggtaagtagggaacggtcttagggctccttaggggagcccagggaaggggagcgtggcccccaggcgtgcggccctgcagccccctcccctcggagccccggaaagcagccgtgtccgcgcttcctgccaagggtgggacgcccgcccgagccgctccgagcctgactccgcgcaagggcccgcgggcggacctcttggccttgtctctcgtgggaaaagactgccccagcctccctttgttcaacccacgagggttctaaaggggaggtctttgcagtcctgcccgctcttgggttctcttgaagattcttcatcctttcctctggctcccttatgagggaaactataaaaagaccatactctgtctccttaaaaatcgacgagaccttctgcagacctcggtgctctgcctgatgtgcatttgatttgtatcgattgtatcatgatctgcatggctttgcatagaatgaccagattttcaaagaagtcaatacagggtttggaaattgagtacttttggcagaacaagggggttcctgtggctccgagtgtccatgcctctgccccggtcattccatttcatggcagtcatcacccaggagaacattgtaatgcctcctgctcgagactgaagattaaggtcttcgcaaagggaacctgcagaaggacacagaattaagacgtaggaactccgtggtgcccttcgcccctcctccccttccagttgtgtcctgaaattctaaatgattggaaacttttataatgttcacgtttaagactctcatactacagagtagaggaaggagcgggtgtgcagagggggtgatgcttcagattaaaactaaagagttgattgaaaattcaagtctggaactcgagagagttaagaactataagtcagtaagttgcaagtatgggtgagattgtctagggaaaggctctttgaaggggcgtccctaatggaatatcaatattaagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatattacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccaggctggagtgcagtggaatgatctcagctcactgcaacctccatctccaaggttcaagcgattctcctgtctcagcctcccgagtagctaggactacaggcatgcagcaccacactcggctaattttttgtatttttagtagagacagggtttcaccatgttggccaggctggtcttgaactcctgacctcaggtgatctgcccaccttagcctcccaaagtgcagggattacaggcatgagccaccgtgcccggcctcccctcatgttttaacaccttagaaatcagaatgcattttagagtaggtttttaagttataaatggaagttattgtattttcactgctatcaggtgccacccttcctgctgttacatatgtggaaaatgtgacggggcaggctagagaactctggatttatgtaaactaggcatgtagatgacatattggcaataggattattttagtttataagcagaagctgatctctttgcaagcctgtagcaaaattagctggaggtgacagcacatgcctgtagtcccaactacttgggaggctgaggcaggtggatcgcttgagtccaggagttctgggctatagtgtgctatgccagtcacgtgtccacattaagttcagcatcagtgtggtgatgtcctgggagtcagggtccaccaggttgcctaaggaagggtgaacccgcccaggtcaaaaatggagcaagtcaaaactcctgtgctgctctgtaatgggatcatacctgtgaatagccactgcactccagcctgggtggcacagtgagactcttttaaagtaaatagataaatacctatccactgtgactttctgtcatactttctgcttatccacatcttaacaggattcgccattttgtcactggaacttaaaagttttaaaaaacatgtaattatatgtttatatcactagtgaaagagagttagtgtctgcctcatttattttctgttaaagccattggcttgagtttttaccatagtgttttaaccctcatctaagatcattataaacttacatcactttcaccagcttagataatgtgagatgttttctgaaataattctctttattaaaattggtctatcagagaagtattccttctcataaatatgtgtacttgggggtattgttttgcttaagacagatatttccctcctctagtcagaccattcatctcagatgatctcagctgaacataaaccataaggaattagacattattttcttatgatcaatgtgttcctgcttagtacatctttgctttaaccagatttaagaaatatgcataatcttggttattgtaagtcttattctttttgttcttcctattcatgcctcttccactccactcttctgtgtcaaattgtgacttgacagcctttccttctaccgtttatctgtaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggtatctggaggcaaaagagagaagataaattgatcatggggtgggaatagagcatgacaaaatatggaaagggtgtcgtatctttcttccttttttttttttttttttttgagacagagtctctgtctcccaggctggagtacaatggcgcgatcttggctcactgcagcctctgcctcccaggttcaagtgattctcctgcctcagcctcccaagtagctgggactacaggcaggtgccaccatgcctggctaattttttggatttttagtagagacagggtttcactgtgttagccaggagggtgtcgatctcctgacctcatgatccacctgcctcggcctcccaaagtgctgggattacaggtgtgagccaccacacccagctggatgttgtacctttctaaagaaatggaaatgcccttctaccgtagagcatttgagagaaatgatatataactcaagaataacagaaaggacttcacccatacatacacttttcctgtaaaaagaattcttggatgaggacactactaggaagctcatgtggagaaatagaattatagctagagaagtaaatatgatttcatgttttattcttgtgtcttaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccggtatgaagctttagtaatatggggtgttgggaagggttagtttgactggaaaggaatttgtaagtcagagtgagggagactagattttgttgtatttggaccggaccacttccctaaggtctgtcatcatgagttttgatttcttacagttgagctgtgactacgacttgagtctcccttttccggtgtgtgagtcctgtcccctttacaagaagctccgcctgtcgacaggtgagaattgatggactaaaaggggtcccaggccaggtgccacggcttacgcctataatcccagcactttgcggggccaaggcgggtggatcacctgaggtcaggagttcgagaccagcctggccaacatggtgaaaccccgtctctactaaaaatataaaaactagctgggcatggtggtgggtgcctgtaatcccagctactcgggaagctggggcaggagaattgctagaacccaggagacggaggttgcagtgagccaacacggtgccaccgcactccagccttgccaacagagtgagactcagtctcaaaaaataaaataaaataaaataaaaaggaggggggtgtcccagattgacttcccctttcttgtctggtatctggctttgtcctaacatgagcccttttttttgtttttttttttttttgttgtgttttttttcagaaatagggtcttgttctgtcacccaggctggaatgcagtgacaccaccatagctcactgcagcgttgaactcctgggttgaagggctcctcctgcctcagcctcccaagtacctgggattacaggtgcatgccaccacacctagctcatttttaaattttttgtagagaaggagtctcactttgttacccaggctggtgtcaaacttctggcctcaaatgatccttccgccttggcctcccaaagtgctgggattataggcgtaagccaccatgcccagctgagacatagtttatattgggaacagttgtcagtaaatttgttaagggctagtaggacagtttatgcaggagtttgtggttttttgttttttttttttcttgtgatggagtcttgctctgtcgtccaggctgtagtgcaatggtgcagtctcggctcactgcaaactctgcctcctgggttcaagtgattctcctgcctcagcctcctgagtagctaggattacaggtgcgtgccaccatacccagctaattttttgtgtttttagtaagagatggggtttcaccatctcctgacctcgtgatctgcctgcctcggcctcccaaagtgttgggattacaggcatgagtcactgcgcccggcccaggcaaggtgttattaatagttggtccatttcccttccaccccagataacagtttttgtgataattgggcctttgagtagcatgtatgggcaggaagttcatgctcaattggcctctaaaaagctgaataagaaaagactacatttggggccaccagcctgctgatggagcatcctagtgattggaacgaggcttttatcagctagcccattcggtcattcagccagttgagcatatgcttcatgcaggctatgtgcagagaatcctttagtgagctaaaactaagagtctctgccctcatgaagcttacaggtttgggtagtgagtgagaccaatatttatcacaacccagttgcaagagatgtctgaagttacaatgacatattaagattgatggttaagttatatactagttttttggttttctgtctataccacagatactgtggaacactccctagacaataaagatggtcctgtctgccttcaggtgaagccttgcactcctgaattttatcaaacacacttccagctggtgagtttttgcataatgacaagaggaagagagttgggaaattagacacccttcctgggaacctgaacttagtttgcatgtacatttcctttctgccttattagtcagaaagttgttactggttaaatgccttctgtgagcatttgtctatttttacctgctggaggttaagaagaaaaatacgatgtctttgttttcttgaaatgtctaatctagccgaggaatcatctgttatcaagacgctcatggtctaactggcctctcctccacaggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggtacctgaggtgggaaaaattgacatgtaaattagaggactgaacaacactttgggaccagagacatcgtttgttcctgtgcctgctgggatatgtcttaaaagttggtttattctacttacatttttactcactctgttctgcctctcaccttgcattctagtaagaaagaattagggccggccagccattttagtgttgacatctcaggttgtggtttcataaagtaataatagtccacagttggtgtctcacttttttttttttttttaaagacagagtttagctctgtcacccaggctggagtgcaatggcacgatctcggctcactgcaacctctgcctaccaggttcaagcgattctcctgcctcagcttcctgagtagctggaactgcaggcgcatgcaaccatacctggcttattgttgtatttttagtagagacggggttttgccatgttggccaggctggtctcaaactcctgacctcaggtgatccgtccccctcggcctcccaaagtgctgggattataggcatgagctacggcacctggctgggaaagtattcttaacatttgtgtaatcacaagtcatagggtagattgtttgtggaccagatttctagaaattgtaaacattttcattatgggctgttcgtcattaacctcagttactgtactgcacaactgactttgtgacctttagggtttctattttgcaatcaataatggcctatttgtagattcatattcactctttattttgattccagaatagtagaactttcttcaacttgctttgaggttgtcagtggtgaaattaaaattgctaggagattcactttgatctgttgggatagaggatctttgttttccattcagcattgtctgtagtcttcatttctctttcttagctgccctccttctgtgagagtaattatgtatttactatatttttggcaaggccagtttcatccacaggtacctgggtgttgtcctttacatgctatttttgccagcttcccccttgtagcatatgcaatgtagttaaatccacccttgcttcaaagccatggcagcaacagctgcttcagtcatcaagtattcaggtagtttatatgctttcctgagaagtctgctgggcataaaggggcaaagggcagggtaccagccataattcctacagaaggtcacttaacaaaatgtgcagtgtgtgtgttttcttagaggttttggtctagccatgtcttttactagaaatctattatgtcatggtttttcaagttgtatgcagctgataaaggatcttacatgtctaatagttaaagataaaatactgagtcactaagtcaactatatatactgctgttttctcagagactgtcagatttggtgagtttatgagctcacttcataaatagcatttccatttatggtaagcctgatgcatattcagtgacctattggattctaattctttggttgaattgctctgtaactggaattgcagtagagttgaacttcaagcaccttataatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccaacccctagccaaaaatacacttaggagttaagaaccctgctatttatagaagtactgtaattttatcaaaaacaaatctgcagatcctattttaagctatgctacttgtagaaaaattcctccaaatgtctaatccccatttattgaatggtttagtcttactaagtttggttacaaagtgcgtgtattctttttttggacattgttttctatttactgacctaatctcactaaattcaaaatgctcgtgattcggtgcccaggtatataatttttgttttctttttttttattttgagatggagtttcacttttgttgcccaggctagagtgcaatggcgcgatctgggctcattgcaacctctgcctcccaggttcaagcaattctcctgtctcagcctcctgagtagctgggattacaggcgcatgccaccacgcccggctaatttttgtatttttagtagagacagggtttcatcacattggtcaggctggtctcaaactcctgacctcaggtgatccacccgcctcggcctcccgaagtgctgggattacaggcgtgagccaccgcgcccggcctttgttttcttctttgagcaaaattaacttctttaactattaaatgttaaattctattagcatcagctccagaggaacattcacagttatgtattctcttgaaattatatattcttgaaagaattttttgattatctgtcattaccttaagatttctattattatggtttgcttctacttagaaaatacagatacttttcaacaacaccagtctctttatttctagttatattgcagactttcaaatattttatgtaattgcatctcaattatctacaaacagaagtattccgaacagatca

SEQ ID NO: 1329 - DNA, 24151 bp, Homo sapiens
gcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagaccccacaagataagaaggccttggtttgaagctgtggaccttcttaaaggtagaaaactggtatcgttttttgtttcttttttactttgagacagagtctcactctgtcgcccaggctagtacagtggcacaatcatatttgctgcagcctctacctcccaggcttaagtgatcctcctgcctcagcctcctgaagagctaggactacaagcctgcaccaccatgcctgtctaatttttgattttttgtagagatgaggtctcaccatgttgcccaggctggtcttgaactcctggatccaagagatcctcccaccttggctttccaatgtgctgggattacaggcatgagccactgtgtccagcctgagtactggcattgttaactgagggtgagacactagggctgaaagtcaagggccacaccggtgtttgagatgagtcaggctgggagggttccacggcaggtggtatagaaagagagcagacaaggccgggcgcggtgtctcacgcctgtaatcccaacactttgggaggccgaggtgggcagatcacaaggtcaggagttcaagactatcctagccagtatggtgaaaccccatctcaactaaaaatacaaaaattagccgggcgcagtggtgtgcacctgtagtcccagctactagggaggctgagacaggagaattgcttgaacccgggaggcagaggttgcagtgagctgagattgtgccactgtactccagcctgggtgacagggagagactccttctcaaaaaaaaaaaaaaaagaaagaaagtagacaagatggggaggatgcaggaggagactaagccttactgagatggggttgggaggagctggctcccaggccaagagggtgccagctaactcccactttgtgtctgggggtatccgcagagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtgaaggtccccaggttggttaatcccatctgtctctacccctagggctgcttaaaaagcccatcacccaaaggactccacccctgggagatggctccttcctctcccttccctacttgatccagcccgacacagacagggagtgtggatgcaagaacacaatggcccccaaagcagacccttgaaccagtcctccccatctgagcctgtttctctgagaatgaaatctattatttttctgtcatcttggggatgcttagaggaccaatgagactgtagatgcgatgacaaagaagaaagcacttcaccaattttttttttttttttttgagacagagtttttgctctgttgctcaggctggagtgcaatggcactatctcagctcactgcaaactccacctcctgggttcaagcaattctcctgcctcagcctcccaagtagctgggattacaggtgcccaccatcacacctggctaatttttgtatttttagtagagacaaggtttcaccatgttggccaagctggtcttgaactcttcacctcaggtgatccacctgcctcggccttccgaagtgctagaattgcaggcatgagccaccgcgcctggcccaaaaaatttttcataaggctctcaccttcagataaatggtttcccctctgaacacttcccactcctcaatttctctttccacattctatctacctcaagctttacatcagactgcagatgggggaagtgacagcaagagatggggaccttaaagcactccttggtattcccatctccctccctcccttccttcctttttcgacggggtctctcctgtgtcttctctccctccctctttcgacggggtctatgttgccgaggctggtctcgaactcctgggctcaagcaattctcttgcctttagtgctgggattgcaggcgtgagccaccatgtccagcctgaattcaggcttttcaaagctacagggccatataggccagggaggcagtgccttcagggccatagcaaagatcattgggcaaaggcatggaagaaggaaataaagccacaccaagactgtggaaacagggcagcctctgcctgggctacttagctgcagttcaaactcaggtgtgagtggcaaggggaattcagggtcaagtgtgtaaaataagcagttccttgctgggtaaagtgagcgctactgacagaaaccagaataagcctgagttgtgtggagcttcaccccttacagagcgtgttagttttactgagcgcattagcgtcttcctctcttgggaaagatggaggaaagcacttggccctgcagctggtctgcaacaccacttacagactgcaaatttgggcaagccacttctgaggtaaaaagggcataatgacgcttagctcctgggtctattgaggggatgatcgagcgtgtaaaacatacatcagactaacagttctagatgctaaatagtacctatcatccaaatcattgagtgcagtggttcttaaacctgcttcacctgcataatttatacaagtgccattgcccaggccccaccacagatcagttaaatcagaatcttcgaaggtatcagacacgggtgtttctaaagctcctccgcgcccattctctcctctgggaattcatgtgtagccaggaatgaaaaggtcttagtacaagccagcagttttacagaagctagggatagcaacgggctgaaggtaacagtcccatgagctggttgaggccccaggttctccggcaaagagatctctctcagttggggaggcttgccccaccctttattattatgcctaacacataagaaatgcgcaggaatcaaacgcaaactggtgaaccaactagagggccgcgggggcagaagtgtccggcggggatccggacagcgcatccggaagcgccatgggccaacgctcgcaggaacctgaacccctgggccagcgccgcctttgctcgcagaggcctctagcatctgtactgtcgaagccctctgagcttcagggcagactgaagagccttacacaccagacacttggacgcgatcgcgccagaaatccccgggaattcagtcttggctccgactccaaaacaaatgattcctcaccagccagatctccatcattggcgttagtctctggtcacctgacttgttcaagccaatgagagggggccgaattagtacttccgctttccgtgctgtttaacgagccactatgcccgtccctcggatactctgattggccagcctctctcagctcgtcagtttattggccagcgccgctaggccgctatcgagcagggtccgagggctgtgtcagaaggctgggcagccatggcgtcctatttcgatgaacacgactgcgagccgtcggaccctgagcaggagacgcgaaccaacatgctgctggagctcgcaaggtgggtgcgcggggcttggggatagggtccaaccagcaggtttctgggctggggctggctggagaaggcggattaccaggggcagcggattctggggaggacagatgagtaatctggagtgttagtacgggcggcgagactgaggggtgtggggatgagcatctcgataatttgggccgtccgttgggccggcctggggcaaggggattgcgggaaagattggagctggagagtggtgggcgtgggggcggaaggacagcaggctctgggaggtctcagagaaggtgaggcatgggggcggggttggggccgtgtgctgtgagtgggtatattcatcagtaacagcaggcactgctgttactggacctggaatctggcttggtcttggaatctgggctctaccaggttattcagcgtagcctgagtaacttctctgaatctgttgcctcatgtgtaaaatgggaataaacactttacgtgctggggcggtctgatagcagttgtaaactatttcccatcgtgctttttatctagtgagcatctactaactactaagggtagctattattcctactagctgggcagcgtgtttattaatgtccagtggattatggggacaaagaaaaagcatagttttcctttgttctgactttacatccccttccccaggtcacttttcaataggatggactttgaagacttggggttggtagtagattgggaccaccacctgcctccaccagctgccaagactgtggttgagaacctccccaggacagtcatcagaggctctcaggctggtgaggacactgattctttctgctatttgggccagacccaccccttccccaagccagactgtggtctggtccttcagttttccaggtcaggtgggggcaagtgtccttcaggagtgggagcttgggaggcagagcctgtagcagctctcctgatcagcactccttcctaaagagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataatagctgcccatcccctcacccataggccttcagttttggcccctgcccagcatgccttctttccttcaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaatacccacgtggttctgctgtgttatttgccctaaaggaagtgaggggcagagtgaagaatcccagtgcagctcagtgggcccagaaatgggcctttccgtaggctaaggcgtgcccactccacctccaccagacttctatcccctctgctgttcccagcccccaattcctgcagcaggaaaccccagtggtctggctttggcactgggagtagaaggcacctgaagggctggctgggtgagtgaggacaggtgacctttaaaaacaaaacgacaccgtggggtggggaagcaggtcatgcagctgtggcagctggcagggcccactcctccatggcacaggtgggcatgggatggccacttctccagaagtgaggaagcccagatcccaacagaatactttctcaaaattgtttttggtacgaaataaatggaaagaagatatggggtggggtgctgtggaggccgggccagccaccctccccagaccttagatcatagcgatgctctcgggggcacagttgaggtgggtggaggtgctgctgctcccggaggacttgcaggcccggccaggggtaggctgcagtgcagccaccagtgtgtctgaggagactgccccaaactcgtagctgaaggtgccatagaaaatgaggatatcgatgacacacacccactcacacagggctgccccatgttgcagctgagaactctcatggacaaagaagactccacctaaaacgaggctaaggaaatgttcagtaggacatacggaaacctggcaacaccccttctgcagtctcaggcctcacctctccaaagggagaggtgttagtcctctcccccacatggcagtgttaggcctccaccccccatcctcttgggagggagaaaggttgagctagaggatgagttcctggctgccccgtcctgaaaggatactgaggaccagggtgataaaggcgatgacagccagcacacttcgcagataggccacagccaggtccagcggggcggtggccccttggtaggagagagcacagtgcaggcaaacaaagagcagccccgcagggaaggccacgccagctccaacgtagtgcagagacctggcatgatccacctgggcccagagaagggccagttggtgatgtggccatggccccacctctccacccctccttcaatgaatctcctctctccctcttccttcctctccctctttccagccccaaccttgaggtgccacactgcaggcagccaggccttgttaggtaaagtttaaggtttgcaggggagaaggggaagcacctgaaagttgccaaccaccaagaggcccgcagcgttggtgcagcctgtgatgagtgccgtggtgttaacccaagagtgccgactctgctccaggagctgcccgtagcgcaggaggcagatcagggccactgggggaggagagcacagttgaggccttcctccagccctggccctgcccagcgagcctgtcagcttcccccagacgctgtggtgctcctgccccttctgaggggcagaaaggaacagacaggcgggtggtgaactaggtttcctcaggctccagccagcagggtggctgtgtgggagtcagcttttggccttcaaggaaggggagaagctgcctctattgccttagcccttggtggggagggctgcacagaagggcttcctgggcctttctgtgtggggatcactgggctgggcacgcagggtcagggctaagggtacaactcacccatgaaagcacccatgttgccaatgaggctgaagaggcagctttctgggggataggagccacacttgctgcgaggagggggaaggacagagtaagaggggtgcaggaggcccggggggcccccattttggctcactggctctcccctgctttacctgcacctgctccttagcaggcaggccactgatttatgtgaagatccagggtccctcatgaacaactggttccaggctgggcccccaaagcagagctcatgtgtgtgagagagaagggagtgcccaggagtgttcgggcaaccctgacactctttgctgagccctgcggctggtttggctatccttgagccagaacacgggctgggcaatctgagggctccagcttaaatccaggtgcctccgcttattagctgtgtgacctggatgaggaagactgagcctgtttcctcacctataaaatggtgaaaacaatacctgcctcactcctgggaggatgaaaagagacaatgcatataaagcactcagcagagtgcctgccccacagtaactgtcaagtagtgttgttattaagtggctcttaggatacttattgttcctgagacccaaggacagctctttgcttgaggggctgtctgggaggcccttagatctccctgaccggcccaatgtccaggccttacctgatgagggggacatcgtccagggtgcagcaggtcttgggacccccttgctcagcagggtcaggagggcaggactcgttgtaggacctggcaggcaggacagggagtagactgggggaagggactgcccccaggcccttggcctatagcctcaggcctcaaagaggactctctcccagacctcccctacagggacagaagatcccactccccagtgcccgcctgaagcagtaaccaaaggggcaaagggatagtgggaagtgggtaggtggcaagaagccatgcctggggaccaatttcagagaagagcagtgaggctcagggttgcagtctggctcgtggcagcctcaggcccaagaggggacagagatgaaggaagctttagagcaaggttgtctgcagagtccttcataccagttctccacagggcatacatggtggttcatcacagccatggcatacctgtgggaacagaactgtcaccctggcagccttcccgagccccactcaacccaccccatgacccttctcttcaaccttgatttctggccccattcagcctcattattgttgctggggactcaagttgaggtccctaaggcttgatgccacaccagcacctgcagcatgcccccagctacaggccctctggaaattgccctggctagaagtatatttgtcagggccaccctgctggacagcagtggtgccagcttgtcccaaggggctgtgtgcccaggcaccaagtcaggcttttgagacacccagagtgaccctgggtaccaccgtggctatgacaggacaagagactttgtgtgcgtcatcaagctcctgttgccccccgggcacccccctttactcacacagtccatatgccagtgatggagaacgctgacaggctgacaggcaggaggatccaggcggtcatgagggaggggagccagggtggtggtggtgttggggggaggacaagaggtagatggggaagtgggggcggaccagctaccttgagatgtttctgccacaaccatcagctgtcctggcctggtggagagagatcaaagtccaggagtgggtaactggccgggaagggggaggggaagggggtcaacaccttatccagcgctcccgttgggtctctgagcgtccaaagtttgggctgagcccacggcagaacgtgaacaccctctggcactgggggcctccgcggtcaacccaaatgccaccggcgtgctgagagacgcaggcggaccgtaacatctggaagggagttaccctccttctgagggaccagggctgggagaagggctggacaaccgaagaggccacgccaaggagaggctgggtgccggcccagtggagcggtggcgagtcggcggcgcgcaggcaaccacctgaccatcggcgccctgggcgaggggcgggttcacgcggaaagcccagcccggcccggcccccgctcgcctgggcgcggggaccccggctggggccggaccctgcggccggcgaccccccaggacccgggacgcgagagtccccaggtgattcctggaagcccggaggaagggaaggagcccagtacgcacctccccggagcgccccgccgccgccgcaccctgctcggccccctcgtggcgccgactctagctgcggccctcggagcagccctgaaaggtttaaagggccgagcggccccgcccctggaggccccaggcctcgccgcgccgcccgccgggacgtggagtccgcgcagccccggcctcggtgcccgcgccctgcccgagactacaactcccgagcccccgcgcccgcgtcacgggggaaacgtgggcggtgtcccaacttcggaggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacggtgagtcctctaggaagctctctcaacgtggcgccccatgcctgcctctggccagggctgcggtgggtccagagaagcagacacaaagacttggctgtttcttaagaaatccaagcgcctgggatttggcttatggttcctgtggctcagcaaactccggaggagggctgctttcattagatactttttgctttcctgcatacaagtacacaatgtactagccagaaatcagtgtccaagacgtgtttcccgactgatcaacacttatttgaaataagacggcagagaccagaggacatccattctaaatagacacatgtaggtgtcagtgtagagtaggtaaggattaacatggccagtgttggtaagcaaagaggggaaggtgagagacccggaggaatctgggaaaaggaaacaggatagtgtgggaaaaattactgaccagcttcaccaaaaacttacaggctatgagtgcattcctggatgtttcttttttttttactttttctttttcttttttttttttttgagacggagtctcgctctgtcgcccaggctggagtgcagtggcgcgatctcggctcactgtaagctccgcctcacgggttcacgccattctcctgcctcagcctcccgagtagctgggaactacaggcgcccgccacctcacccggctaatttttttgtatttttagtagagacggggtttcaccatgttagccaggatggtctcgatctcctgacctcgtgatccgcccgcctcggcctcccaaagtgctgggattacaggcgtgggccactgcgcctggcccggatgtttcttaaattattgcaagggtggaaatactttcacatatcagaagtgtgcctggcattctgtctcaaaggcggtcccagcatctgttggagcccttgtgagatgacagatcatcacctgaatggtgcacaggcgcaggttgcccagcgtggggagctgaagtttggcaacactggtgaggcaaaggctatgtgaaacaacagggtcctgtgctttagagaagtagagcagaataaactgcacaatgacttgaagagggagaaaccttcttggacccagtggaaagcagaaatggaagcagaaaacctgttggagagccctttttcttttgagacagagtttcacttgttgcccaggctggaatgcaatggtgcaatctcggctcactgttacctctgcctcctgtgttcaagtgattcttgtgcctcagcctcccgagtagctgggattacaggtgcctgccaccatgcccagctaatttttttatatttttagtagagacggggtttcaccatgttggtcaggctgctcttgaactcctgacctcaggtgatccgctcgccttggcctctcaaagtgctgggattacagatgtgaaccaccgtgcccagcgggagagccctgtccttaaacacattaggacaagtagttaaaacagggccaagaagtatggctgtgtagtgatcactgtacaagcacacctggctgaataaaccagtgggggataaaatccagctcacctgccgctggctatgctttgtgcctcaggacaagggtgtgcttccttgctaattgacaggaaccatcttcctgcccaactgcattcccactgcgtaggcaccttatctgcccaatggggctgtgaaccctaattggaagctttgcaattcttaacactatatcttcttgagctgggtttgagtccctatccaatcaagatgaaggcctgagaggactactcaagttctaacatgatgtgggggcaaggcatagtagtccagatccgggacatgaggcagcttttggcttagtatgacaatctaatagttcctaaaatagaattatcccaggatggagctccgtatgacagaagggctcttcataggtagttggtagggggaattgtgtatcatgtaagaagtaggaccagatgtctttaaaaagaccttccaactctaatgctacatgagtctgtctagttgttatgttccaacagggacagctcttaaaatagtgtggcaaagcaagagatgagatttccagtgctgactcggtggtggaatgactttagggcaggtatttaacctccacttccccaagtacacaagttatttcacaactcttggcaaaaacagtgctgtaaaaatcgtaagtttatttgttaaaaaaaatactgtatttgaaaagtaccttccttctgggattttcaaataatttgtacactacattttattcatctacacattggaaatgagtaaactggtgaacatatagctttttatacatttaacacaaccagtgcaaattctcctgcctctgagaaggcagagaagccctttactcagaaggtcttcaattctagcattactccaactcctagggaaatttcgggtgggtgcctatggctgtatgaccatctgattcctcagggacaggacaggaattcagcaagggagcttaaaatattttaagtaattgtcaacattccatggtgactctccccaaaaatctagtggtaggaaaataatctgtacttattcctctttctgcacacaaagccctcatttaaatttgtgagcctgcttgggatccattacctagccattcagagatcctgtcaaatgcacagcagattggatactcaccatcccaaaggggttcctcccacctggatggggccaatctctagttgacagtgcccctcagagtgcaccatggagatggaatgtcccttccagagagacttttacacagggaaaagcatttgttggctgggctccaactctcatttggtacaaaaagctttacattcttttccctttttacattacattcttcaaagacttccgtgcttgccagctggataacaactcaagctctagtgtttactcttgcacagccccaaacccttggaaactcagcttcgttctatcagtgacatcacccattgtggccgaggaaccacaaaaccttaaaatacaggcttaaattcagcaagcgaagaacattccatattgaatgggcatgagatatgcctatcagattgtgtgtgtgtgcgcgttttttaaagacagccaattacatcgtatctagtcaaatgagcggattctaaagcagcctgctgggatgttccacttagtctaatgctgttgccactgtacgccacagcaccggacagtgttctttgggacatctctgggaaatgctctggaacatgctccttgatggaaaacactaatttttgaaagaagtagatgtctggaggcaggtctggtgaataaactgaatagtactgccttggaccccagctgaggggtggcagtaagcaatgaggatgggctataaagctgttaactggctaagggccatccttgggcaggcatttcagacacatctgtagagagggcagtagcatctccgataggccagctctgaaggaagcttaatgcttaatacagtcacactgcataaattagcttagaatgctctcttgggtaaaaaatattaatagtgtatatgcacttgaaaagcaaaattcctcaagaaaaaaagtttaatagcaaggagtttccatcagtcccggtctttgtgaggattaccacaacaaacacttaaaaggatacaacaggtacttattaaatgctgccttgccttttacctcttccttttttttttttttttgagatggagtctcgctctgctgcccagcctgaagtgcagtggtgtgatctcggctcactgcaacctccgccttccaggtttaggtgattctcttgcctcggcctcccgagtagctgggatggactacaggcacatgtcaccatgcccagctaattttttgtatttttagtagagacggggtttctgtgttagccaggacggtctggatctcctgatttcatgatccgcccgcctcggcctccctacctcttcctttacttaataagaatgcggtctaaattttcaggtgccaagcccccaaactcctcttctagccttctgaattgtgtaataaaaccaggaaacaggtgatccagctgtgcgaaaacagacctcaaatgtatttccagactaaaaagccagacttgcagtgaaatcctatgttccaagtcatcagatcagtttaaggactagaagactagaatgactgactggttctctgaccaggaagaacaggggtggagtttgggagagccttcttgacccaggaggctttggagggtagttaacattagaagtcaaaaggcacttctagcccagctgcctaagtagaggacaaagactttctcctttcaaaggagaactgagcccaggattggtaagtttaaggcacttaaccttgaccagctctgtaggtctggagcattctggtccctggccgctttcaccaccaggcccttctcacttatccacctcacttactgccccagcattcctttggcattgcgagctgtgacttgacacattttaatgacaagattgaagtagctaccttgcaggatagattttctggggtataggggacaaaccaacagtgccatcaggtgtcttaacacccggatgtggagaaacccctggggcaagggcctatggtttcaggaaatctcagttctcaaaggcttaaagccatatttcaaggcactgaggttaggctgatatgctggaaaacaagtgccttggaacttccgtactggagggggaggatgtcttgtggaattcagacgtaagcctaaccctgcattagaaaaaatgttcaccgggttagagcagtggtattcctggggatctttatgctaaggatctgagttacatactcctgggaggtaggagagaaggcctcatttcattccctctggcgtgctgtcaatcaggcaattattgctaatattgactttccctttgtaggtatgttcagaactgttaagtcacaactggagagtaagttcccacttgtttataattcccttttagtctgagcagaggacagtctgttcacggctaggaatcaagttgaaagttggaattctgtagccctggccgaggcaggttttgctgtaagaaatcttttcagtttagcaccaacatcttcctaggtttcctgtctagacagtgcaaagcagtggaacatgcgagaaacgaaaaagccatggaaagggagggagacatgcttgcaaataggcctcaaaaatggaggtctcccactttattggtatcagaattacttggagagttttttagaagggtagatccccaggccccgcccccacctccaaagtcctgagcagctggaggtacacagtcatttggagggggaggaaaactgatggattctacctgaggcaaaaagatgagggaaaggaacaaagaaaaagggctgaaaaaaggtctataaacacatgggtggaaatgagcaaaagcacagaagaaacataaaataacaaacgtggctcatggagctgagtggaacagcagcagccaggcatatgacctcggtgagaaagcaccatgttgcacgaggcttcataaattctggttctccctggagtctctgcttctagaacacattagccacacaaaatcctcaaaaaaaaaaaaaaaaaaaaaaaaaaaagaattccagaatatcaggctgggcaaatgggtcaacatataagaaagaatgactgcaaggcaggccaggtgtagtcctgcaacaccctatggatgcagcagctctgggggtctcaagatcagacaaactggtcctggtacccccacactaaattccctgggcagaattcttccgagtgcagtgaatccagcctggagagaacgccttcaacatggtcagtgttggctctggcgctttgcaatctcctcctggatacgcaacttgagggcttctcgcatgggtggatccagaggcgtgtgtgccgacaccttctcactcacctttcctgggtcatcaccctacgtggaggaagagtcagaaggctcagggcctggcctcttccagaaaggtgacctgccctgtccctaaacactctcacagaactccatttagctcaaggctttttgccagcacctgtcatttcctatgtgtctcctgtaatagtgattctccactgggggccaagagccctccctgttcccctactgagaatcactgtgagatgggagtgagttgtgctcaaaagcactgcccggcaggcctagactcacatgtggagcagacgcttcccattgggggtcctgaggaaaacagggctcagggtctgacaatgattactaccatggcccaggaccttcaggctgcagctgtttccaccaggcgtacctgatagacgataactgatgtgacctctccactgtctgcctcgtattctaagcagaagagctgatggccagaaggctccagctcagagcctccactactgctgctttcaccggactcttcatagtctgggttgcgtgggtgggcagagacatctggaaggatgaaccacagtaagaaagaagagggggggtgctgctgaaggccctgtccatagagatgctgcaggaaaatatacggttaggaaagccccagtcttcttttttttgagacgaagtctcactctgtcgcccaggctggagtgcagtggtgcaatctcggctcactgcaacttccgctcccaggttcaagcgattctcctgcctcagcctcccgagtagctgggattacaggcaagtgccaccacatccagctaattttcatatttttagtagagatggggttttaccatgttggccaggctggtctcaaactcctgacctcaggtgatccacccaccttggcctcccaaagtgctgggattacaggcgtgagccactgcacccagctgccccaatcttcttatgggtccagtgtaagtggtttttttttttttttttttgagacggagtcttgctctgttgcccaggctggagtgcagtggctaaatctcggctcaccgcaacctctgcctcccaggttcaagcaattctccttcctcagcctcccaagtagctgggattacagccgcctgccatcatgcctggctaatttttgtatttttagtagagatggggtttcaccatgttgtccaggttaatttcgaactcctggcctcaagggatccgcccacctcggcctcccaaactgctaggatcacaggcatgaatcaccgcgcccggaccagtgtaagcatttggtgtgctgccaatcaaggacttatttacctttgcatccctgctctgaggccagcacaatcctgtcacacagtaggtacacaatgcacatttgtctagcaaaaagtactggaaagcagaagggtggatagagctctgcctgggttcaaatccaggctctgccatttactagctgagatcttgggcaagttgtttaacctctctgtgcctgtttcctgactgtgaaacagacagaagctttcttatgaggttgtataaagactcaatgaattaatatacgtaagatctaaaagcactttcactaatgcctaacaaaggtagtggcacacacctataatcccagcactttgggaggccgatgcgggcagatcacctgagctcaggagttcgagatcagcctggacaacgtggagaaaccccttctctctctctcttttttttttttttttgagaccgagtcttgctgtgttgcccaggctggagtgcagtggcgcgatctcggctcactgcaagctccgcctcccgggttcacgccattctcctgcctcagcctcccgagtagctgggactacaggcgcccaccaccacgcccggctaattttttgtatttttagtagagacgggggtttcaccatgttagccaggatggtctcgatctcctgacctcgtgatccgcccgcctcggcctcccaaagtgctgggattacaggcgagagccaccgcgcccagccggggaaaccccttctctacaagaaataccaaaattaaccggtgtggtggcacacgcctgtggtcccaggtactcgggaggctaaggctgcagtaagcccagatcgcaccattgcactccagcctgggcgacagagacctagtctcaaaaataaaataaaaacattttaaaaaaagtaataatgcttaacaaaaattgaccgtcatatattaaccagtgtgatctctaggtagcagagaagctggggaaaggccatttactgggttcattccgcaattatgtgctggtcgctcatcgctgtgccagactttctctttgctaggtagcggagcaccttactaaaatacagcacggtggggcaaaccggcagataaacttcttgctggctccccgatactctgacagcgatgcttaactgggggcttatgagtcgtcccagttcttggtgagaatcattcagcggagatttgggagcgctgaggtggaggttccggaaagagacgagatgagctgaaccttaggagtaagaagtggtttttccctatagagaaggggagtgcgttgcaggaagagcgcgcgggctggaggcaggcggggcgggcggcctcacctcggtgtcgcggcaggtacacctgcaggtctggcttgcggggccgcgtcggcgcgggcgtgtgccgcctcctcaccttctccttggccgcctgcttcaccttcttgtcatagtcgtccctgcggggagccgagcgggagtcagggactgtcgggccgggccaggccaggccaggagtggtggcggcggcggcgcagggcggggcggtaccgagcgatctggttccgtcggatatggtgcacgaagccgtggttcatgtccagccgccccccaggcttgcagcagtgccccggccggggatgcggccccgcctccatcaggagccggggacgcagagtcgccgccgcctcgacggccccaacaacagccacccgcccacagagctccgcgccgccccttgctcagcttccggccccgcatcctgacttccggtctgggaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctggtaataggatgctgtgcaatccatcgccatctgcgtgactttggctgactgtgtaacgctgccacttctcagtttcctcattagtaaatgggaacacctagagcacctacctcaaatggattgtgaggccttgaagtgctcaggcagggcaacagcggcgcccaggccgcaggcgccgcgaaggctctcctggcccggcttgcctcctgctcacggcgccgatggcttaactgtccccgcgggaggacccagggtttttgagggacctacgggtgtattattttcttttttatttatttttccttttttttttctttttgagaaggagtctcactctgt

SEQ ID NO: 1330 - DNA, 94244 bp, Homo sapiens
agctttccttgagtccgacattttccatttcagtaattaacaccaaattctagcattctagaatcccagcattctagaacctcaacctgccaacaatttagggattcaagatggtgaccttccaactttgaattccaacaatcacagggttcaactttctaacattctgtgattccaacactccagcaagaaagcaaggctgggcgtggtggctcacacctgtaatcccagcacttcgggaggctgaggcaggcggatcacgaggtcaggagatcaagaccatcctggctaacatggtgaaacccagtctctactaaagatacaaaaaattaggccgggcgcgttggctcacgcctgtaatcccagcactttgggaggctgaggtgggtgtatcacgaggtcaggagatggagaccatcctggctaacacagtgaaaccccatctctactaaaaatacaaaaaaattagctgggcgtggtggcacgtgcctgtagtcctagctactcgggaggctgagacaggagaatcgtgtgaacccgggaggtggagcttgcagtgaatcaagatagcgccactgcactccagcccaggtgacagagcgagactctgtctcaaaaaaaaaaaaaaaaaaaaaaaaaggaacctgatcccaacattacaagactcccagttctttttttgttttttgtggctgggattataggcgcccaccacgcctggctaatttttggatttttagtagagacgggtttcaccatgttggccagacaggtctcaaactcctcacttcaggtgatccacctgcctcagcctcccaaagtgttgggattacaggcgtgagccaccgcacctggcacaagactcctggttcttacacccagacctcatcccctgagccctccaagctaaaggagacagatgctcagcccaagcacagcagcagccaggtgtccaacctggagcacctggtcagcagatggcagtcatgcccccagcctggaaggcctccatccaggctacaaggctcacctgaagcaatagttggtgtccagggctcggcggtgccgggagctttgcagatgctgggccctctccagcggggtggccatgagaagcaggaaaggccggttcatgccatgaatggtggccaggtcacctcggcggccggtagtgaaccctgctttggtgtgggagtcaggggataggggacatacacacacactctcagagggatagataagtggggcgtggggcagatgggaacacacacacgcacacacgtcacaactgggcatggccggggaagcaggcctcaccgttgatgtccacttgcagtgtgttatccctgctgtcacaggagcagtgggcgctaaggcgaaagccctcaatttcccctgtaggagtggcgagagggaagccagtctgagagtgcagctcacccagcccctggaggaagaggaaggaaggagcaaaccccaggggcttccttcctgcctcccccacccaccccactctgccctctcactgcagctctctctttttttttttttttttttttttgagacaaggtctcgcagcctcaatctccaaggcccaagcaatcctcccatctcagcctcccgagtagctgggaccacaggcgcgtgctaccacgcatggctaattttttttttttttttgagatggagtctggctctgttgcccaggctggagttcagtggcgtgatatcagctcactgcaacctccacctcccaggttcaaacgattctcctgcctcagcctcccaagtagctgggataacaggcatgcgccaccacacccggctaattttttgtatttttagtagagatggggtttcaccatgctggccaggctggtctcaaactcctgacctcaggtgatccgcctgccttggcatcccaaagtgctgggattacaggcttgagccactgcatccggcctacacggctactttttaaattctctgtagagacagaggtctcactatgttgcccaggctgggctcaagcaatcctcctgccctggcctcccgaagtgctgggattacaggcatgagccactgcacccagccagcatcaatctcttgaatgaatgagtgaatgatgttttctaggctcctacaatgtgccgaagcctgtgctgtgtgcttgggactcagcattgaccaagacagatgagctccttctaggcctttgtcgaacagcccaggacactcctcccagtgcccacctgctccctaatccctattttttctttttcttttcttttttttttttgagacggagtttcactgttgttgcccaggctggagtgcaatggcacgatcttggctcactgaaacctccacctcctgggttcaagcaattctcctgcctcagcctcccgagtagctgggattacaggcatgcatcaccacgccgagctaattatgtatttttagtagagacggggtttctccatgttggtcaggctggtctcgaactcccgatctcaggtgatccacccacctcggcctctcaaagtgctgggattacaggcgtgagccaccatgccaggccccctaatcccttttttttcatgtggccaaactactatttatcctgtgagtctccacacaatcaccctcacccagcaagccctcctagactccccagatgggtccaggtgccttctctgggctcccaacagcacttagggcgttcccccatcctgcatgcctccctgtcccagccttgtcctccctgctggtgcctccccatcccattcttgatcattctaggtcattcctgcctggtggggccttgacaagatctcttaggtgtccagaagtgactgtgggccccatgagggcagaactgagggctgtcttggttatcactatgtcccccacaccacccagcacatggccaggcacacagcaggaacctgtgggcaattattgaataaaagcataaatgagagggaggtgagggagagagataggggcaccatgggccctgccagaaaccagacagagacaatcatctcctggacagatcaaatgagttagttaggctctccctggcctccaggcctttgcacaggctgttccctttgcctggaatcttttttttttttttttttttgagatgggatctcactctttcatgtaggctggattgcagtagtgtgattatgactcactgcagcctcgacctcccaggctcaggtgattctcccacctcagtctcccaagcagctggaactacaggcacgtaacagcatgcatggctaatttttgtatttttgtgtagagaccgggtttcgccatgttgcccaggctgctctcaaaactcctgagctccagtgatccatcctccttggccttcaaaagtgctgggattataggcataagccaccatgcccagccccagaatactcttacacctctccttttcctgaccattctactcatcccttcaacatcagctatggtgcccctcctccaggaagccctccctgattctgggctgggtcaggtacctcctttgggctccccatcccagtcccacccactctgggtcatcactgccttacaggtctgttccccagctacctagccaatggactatatgagctctgtgagggcaaggatggggctgttttggtcattgctgtgtccttggcatcacccatcacagggcagggcagagaggtgctcaggaaacagattagccaatcactcaggtttccatgccacagaggggagccaggtctcagcactttcacaccagtatggggcggagaggggtcctaggcaaagtgaccccaggacaaacaatggggtggaccccagggagaaacaggggtgggacacacaagtaatcctcacctccacggctcaaccactgccgcacaactccggtgacatcaaaagataaccactctggcgagtcgctgggtgccagcagccggttgctgaggtatcgccaggaattgttgctgtatttctagaggatgatgaaggcaggagagagacagtgggtagatggtgtcacgaccccacatacactaactgaatccttcaccccatctgcttccccaaacaggcttccagaaagttcccaggcactaccctctcagacagccacctgtgtggtcctgtggcacccatcctccccaacagtacccatgagaggaggggtggagaaaaagctcaggctgcggtcaagtcaccttcacacagctcagccgaaggtgttttcttgccttctcgaggcctgtttcctcattggtgaaatgctaagccccactcagcgtggacagcccacaatgctaaaattctgctgctaacattctgggccgggcgcagtggctcacgcctgtaatcccagcactttgggagcccaaggtgggtggatcacttgaggtcaggagttcaagaccagcctggccaacatagtgaaaccccatctctactaaaaatacaaaaattagccaggcatggtggcacacgcctgtagtcgccactatttgggaggctgaggcaggagaattgcttgagcccgggagacacagactgcagtgagccaagatcacgccactgcactccagcctgggcgacaggacgagacttcgtctcaaaataataataataaataaaataaaattctgctgcaaacattctggggtttactgagcatacggttctgcaaatttgacaccctgaattctcagtaacttagaagtcatttctaatgattccggctgggcacggtggctcacgcctgttatcccagcactttgggaggccaaggcgggtggatctcctgaggtcaggagttcaagaccagcctggccaacaaagtgaaacctcgtctctactaaaaatacaaaaattagccaggcgtggtggcacacgcctgtaatcccagctactcaggaggctgaggcaggagaatcacttgaacccaagacacagaggttgcagtgagccgagattgcaccactgcactctagccagggtgacagagtgagactctgtctcaaaaaaaaaaaaagtcattttgtgattcaaatgtttgataatatcccaagatttccacttctagagcctgagaagctttagaagactaatgttctataaacccaagagtctgccatgccgcacctagatgctgcaggtacccaacatctgtgtagaataattttctgggccaggcacagtcgctcacgcttgtaatcccagcactttgggaggccgaggagggtggatcaccagaggtcagaagttcgagaccagcctgaccaatatggagaaacaccgtctctactaaaaatacaaaattagctaggtgtggtggtgcatgcctgtaatcccagctgctcgggtggctgaggcaggagaatcgcttgaacccaggaagcaaaggttgtggtgagccaagatggtgccattgcactccagcctgggcaacaggagcaaaactccatcacacacacacacaaaaaaaagaagaattttctggggctggatagtccactccagggactgcagaataaagctgaattccccagactccaagaagccaagctaacataggacaaagttctctcactgtgaaagtctgaaatctaccatcctatgagttaacattccctctgatatggattctagctcatagaaactgctagagcctccagcccttccagatgccccagtcctcttggaagctccctatcttctagagcagtgctgtcctaaagaactttctggaaatgtgctttatctgcaacatccaaaatagtagctgctaaccacatgtgactatagagtactagaaatatggccagtgagaatgaggatttctttttcatttttatttttttgagacagagtctcgctctgttgcccaggctggagtgcagtggtatgatctccgctcactgcagtctccacctcctggggtcaagcgattctcccacctcagcctcccaagtagctgggattacaggtgcctgccaccacacctggctaatttttgtatttttagtagagatggagtttcgtcatgttggccaggctggtcttgaactcctgacctcaagtgatccacccaccctggcctcccaaagtgctgggattgcaggcatgagccaccacgcctggcctatatatatatatttttgagacggtctcgctccatcacccaggctggaatgcagtggtgcaatcacagttcactacagcctcgacctcctgggctcaatcaatcctcccacctcagactactgagtagctgggactagaggcacgcatcaccataacaggctaattttagtattttttgtagagacgaagtttcaacatgttgcccagactggtctcggactcctgggctcaagcaatctgcctgcctcggcttcccaaagttctgggattagaggtgtgagccactatgcctggccctaaatttttaatttaattttaaacaatttaaattttaatcaagctaaatgtgactagtggctgtcatattggacagaatgattctagagcccccaaccttttcagagattccaactttcaagaatcctgtgtccttaaagagtccaactcctaagattccagccttctaagtgtttaacatcctaggatgcaaagagtctgaacatttaaaagtgctctaggttccgggtgcagtggctcacacctgtaatcccagcactctgggaggctcaggtaggagaatcacttgagggcaggagtttgagacaagcctggccaacatgataaaactctgtctctactaaaaatacaaaaattagcccagcgtgttggcacatgcctgtaatcccagctactcgggtggctgaggcaggagaatcacttgaacccaggaggcggaggttgcagtgagccgagatcaccccattgtactccagcctgggcgacagagcaagactccatctcaaaaaaaaaaaaaaaaaaaaaagaggccaggcgcagtggctcacgcctgtaatctgagcactttgggagaccgaggcaggtggatcacgaggtcaggagatcgagaccatcctggccaacatggtaaaaccccatctctaccaaaaatacaaaaattagctgggcgtggtggcgcacacctgtaatcccagctacttgggaggctgaggcaggagaatcactggaacccaggaggcggagattgcagtgagctgaggtcataccactgcactccagcttggcaacagagtgagacactgtctcaaaaaaaaaaaaaaagcgttctaggattgtatggtttgtgttcttctatccttcagggaccatctaggtggaccttgtaaccagccgacccacagccacccccttggtcacagctcaccctctccagcccatgccctgaccttccttctggctcatgtcctcacctggtacagctccacgtgctgctccacttttaacttgagcctcagcagacgcagctctgcccgggagagcaacacgggttcaggtaccgcttctcggagctctgatgtgttgaagaacatatatatgctgtgtgtactctgcttgaacttgtcatagatttctagcagggagaaatgaagggaggcgatcaggggtttggcagaggtgaggggagctggtgctcccaactctaggagttttggagctgacagctctggggtggagtcagtctctgataccttttatttatttatttatttatttatttatttatttatttatttaaatgaatttttttttttttttgagacggagactcgctctgtcacccaggcttggagtgcagtggcgcaatctctgctcactgcaacctccgcctccagggttcaagcaattctcctgcctcagcctcccgagcagctgggactaaaggctcatgccaccatgcccagctaatttttgtatttttagtagagatggggtttcaccatgttggccaggatggtctcgatctcctgacctcgtgatccacccgcctcggcctcccaaagtgctgggattacaggtgtgagccaccacgcccagccctgactgtgatactttttagctgtgtgaccttgaggaagtggtttctccccctaggtttgtttcctcctctgtaaaataggtcctaaccacattcctctctcatgtagcatcatctctcaagtcgactaaggctggcaccaaggggaaccactctgtttgctctggccttccttgccccaaatgcaagagcccctaaaatgcagagtaaggatcaaaggcacaggctttggactcagatagtgcctctgctgcctcttggctgtgtgaccatgggcagttaacaccctctttctgaatgtcagtttcctgttattctttgaaaaacagcaataacattaagctccctgcattcccacacagactctcctaatttaagcgctgtgtaaccttgggcaagtgaattcctctctctgagccaggtgtaagacaagacagagtgactctagaacccattccagtattatagtgggaaattagatgacccaggtcaagccatgtggcaccaattctgcatacactggtcactcaatcatgtatacgtctaagagtgctggctgggcgcagtggctcacgcctgtaatcccagcactttgggaggccgaggtggattgattacttgaggtcgggagttcgagaccagcctggccaacatggtgaaaccccgtttctactaaaaatacaaaaattggccaggcatggtgccggacggctctaatcccagctacttgggaggttgaggcatgagaatcgcttgaacctgagaggcagaggttatagtgtgccgagattgcgccactgcactccagcctgggtgacagagtaagactctgtctcaaaaacaacaacaacaaaaaaccacaaaacagcgctatttaccagatgctatctaaagcactttacaaagatgaagacatttaaacctcacaaccttatactattattatacccgtttaatagatgagaaactgaggcaccgagattaagtaatttgccccaaggtcacatagctgcagactgggattcaaactcaagctgtctcattccagagactgtgctttttttttttcttcccccaagagacagggtctcactctgtcccccagacggaagtgcagtagcacaaccatggctcacggcaggctggaactcctgggctcaagggatcctcacgcctcagcctcccaatatgttgagatcacaggcatgagccaccacacccacccagctagagactgtgctcttaacccctaagtgattcttctacttatttttattattagttttccacccttaactcccttccccagctggttagggaaagtgaagttcattctgggtaggaatggctgtagtggggagaaaaggaattaaggtgttttcttttctttttttttttttttttttgagatggagtttctgtcgcccaggctggagtgcagtggcgcgatcttggctcatagcaacctctgcctcccaggttcaagcgattctcctgcctcagcctcccaagtagctgggattacaggcgccgcccgccaccccgcccagctaatttttgtatttttagtagagaccgggtttcaccatgttggccaggctggtctccaactcctgacctcaggtggtccacccaccttggcctcccaaagtgctgggattacaggcgtgagccaccgcgcccagccaaggtattttctagtttaggaaaagtttggggatggggatgagggaacaggccatgaactgctggatcaactggggcaactgcttccagcctcccatagtgggggtgtgaaaagagactggtgagaaaggcagaggaaacccctcccctacggcccccttcgatcctcctcctcctccccagtctccctccccacccagccccagtaagccctattcttggcccggaggttactcagcaaaccccaaaggaaaggcagagccttggctggggaagacagatagggaggaagacagagaggagggagaggaagggttggagggtgatgcagagagggagaggcggggagatgtcagagacggagacgaggcaacaggaccgtggaggagaaaaatagaaagggagagaaaatagtcggagagacaaaaaccaggagacccatgcgtggacagaaagactaacggagacgaaaagaaagaggcagatggggagacacgtgcgagacgagacacatgtgcatttgttggggagaagaggattggaggtgtcagtgttaaaggaacctctacaacgaaggtgaagccacggaagataaggtaaggctgagacttgggtgcggagtgcgcgtcattgggctggagctgtaaactggcgcagaaatgggcagggaacccgcaagcccacaccgcccaagagtcagtgaaacctgagggatcttccccaaggctctgaaccacgcgggacgcctgggtcctcgcatggatgccgacggggccggctgagtgggagccccgcccgtagctggggtgaggagggcgggaggcgccgcagccaggagggcggggaccagacctgccccgtctcgccccgggctccgcgagcgatccccgcctccgccgggggcatgggaaggaaagggaagggagggggatgaggccgccggacgctggggtttccccagccaccctgagaggaactgggactttggggtccagactgccagcgtttagcgcagcggggtcctcctgccccttggtggaagcgcaggctcctccccccgcgcgtggcacccacgtggggctttctcactcctcccagcttggttttctcacctcggtcttgtagagtcaccccccacccagcacttcccctgcggctggactccgctcagcccattcccctgcatcctgcggggaatgcagcgtggatggcgctgggtatctctcctcctccccgctcacaccacctttcccacgcctgtctcccctctcggtaaagcccttcccatgacccaggactctaggtcttctggaagctcgattcctccgctgggctccccactctgtccctcacgtccctgtgtgaaacaccgaggacacctctgcatcccgggcgccctcccgagtctccgctcctctcccgcttgcctcctccttccaataacctcccgtccctttctccccacatttatcacacgcacctctgtttctctttctacgactctcccccacccccgcatcccgcgtgttcctggcagcctctggaagtgggtccgctctcactttcctggcaccctctggggttgccttcatctagcttttctgtccttcttgaatctttccacctcaggacccccaagctctgggtcaactttctccagcgcctctcctttcccaaatgctggggtcttcgcttctcccacaccaggctcccttctctgcacctggcaccccacgacccccccccccattcaacgcgtcctggaagagggagccttctaccctccccctattgcttgtctccctctaggggactgcccccacgaccccgcatgtttctgtcgcactctagaagcggtccacttcgctatctcctcctctccaagaccagacacctgggtggtagggggctcagtgccatcctctttcggacacccccctcccaccatcacacgttccctttgccccggggtgtcctcttcctccagccagtttcttctgccagtcacttcctacccgtggccccggcactccggcgccccctgggggcccccctcccggctcccctgcccctccgagctcaccgttgtgggtttccaccattagcacgcgggtgacctccttggcgtagtagtcggcctcaggctcgggctccggttctgcactctccccggccacccggtcgcgggtgctgttgtacagggcgagcacggcctcgggcagcgggccgggcggcacctccccctggctcggggggctggcgagccgcagcttggacaggatctggccgcggatggcctcgatgcgcttccgcttcaccagctccatgtcgatagtcttgcaggtggatagtcccgcggccggccggccaggcgtcagcaccagtagccacagcagcggtagcagcagcggcagcagccgcagcccggagggcggcatgggggaggcggcgccccccggcactgccgagagcgcgaacagggctggtgtggtggggaggccccgcccctgcaggggctgggggtctcccggcaaaaggtaggagggcctcgagggaaagctgaggtcctcagggagaagggcgcagtggtggaggggaggcttggaccgggggtgtctcagtatcccacggaaataacctagatgggcgcgatctggtaccagaaggtgggtggtcttgaataggggatctgtggcaggtcggagagagatccgtctcctggaggagaaagggtctaggatgcgcgggggctcaggagacaggccggggatgaaggcggcgtgcagggggtgcgcccgaggtctggggaaaagtctttgcgggaggccgggtcggcgactcccgagggctggtccggaatgggggcgcctgagggacgccgtgtagggggcagggagggagcaagcgtccccggcggcaaagggaggcggtctggggtccccaagtcctgcctcctcgcggggcagcgtcgcgccaagaggtccccgcgcctccggctcccagcggcaacggaaaagtctcaaaagtttttttcctcttctcccgaccagctcgtccctcctcccgctcctcctccccctcctccccgcagtggcgggggcggcggcggctcgtctcagactctggggcctcaggctgctcctcggcgactccttcctccgctccgggccgaggccggccccgcgggcggctcagagccgggggggtgccccggacggggcgtcccccctgcccccggccggggccctcgctgtctggctgctccgcggagggaggtgggagggagatggcccagggcgcgaagggcggcggcggcggggaccggctgggtcggcagggggttttgaagccgcccccggccccacccaggaagcgcacggggcgggagcgggggcggcccccagggggagggcatgggggggctgggccaccgtcctcatctcgcgtgggcgggctccgaggggggtcccttcagccctgggggaaagggggcgggcaccccggctccgccccgcaaacagggtgctgcctcctggcggccaagcgccaccaaagcgggtgatccagatgcgctgtggctttgcgggcggtgtgggtcaccagagaaagaggaccaggcggagaaggcttaatccgggggatgagacacaggggagccgaccagaggagggggacccagaacggaaggagagtcaggctgggaaacaaggtaggagaagagggtctgtcaacatgggggcctccggagggtgtcagtgggaggagggggcaacaggacacctgaaggatggaagggtcaggaggcagacacctgtaagaattgctctcctttactgagcacctcccatgtggctaagcagcctcctgtcactcaacaccctgcgaccccatacatttactgtccccaatttacagatagggaaactgggcccagagggaccccgaggtcctagaaaggacagaagcggtgccatgccttagctggggtcagctctgacagtctctagagtctgtgctcttgaccactgtgccatcctcccccatcactgggtgtccggggtgtggatggtggtgacgttggaggcagagtccctcagcactccacgccgtagcggtcgaagttgcggagcagcaggccgatctccaggtgcacggtgccaccagcagctgtgtgcaggcgatagcggtcggccccactgtagatggtgtccccatgcagcagctgcggcccaccacccacgaaagcccgtgccaactgttctcgccaactgcccaggggccgccacgtggggcaggccagctggtgggtgcccgggctactgggcacatggcaaaatccatagcctgcaagctggcagcggccaaagctgtcctgggaccacacctggaaatggagccggggccagcctgcaggaaaggagagagaggggaaaggagggatgggtggggaccagactcctgctgattccccactccctgatactcactggagaccccaggcccagtcttttcctctctgggtttctgtcccagagtttccaacccagcctcctttctaggctcccaccgtcttatctatccccacacagcagccaaagtgatctttccaaatccatgttactcccctgctaaggatccttccatagctccccagtgccctcagtataaagtccaacctcttcaacattcaaggcccttctaatcagacctctgctgaatttcctctctgtgttatcctcctccatgaccccatgtcagggcagcccattgctcctccagtccccaggtaaccatcatgggccttgtcagggacacctcctgccttccctcatgtccctgccctgctctctttgggcccagggccttctttcttgcccctctctaatccaccttccacctggcatctggaagcatctttctctccttccatagctttgcccatgtcctcagaacacagttcagctcctcagtctggtagtcaaagcccttggagatccagccccatctcatctcatgctgatcccttctcctgtgctagactctgttctagctagctggggacacggcagacatgaacatggatggcagacaaaaattcctgcccccgtgaagctgatatcctagacaacgaatgtagtaaataagcaaattatagggtagatcagatggtggtaattgctgtgagggaaaacagagctgggtagggtgagggtggggataccgctttagcaagaaggggatcaaggaagcttcattaagaaggtgacatttgagcaaatgctaaaaggaaggaagggagtaggccatgtggccatctagaggaagagtgctcctagccagagggaacagcaagtgccaaggccctggggggggactgtctggtggggacagtatggctggagcccagacggagtgtgcctggtggggacagcatggctagagcagaatgaggtggggagacgggaaggaggtgccagcctggttgtggagagccttgtgatgcatgctaagactatggctttcaccctgagtgagatggggaccattggagggttctgagcagagcagagatgggacctgacttaggtgttcacagggtcccagctgcatgtggggtgcagaccaggggggttggggaaggggactccagagacaagattcttgtcatagtccatgtgagagaagaacttggacagatcaaggtgctgggcgagaaaagggtaagaagtgggatttaggatgtatttcaaaagtagaggcagtttaagatttcctgatggacaaaatgggggcttgagaaaagagaaagcaaggctggtgccaccactgggggactggaggccccaagagctgaaaggttagagctgcccacctcacccacacagcaccggaaagattttttttttccccagctccagcttaaaagacagaaagattatttaaaagtgaaatctcagccaggcgcggtggctcatgcctgtaatcccagcactttgggaggccgaggcaggtggatcacctgaggtcaggagttcgagaccagcctgaccaccttggtgaaacgccatctctattaaaaaaaaaaaaggcaaaaattagccagatgtggtggcacgtggctgtagtcccagctactcgtgaggctgaggcaggagaattgcttgaacctgggaggcagaggttgcagtgagctgagatcttgccactacactccagcctgggcaacagagtgaaactctgtctccaaaaaaaaaaaggtgaaatctcacttgtccattacctgctctggctcccaagtgccttcaggagatggcctcagctcctcagcctggcactcaaggccctgcatggcctgtccccttctgcctttcccctctgccgtcccgctctccctcaatccactagatgcccttggctcactttcccctttgagtcttccacgtagctccctctgcctagaaccttcttctatccctctgccttattagctccgctggcccttcacagcaaagttcagaagccccctcctccaggaagccctctctgacctccctgacagagtcagccacttcctctgggctcccacagcctctccaaatcacctatcttagtcctgcccactctgaggtgccactgtctggagagaggtgtgtccccccataggacggtgaaccctgtgaggacaaggctaagggacactgccttgatcctcaatgtctccctggcatcacccaacacaggctggacacagggcaggtaccaggtagacgttctttatattggtgaaatatatggcacatttacctaggcaatttctcagaatcaactcatctccaggaacccacattttctactagaaaggctttctgatgccgctcctcccccagtactgatttcccctttgagcagcagctctactttcaagccgaggagcccttcctggagaaacagcccttgcctctctcagaccctgcctcccggcttcctctttattggagactctcgttttgtctctttacttgaatgccacctcccctcccaccctgaccccccaccttcccacctcctgctccaccctggcctctgccctaatcatacaaacttgggatcgcctattgagcaggcctgggaaggccttagctcagcctctccagggccagacttggctgcaaaagggacctacgtggtatggggagcagggacaggtcttggtgttcccagccccagggacctcagaggctactggccccctcccctcagcctggacccgggtccaggtgtgatacccaccttgaagacctttggtggcgaagtgcaggtcgatggggtgggaccagtaagccatgtcccctatctgcggggtgtccacttgcgtttggccctcccgcacgcctgacaggagcttccatgccgcccctgcagtgagagccgggacatagaggggtgggaggcagccatcgggaaggggatgccgctgtggctataggactgtttctctgtggcatctactggtaggggttacgaagcatggactctggaaccaagtatctgggttcaaatcctggcactacctcttcctgcctctgcaaccttgggcaagttagctttctctgccttggtctccccatctataaaatgagctgagtaataatgcattcctcattgtcttcatttgttttctgttactcttaacataatatccaaaactggataatttataaagaaaaggaatttctatctcacagttataggagactgaccaaggtggaggagccccatctagtaagagccttcttgctggaactcttcagagagtcccaaggctagtgtgctaacatgccactcacgtctctctctctcattttataaagccaccacttcctctcccatgataacccactaatccattaacccattaatccatgaatgggtaatgagcatagtgagcacgggataagtcttcaatatcattttattacgattctcaccccatattttcaagcctagtccaaggattaagatggggccaagggtaccctccaggagcgcatcctgaaacacacataacaatttcgatcctactgaggggtgataatgatagctaaaatgcactgagtggtaggatacagtggctcacacctgtaatctcagcactttgggaggccaaggcaggtagatcccttgagtccaggagttcaagaccagcctgaccaacatggcaaaaccccatctctacaaataatataaaaattaaggctgagcgcagtggctcacacctctaatcccagcactttaggaggcttaggggggggtggatcatctaaggtcaggagttcaagaccagcctggccaacatggcaaaacctcgtctctactaaaaatacaaaaattagtctggagtggtggcaggtgcctgtaatcccaggtactcgggaggctgaggcacgagaatcgctggaaaagctgcagtgagccgagattgcaccactgcactccagctggtgtgacacagtgagactccatctcaaaaaatgaacaaacaagccaggcgcagtgactcacgcctgtaatctcagcactttgggaggctgaggcgggctgatcacctgaggtcaggagtttgagaccagcccggccaacatggcgaaatcccatctctactaaaaatacaaaaattaggatgggcgcagtggctcacatctgtaatcctagcactttgggaagccaaggcaggtggatcacttgaggtcaggggttcgagaccagcctggccaaaatggtaaaactctgtctctactaaaaacacacacacacacacccacaaaattagccacgtctgtaatcccagcactttgggagactaaggcaggcagatcacaaggtcaagagatcgagaccatcctggccaacattctgaaaccctatctctactaaaaaaatacaaaaattagctgggtgtggtggcgcacgcccatagtcccagctactcaggaggctgaggcaggagaatcacttgaacccaggaggcggaggttgcagtgagccaagatggtcccattgcactccagcctgggcaacaagagcgaaattccatctaaaaaaaaaaagaaaagaaaaaaagaaaatgcaccgagtactaactaaatcccagatgctatgctaagtactttaagcatccattcatttaatccaccctctaggactcttaatcccctcctcaccccccagtttacagaccctccaccatggcccacgtggcctggctcttgctcccctccctgagttcatctcccatcactctccccctccctcatcaccctctggcctcactgtcccacttctgactccccacctcagggcctttgcactggctgttccctctgcctagaaagctctgctcctgggtgtccccatccctagcttttgttttcatccttcagggcccagctcaagtgccacttccacagaggggttctccctgaccctcttcaccaaacactagtccctgccacatcatttcttttcatcctagcacttaccactgtctggaatcacggtgctcctttctttttttgggggggtggggggagacaagatctccctctgtcacccaggctggagtgcagtggcacaatcacagctcactacaaccttgacctcccaggatcaagcaatcctcccacctcaacctcccaagtagttgggacgacaggcacacagcactatgctttgctaattttttatttatttgtagagacgggggtctcactatgttgcccaggctggtctcaaactcctgggctcaagtgatcctcctgctccagtctcccaaagtgctggcattacaggggtgagtcaccacacccaactgcactcgtttatctgtttatttattttattttatttatttttttttgagacagacttttgctcttgttgcccaagctggagtgcaatggcaccatctcggctcactgcaacctccgcctcctgggttcaagcgattctcctgcctcagcctctcgagtagctgggattacaggcacacgccgccatgcccagctaattttttttgtatttttagtagaaatggggttttaccatgttagccaggctggtctcaaactcctgacctcaggtgatctgcccgcctcggactcccaaagtgctgggattacaggcatgagccaccgcgcctggcctgcttatttattttctgtctcccctactgtatggcccaggaaaacagggaccttgcacactgctggatccccaagaccacaaacccagctcttggtatacagaaggtgctcaataaatgtttcttggacaaataagtgatcctaggaggtgggagctaatataatccccatttaacaggtaaagaaacaggctctgagaaggtgagttcatgaacatttattcagcacctgctatgtgccaagcactgttttccatgctggtgacatagcagtgactatagcagaccaaggtcccatcatgggactggattcagactcagctctaactgcagagcccaagcctttcatccaactgcctcagtattcttggctggatcaacatccccagcaactccctgaaataataaaaatcaggttagtcattactcccttctgggctgagttgagggaagcaccaggccctgcgtcaggctccttaaaagcaagatttcccaacagccctatgaagaacaaatgaggaaactgaggctccaagaggggacagcctctgcccagggtcacagagaaggtgagtggtccaacctggaaaccaagtctgactccagagcctgcccctcatccatcagctggagggttccgatttcctgggaatttcaacttccacctcacttacctgtagaatcaaaaaggacccaggggccaggcgcagtggctcacacctgtaatcccagcactttggaaggcctacgcaggcggatcacttaaggccaggagttcgagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaagggccaggcgcagtggctcacgcctgtaatcccagcactttggaaggcctacgcaggcggatcacttaaggccaggagttcaagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaaaaaaaaaaaaaagggccaggcgcagtggctcacgcctgtaatcccagcactttgggaggccgagatgggcagatcacaaggtcaggagatcgagaccatcctggctaacacagtgaaaccccatctctactaaaaatacaaaaaaaaaaaaaatagccgggcatggtggcgagcgcctgtagtcccagctatgcaggaggctgaggcaggagaatggcatgaacctggaaggctgagctagattgcaccactgcactacagcctgggaaacagaacgagtctcaaaaaaaaaaaaaaaaaaaaaaaagggactaggactcaggcctgaagacatgataatgccaaatggccacatctgtttcatagacattcatctgtgccacgcaacaacataccccaggctttacaaacaagaccccatcaaagtcttgtataagccaggcaaacactgaatgagcacttcctattccagccctattcctattctaagtgctgttgatactcgtttagtactcatgacaacttcaacaggtaaatatttctatgactctcattgtacaaacaaggaagtcgaggtgaagagaagtgcccaagttcacataatcagcccaagggtgccttaacaagcaataactggttttgaacccaggcagtctgtgctcttaacctcaaacctgtgctgcttcttagctactattagcttcactttgaaacaaggaaactgaggctcaaagtggtcgagtccaaaggtctccaattaataggtgggggagttaatatttaaatgcagatctggcagcccatgaccctaaccattacactataccatgactctatagggcctcagttggggaagcatgaacaaaattactttcctgggacgtggcggctcacgtttttaatcctagcactttgagaggctgaagtgggtggcctgtttgagcgcaggagttcgagaccagcctgggcaacatagcgagaccctgtctctacaaaaaataaaaaaaattagccagatttggtggtgcgtgtctgtagtcccagcttctcaggaggctgaggcgggaggatcactagagcccgagagttcgaggctgcactgagctatgatcacaccaccttactccagcccgggcgcagagagagaccctgtctgtatcccacccctcacacacacaaagatgggagcttgagactcatgtggacagggtgtgggctgggcctggagtactgagaactgatggaaatgaggttaagagtctgcgttaaggggtggaggaaggagcatgtagcctctaggctaggggtcttggtgtggaaatgaaccaggcttgggggaatacctgtgtgaatgccccacttgcagaagaggctactttccgagaaaccgctggcccctatgatctgcccgatcacgtgcacctcagccatggccctgggaggggaaaaatataatcacaaccctgtgaggtaagtgtattatctccatttgacgggggggaaactgaggcccagcaagtaaagggtagtactaggattccaagctagcttcgtcacacccctgaggctgaggtcttgaccacagatcctaattgccaacccatgaaagcctggaaaaaatggggggacccttgtctggggaaccagcatttaactctgggaagtccaaaataaccttttcgggttcaggtcggcggaaagccccgcccgaaggggctatggctccgcccacgagcgcaaaagacccgccttccgcgtcacgccagccaccccgcttccctcccccagcaagctccataaggcgcatgcgttatgagttcaggtccgacttaaccccgcctctaagcgcagcgcatgcgtcattcctaccttagcgcacttaacggttaggagaggagaaagcggcaaccggggttgtagttcatgggcttgactgcttcttttctccgcgggcgccgaccaggcctggctcgcgcctctcccaggacccgcctggctgcgagatatgtaagccgcgatacttccgcgaccgcgctcgtcttggtttccgtggttgttgctggggcaacagcaggctcctcccctagctttgtactcgctctgcgcgctactaattggtgctagccgtctgcggggggcggggtgaagctgtgatggacattttcctcctccgctccattttgggaaaatagcgtctctccagctacggcaaagggttccgccattttgggcgtggctaggaagctgccatgttgagtgtggctgaggaagtttgagtgcagtttctcccagataccttctttaccaaaaaagcaaatccctaactgctccgtgctgcgcctaccccaccgaagagctctctgtggtccgggatcacaaatcagagattgaaccaggaccaagggggaattccttccaggacctcgtgtacatccccggccttgtaactggaaaacaaagcaaaaaaatcactcctcattcagagagtggagaagttggggagtgggttctgcttccgttttagagttcccctaggtttctcaaggacaaggaaggaaggaagttggataagtccaacttccttctcggagctactaccaagttcactgttactgcttgattctgagcaaggagcggttggggtagcgaagagaaatgaggaactaagattcccttatttgcagaaaatcctctttcctattgattgatttatcaatcaagaaatggagatgttgtccctggatgccatcctagatgccatcatttcccacatcaagccagtcatcaggtcccatcaaggctccttaaaagggtctcactctgtcacccaggctggagtacggtggctcgatcacagctcattgcagcctcttaactcctgggttcaagggatcctcctacctcagcctcccatgtagctggtatcacagacatgcaccaccacggctggctaattcttttttttttttttaagagatggagtcctgctatgttgctatgttgcccagtcttgtcttgacctcctgggctctagctatcctcccagttctccctcccaaactgccgggattacaggcgtgagccacccagccaggccaatagatacaaagtatttacaagctaccattggctaggcgcggtggctcataactgtaatcccagccctttggaaggctgaggcgggaagagctcttgaggccagaagttcgaatatagggagaccccattaataatgcatatatcaactagtgaagtattccattgaattgtttaatataaatgttatcctattgaaatgttgtaccctcgttataattttggttttttactttttgagatggcgtctccccctgtcatccaggctggagtgcagtggtgcgatcccagctcactgcaatctctgcctcccgggttcaagagattctcctgcctcagcctcccgagtagctgggactacaggcgtgcaccaccacacccagctaatttttgtatttttagtagagacgggttttcaccatattggccagaccggtctcaaactcctgacctcaggtggtccacccgcctcagcctcccaaagtgctgggattacaggcgttagccaccgtgaccggccgggtttttttttttttttttttttttgacagagtctccctctgtcgcccaggctggagtgcagtggcatgatctctgctcaccacaacctccgcctcccaggttcaagcaattcttctgtctcagcctccttagtagctgggattgcaggcacccaccactatatctagctaatgtttgtgcttttagtagagatggagttccaccatgttggtcaggctggtctcgaactcctggcctcatgtgatccttctgcctcagcctcccaaagtgctgggattacaggcatgagccacctcgcctgggcccagctactttttgtattttcttttttattttatttatttacttttttttttttttttttttgagacagaatcttgctctgttgcccaggctggagtgagcctctgcacctggcagaggtttcacttttaaatgatctttctgtcctttaagctggagctggggaaaatgtatttatttatttatttatttctggatgctgtgtgggtgaggtagacagctctaacctttcagctcttggggcccctggtcccctagtggtggcaccagccttgcattctcttttctcaagcccccattttgtccatcaggaaatcttactgcctctacttttgaaatacaccctaaatcccacttctcacctctttgtcgccctgcaccttgatctgtccaagttcatctatcacctggactatgacagggaccttgtctctggggtcccctttgccaacccctctagtttgcaccccacatgcagctggaaccctgtgaacacctaagtcaggtcccatctgctcagacccgtccagtggtccccatttcactcagggtaaaagccaaagtcttatcatgcatgacaaggctctccacaacctggctggcacctcctgcctcatttttgtatttttagtagagacggggtttcgccatgttggccaggcaggtctcaaactcctgacctcaggtgatctgcccaccttggcctcccaaagtgctgagattacaggcatgagccactgctcccggctgaggtcttcattctgaaggctcccatgtatacatgttaaataaaagaaaataaattatcgtcaactataaataatgagattcagaaaatatgattgaggccggattcggtggttcatgcccgtaatcccagcactttgggaggccaaggagagtggataccctgaggtcaggagttcgagaccagcctggccaacatatagcgaaaccctgtctctactaaaaaataccaaaactagatgggtgtggtggcacatgcctgtggtgtcagctatttgggaagctgaggcaggagcatcacttgaacctgggaggcagcagttgcagtgagccgagatcacgccaccgcacttcagcctgggcgacagagccagacttctactctcaaaaaagaaaaaaaagaaaagaaaggaaaatatgattaactatagagtttattccaggctacaggaccagtacatatgttacaacagtttcattagtacatcttgctatgctgcagggaagattgcgttaacattctgataggaggaggagtactctttctttctttctttctcctttcttttttcttgagataagatcttgctctggggctgggcgcggtggctcacgcctgtaatcccagcactttgggaggttgaggcgggcaaatcacgaggtcaggggttcaagaccagcctggccaacatgatgaaacctcgtgtctactaaaaatacaaaaattagctgggcatggcggcgggcgcctgtaatcccaagtactcgggaggctgaggcaggagaatcacttgaacctgggaggcggaggttgcagtgatctgagatcgtgccattgcactccatcctgggggacaagagtgagacaaagtctcaaaaacaaaacaaaacaacaacaaacagatcttgctctgttacccaggctggagtgcagtggcacaatcacagctcactgcagcctcgaacgcccaggctcaagcctcctgcctaagcctccccagtagctgggactacaggcgtgtgccaccatgcccagctaatttttcaataattttttctgtagagacatggtctcactctgttgcccaggcttgtctcaaactcctgggctcaagtgatccacctctgcctcccaaagtgctggggttacagatgtgaggccacaacacccggcctaggagtaatgttctgaggtgatcttatctctggcactgcttggtcattcttaatcatttacaggaaaaagcagaagttgtaactgcatgctacgtgactcaggctacatagcaacattcctctcaaggcttggaataatttaaagttccaacagctttaagtttgaattatctaaccacattatcgaaagttggccaggcctggtggttcatggctgtctgtaatcccagcacattgagaggccacagcaacaggatcacttgaggccaggagttctggaccagactaggcaacgtagtgagaccctcatttctacgaaaacgtttaaaaaaaaaatagcagggcatggtgacacatgtctgcagtcccatctacttaggaggctgaggcaggaggatcccttgagcccaggagtttgaggctgcagtgagctgtgatcatgccaaggtacttcagcctgggtgacagagtgaaaacctgtcaccttttttttggggggggtggttattgggtttttttgagacagagtctcgttctgtgggccagggctcacagcaacttctgcctcccaggctcaagcaattctcctgcctcagcctcccaagtagctgggattacaggcatgtgccaccacacccgggtaatttttgtatttttagtagagacggggtttcaccatgttggccaggctggtcttgaactcctgacctcaagtgatccacctgactcagcctcccaaagtgctgggattacaggtgtgagccactgtgcccggcctgaagctgttttaaaatatatccacaaatgcttgggcagccccctttcagtaagtggagcctaattctccttcccttcagtatggctagtttttgtaatttgcttctaaccaatagaatatggggctgggcacagtggctcacacctgtaatcccagcactttgtgaggccaaggcgggcagattgcttgaatccaggagtttgagagcagcctggacaacatgatgaaaccccatcactacaaaaaatacaaaaaattagctgggtgtggtggcatgcccctgtagtcccagctactctggtggcggaggtgggaggatcgcttaggttgagagttggaggctacagtgagctgtgattgtgccactgcactccagcctgggcaactgagtgagaccctgtctcaaaaacaaaatgcttttaagccaagtatggcacacagccggcggtcccggctacttcatttttgttgttgttgttgttttgagacagagtttcactcttgttgcccaggctggagtgcaatggtgtgatctctcctcaccacaacctctgcctcctgggttcaagtgattctcctgcctcagcctcccaagtagctgggattgaaggcacctgccgccacgcccagctaattagtagagatggggttttgccatgtatggccgcgcctggccatcccggctactttggaggctgaagccggaggatgccttgagtgcaggaagtccaggctgcagtgagctatgatggcaccctgcactccagcctgggcaacaaagtaagactgcacctctaaaaaaaaaaaaaaaaggcccggtgcagtggctcatgcctggattcccagcactttgggaggccgaggcaggcagatcacttgaggtcaggagttcgagacaagcctggccaacatggtgaaaccccatccctcctaaaactacaaaaaaaatcagctgaacgtggtggcgagcgcctgtagtcccagctactcgggaggctgaggcacgagaatcacttgaacccaggaggtggaggttgcagtgagccgagattgcaccattgcactccagcctgggtgacagagcgagactctgtctcaaaataaataaataaaaataaataaataagccttttaattgtggtaaaatacacatttaccatcttaactgtttaaaactgtattgttcaatagtgttaagtacatttacattgtgcaaccaatctccacaaccattttcatgttgcaaaactaaaatttttgcaaagtaaacacatttttgaaacaaaacaactcccctattcccccctcttctgcagctcctggtaatcaccatcctattttctttcaatgtatttattttactttatttatttatttattttttgagatggagtttcactcttgctgcccatgctggagtgcaatggcatgatctcagctcaacgcaacctctgcctcccaggttcaagtgattctcccacctcagcctcccgagtaactggtattacaggcatgcaccaccatgcctggctaattttgtatttttagtagagacggggtttctccatgttggtcagactggtctcgaactcctgacctcaggtgatctgcctgcttcggcctctcaaagtgctaggattataggcgtgagccactgtgccccacctatttatttatttttattttatttatttatttatttatttatttatttgagacagagtcttgctctgttgcccaggctggagtgcagtggcaccgtgtcagctcactgcaacctccgccttccgggtttaaccgattctcctgcttcagcctcctgagcagctgggactacaggcgtgtgccaccttgtccagctaatttttgtatttttagtagagacggggtttcaccatattggccacgctggtctcgaactcctgaccttgtgatccacccgcctcggcctcccaaagtgctgggattacaagcgtgagccaccgtgcctggccacctatttatttttttgagaggaagtctcattgtgttgcctaggctgtggtgtagcaacgtgatctctgttcactgtaacctctgcctcctggcttcaagggattctcctgcctcagcctcccaagtagctgggattacaggcatgtgtcaccacgcctggctaatttttgtatttttagtagagacagggtttcaccatgttggccaggatgtactcgaactcctgacctcaggtgatcagcccgcctcggcctcctaaagtgctgggattacaggcgtgagctaccgtgtctggcctgttttttattttttttgagacagggtctcgctctgtcacccaggctggagtgttctggtgagatctcagctcaccacaacctctgcctcccaggttcaagcaattattgtgcctcagcctcccgagtagctgggattacaggcatgcaccatcatgcccggctgacttttgtatttttagtagagacggagttttgccatgttggccaggctgatttcgaactcctgacctcaggtgatctgcccgccttggcctcccaaagtactgggattacaggtgtgaaccaccatgcctggcccactatcctctccttccttccttccttccttccttccttccttccttccttccttccttccttccttctttccttccttccttctttccttcctccctccctccctcctttctctctctctctttctctctctctttctttctttctgttgctctgtctccaggctggagtgcagtggcacaatcttggctcactgcaacctccacctcctgggttccagtgattctcctgcctcagcctcccgagtagctgggactacaggcgcacaccaccaagtccagctagtttttgtatttttagtagagatggggtttcaccatgttggccaggatgatctcgatctcttgacctcgtgatcggcctgcctcagcctcccaaagtgctgagatcacacgtatgagccactgcacccggccactatcttattttctgtctctgtgaatgtgactactctaagtacgtcatgtaagtggaatcctacagtatttgtcctcttatgacaggattatttcacttagcatagtgtcctcaagggtcatccaggtcatagcatgcaacaggatttttttccttcctgacccccctttttttgacttggagtcttgctctgtcactcagactatagtgcagtggctatcacagccactcctggactcaagtgatcctcccacctcagcctcccaagtagctaggactacaggtgtgtgccaccgtgctcggctaatttttttttaagttttggagagagagggtggtctcagtggctcccgcctgtaatcacagcactttgggaggctgaggcagtagggggcgggggtggggatcacttgagggtaggagttcgagaccagcctgggcaacagggtgaaaacctgtgtctactaaaaatataaaaattagctgggcatggttgtgcgtgcctgtaatcccagctactcggaggctgaggtaggagaatcacttgaacctgggaggcagaatttgcagtgagctgacattgcgccactgcactccagtctgggcaacagagtgagacttcctttaaaaaaaaaaagttttgggagagatgggggtcttactgtgttgcccaggctggcctggaactcctgggctcaggcaatcctcctgcttcagcctctgggattacaggcatgggattacagtgctgggattacaggcatgagccactgtacctggccagcactttattttattgttatttattattattactttgttttttcataacattgatgttttgaaggttataggcgacctcctttgtagagtgtccctcattttggctttgtctcatgtttcttattattagatttaagttatgcattttggcaggaaaaccaaagaaatggtatgtgtctccctctttgcttcagaccagaggcaactaaggtcaatttgtcctgttaatggtgatattaacttgtatcatctggttaacgtgatgtttgccaattttctccattaatttttttttgttataataagtaatctaggggaagctactttgagactaaataaatatcctgttctttatcaaatcagattttcacccaataacttaatagtttcagtctctgttgacaatccttgctggaatctcgtgatcttttgtttttgtttttgtttttgtttttgagactgggtttcactttgttgcccaggctggactgcagtggcacaatcatggctcactgcaacctccacctcctgggctaaaccaatcctcctatctcagtttcccgagtagcttggaccacagacatgcatcaccacacccagctgattttgtttattttttgtagagacaaaatttcactttgttgccctggctggtcttgaacttttgggtttaagtaatcctcccaccttggcctcccaaagtgctgggattacaggcttgagccaccgtacccagctggaatctcatgtttaatattccagacctgtcacaaacactaagaggtgtagcctcttagactgtacaaggctaacggcagccagagagctctcactggaagtgaattaatctctaggatggcctagagggatgaggggacccacagagctcaatgatttggtgaaaaactgaggctggaggctgatgggaatttatgcccccatcccacacatatgtaataaagacccactttgtgccaggcactgttttaggccgtgaggcacagtagtgaaaaaacgagatcaaatctcagcccttgttgtgccgacactgatgtgggaggattcaaactacaaacaagaaaaatacatggtatgtttaaggccgggtgcagtggctcacgcctataatcccagcactttgggaggccaaggcgggcagatcacttgaggtcaggagtttgagaccagcctgggcaacatggtgaaactccgtctctactaaaagtacaaaaattagctgggcatggtggcaggttcctataatcccagctacttgggaggctgaggtgggagaatggcttgaacccaggagatggaggttgcagtgacctgagatcgtgccactgcactccagccttgctgactggggttttgctatgtcgcccaggctggtttcgaactcctaggctcaagcagtcctccctcctcggcctcccaaagggctgggattacaggcgtgggccaccgcacctggcctacagtatgcttcatagaaatatgaaaagaatgagagcaaggttgagatagaaagtaacagggcatccctcctgagtaaaacaatcctgccccctcacgctctcgtctaccctcccgtgggtctccctgcttctgtcgtctgccagaaactggctgagccaagtgcacttgcagacgccatctgttctccctgggagtggggccggtgccagcgccagcatctggactcttggcaaggagccctggagccctggagcgagggaactccggccccacaaaggccagggaatcctccagtctggtgagacggagggcttctgggaagggaggcctatacaaggctccatgaaggaggtggaagcttgcaagacgatgatagtcttgtaatcagtccgatggagatggatgtaaataataatattaataaacaccatcaaatgtgttcagagtgctttctttgccaggctttggataaatgttggatatctgttctttttattttttatttttctatttcctaggcagcacctaaaccaaaataggttcagagaggctcccaatgttggacatttgttgttgcagcaactctaagtactctacatatgttatcacataagaggcaaggagcattatccccattttgtaggtgaagaaataggggttcagagaggtgaaggcattgtctagaggccacacactcagtgacttaaagagcctggaaaggggccaggaatggtggctcacacctgtaatcccagcactttgggaggctgaggcgggtgggtcacctgaggtcgggagttcaagaccagcctgactcatatggagaaaccccatctctaccaaaaatacaaaattagccaggtgtgatggcgcattcctgtaatcctaactactcgggaggctgaggcaggagaatcgcttgaacctgggaggcggaggttgcggtgagccgagatcacgccattgccctccagcctgggcaacaagagtgaaactccatctcaaacaaacaaacaaagagcctggaaaggaaaccaggtctatgtgggtccaaatgctgactcatgaacatcactgtaccacgtgacaatcagagcatcaccccctactggaccccactcctcagccttctttccctagaaactcctaacccacctgcctctgcttcctcctcacccattggcttagcaagggccacaggaacacagcccggggttacaatatgctgggcttggtaccagctgtttactgtggccaagtgagcatgcaagtgagcccgtttattttcttttctttttttttttttttttttttttttgagacggagtcttgctgtttcccaggctggagtgcagtggcgcgatctcggctcactgcaagctccgcctcccgggtccacgccattctcctgcctcagcctcccaagtagctgggactacaagcgcccgccaccaagcccggctaattttttgtatttttagtagagacagggtttcaccgtgtcagccaggatggtctggatctcctgacctcgtgatccgcccgcctcggcctcccaaagtgttgggattacaggcgtgagccactgcgcccggcccgtgagcccgtttctttatctgcaaaacagggattaaaaacaagccaacaccccttcagcactcctccgcaaaaaaacaccccaaaacaaaataggccaggcgcggtgactcacacctgtaatcccaccgctttgggaggccgaggctgcagtgaacccaggagtctgaggctgaagcgagcaatgattgcgccactgccttccagcctgggcgatcagagcaagaccccgtcttttaaaaaataataataaaaaaaaaatctgccgggcgcggtggctcacgcctgtaatcctaacactttgggaggctgaggcgggcagatcacctgaggtcaggagttcaagaccaacctgaccaacacagcgaaatctcatctactaaaaatacaaaaattagctgggcgtggtggcttgcccctgtaatcccagctactcgggaggctgaggcaggagaatcgcttgaacccgggaagcggaggttgcggtgagccgagatcactccactgcactctagcctgggcgacagagcaagactccgtctcaaaaacaaaacaaaacaaacaaaaaaaccaaagtaaaatagcagcgacaacaacaacaacaacaagaaaaacccggagctgagaggaagaatgaatgcgatgatgaatgtaaagcgtttaacacagggcttgggtacagtctgccctcaatgaaccaatgatgtacccctaggcaatttacctaacctcggcttgccagtttcctcccgcgtgaaacaggacaataaacgattatgcctcttagggttgtgctgaggaatacatgtgtatgtaagtttatttgcaaagcacttagaacagggcgcacggtccttgttgctgttattattattggctattattgcgcaaaggggaagggaggcggggccaagccaggaaggccctggagaatccggggtgccccctcctccggcagagcttgggcctgggctcacgaggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggtgagtgagggacgtaggtgggtgggggtcacagtcccttccctgggtcctggagttggggatgagagggcaaagctttggcgaggaaatcggctcagtcaaggtttggaatgagcaggcaggaggcttggggaccttccagggggatcgtaggacgagaagaagaatattctttctggttgtgttgcgtgtgtacgtgtatgtgtgtgctggggttgagggtgtttatgggggcgaggtgtgcaaaggattctggagagctggtgcatgtgtgggagttgtgtggagtcataggtgtgtgggtggagtagggcaggggtgcctgggcctgatgagtggggcaggcatgccagaggtcatgagaataggagagagtgccggggtgcatgtgtgcgtgtgtgcacaggtgtctgtggtttgtgatgcagtggggagtagggttgtgcacggagtcaattgggataaatgtgtaagaaggttggggacctgaaaggggtgttttctgggagctgatgttttggggcaaatattcaaggagtcctttgggagatgaatgtgtggaggtggaggctgggcttgcctagatggggctgtgtggcaggggacttcggggggcaggtctaggggacagaggatggggaatgtagactagagtgcagttccaggcagcactgggggtaggggatgggtgtgtgtgtgactgggaggggtgcctgggcctggataggtggtcacgcggtatgaacctgggatggatattgggggtgtttgtggggcaggtaagtgtgtaaggcatggtgcaacaggtgctgcaacttattggggtaagtgtgatgggtatgtggcttttgcctgagagaaatgcccagaatttggctgggtgcggtggctcacgcctgtaatcccagcactttgggaggccaaggctggtggatcccctaaggtcaggagttcgggaccagcctggttaacacagtgaaaccctatctttactaaaaatacaaaaaaaaaaattagccgggcatggtggtgggcgcctgtaatcccagctactcgggaggctgaggcagaatggtttgaacccgggaggtggaggctgcagtgtgctgagatcatgccactgcactctagcggatctgcagtggtggatctgcctgggcaacagatggagactttgtctcaaaaaaaaaaaaaaaaaagagagagagagagaaatgcccaaaattgaatgtccagacccctgagttctcttcataacctgaggccaatctttttttctctctgggcctcagcttctgtatctgtaaaatgggtctgaggaccactgcactaactagtctctgcctgagtctctctaaagcaaggggtcagaggttgagtgaagtgagacttttacaacttgtctttttcttccccctacccctaggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggtaggaaacagcaggccttagtggaaggcacgggagggggctggggtgagccccactaaggccagcatctggcaggttgacagctgtgccgatctgccttaggcctggagtctcacttcccagctgtgtgtgggcttctgagatttccagttacggttcttcttgttttatgtctctcatctttgttgcctggcttttggctctgtcttccctctgatctcagactccgctggttggtgtcttcagagtgcatgcacctctggcttttgtccaccctgctgtctccctctttgtgtgtgtgtgtgagagagagagagagagagagagagagagacagggtctcgctctgttgcccaggctggagtgcagtggagcgatcatagtttactgcaaccttgacctcccgggcttaagcaatcctcccacctcagcctcctgagtagctgggaccacaggcatgtgccaccatgcctggctaattttttggtgttttttgtagagaagaggttttgtcatgttgcccaggctggtctcaaactcctgagctcaagcaatctgcctgtcttggcctcccaaagtgctaggattaaaggtgtgagccaccatgcccagccttccttttttttttttttttttttttttaagttactgttgtcactttttataatttctcattccaggccaggcacagtggctcacactggtaatcccagcactttgagaaggcgaggcaggaggactgcctcgcccaggagttctaggctagcctgggcaacttagtgagactccatctttatttttatttaatttttcattttgtcctccgaaaattagaaagaccccatcttaaaaaaaaaaaaaaaaattagccaggtgtgatggcgtgttcctgtagtaccagctacttgggaggctgaggtgggaggatcgcttgagcccaggctgcaatgagctgtgatcataccaccttactccagcctggacaacagagcaagacagacagaaagaaagaaaaagagagggagaggggggagagagagagagagagaaagagagagggagggagggaggaaggaaagaaagaaaagagagagagaaagagagaaagaaggaaggaagaaagaaggaatgaaggaaacaaggaaaggaaggagggaaggaaggaaggagaaagcagaaagaaaggaaggcaggcaggcaacaatcatgatgaactcttacggtttctgttggtcaggaatttgggacttagttgcatggttctgcctctggatctttcttgaggttgcattcagctggtgggtggaactagaacagtcaggggctggctgggcacttttctctctcttcatggtgtcttagggcttcctttttttttttttttttttttttgagatggagtttcacccttgttgcccaggctggagtacaatggtgcaatctcagctcactgcaacctccgcctcctgggttcaagcaaattcccctgcctcagcctcctgagtagctggatttacaggcatgtgtcaccatgcccagctaattttgtatttttagtagagacagggtttcactatgttggtcaggttggtctcaaactcctgacctcaggtgatccacccacctcagcctcccagagtgccagattacaggcgtgagccaccgtgcccagccgagtcttagggcttctatgtggtctctccatgtttgctgccttgggattccttacagcataacggcttcagggcagtcaggcagcttatgtacctccagcctacagcatgaatattgcagcaaagcagaagctgcctcaccttttctgatttcgctttggaagtcacgtaacatgacttccaccacattctattaattacaagtgagtcatgagcctgctcaaattcaaggggaggggacacagaactcatcccttgatgggaaggatatcaaagtcacatggtaagaaaagcatgtggggccgggcgctgtggctcatgcctgtaatcccagcactttgggaggccaagacaagttaattgcttgaggtcaggagttcaagaccagcctgaccaatgtagggaaagcccgtctctactaaaaatacaaaaattaggccaggcgcggtggctcacgcctgtaatcccagcactttgggaggctgagacgggcggatcacgaggtcaggagttcgagaccagcctggccaacatggtgaaacccagtttctactaaagaaaaaatacaaaaattagccaggtgtagtggtgcacacctgtaatcccagctattcgggaggctgaggcaggagaatcacttaaacctgggaggcggaggttgcagtgagccgagatcacgccattgcactccagcctgggcaacagagtgaaactctgtctcaaaaaaaaaaaaaaaaaaaaaaattagctggccgtggtggtgggtgcctgtaatccccgcttttgggaggctgaggcaggagaattgcttgaacttgggagatggaggttgcagtgagctgagattgagccactgccctccagcctgggcaagactctgtctcaaaaaaaaaaaaaaaaaaaaaaaaagcttaaaaatctaaactctagagttttcagcaggcaggtttgccctaatcatttaggccactggagcattttataatctccatcttttatttatttatttattagtgacagggtcttcttgctccgttgctcaggctggggggcagacatgtgatcatagctcactggagtctcaaactgctgggctcaagccatcctcctgcctcagcctcccaaagtagctgagactacaggcacaagacaccatgcctagctaattttttttttttttttttttgagatggagtctcactctgtcgcccaggctggagggcagtagcgcaatctcggctcactgcaagctctgcctcccgggttcatgccattcttctgcctcagcctccagagtagctgggactacaggtgtgtgccaccacacccggctaattttgtttttgtatttttagtagagacgaggtttcactgtgttagccaggacggtctcgatctcctgacctcatgatccgcctgccttggcctcccaaagtgctgggcttacaggcgtgagccactgagcctggcccatgcctagctaattttaaatttttttttgtagagatggggtcttgctgtattgcccaggctggtctcaaactcctggcttcaaatgatcctcccgccttggcctccctaagtgttgggatgacaggtgtgagccactgtgcccggccaataatctccatctttttgcaggttccttgtttcagtggtgtttgtccctgctcaggggcttttctttttttgagatggagtctcactctattgcccaggctggagtgctgtggctcgatctcagctcactgcaacctccacatcctgggttcaagtgattctcctgcctcaacctcctaagtagctgggattacaggggcataccaccacgcctggctaatttttgtatttttagtggagatgaggtttcaccatgttggccaggctggtctcccaactctcgacctcaggtgatccacccacctcggtctcccaaagtgctgggattacaggtgcaagctaccacgcccggccatgcgggggcttttcactcagagattgtaagcaattgtagcgtccatgattggatccgtcaaccccttgaaaatgaactgaaaactctgggtgtgggtggggctcttctctggagacctgatccacaacttcccttcaaagggctccaggatacaaatgtcaaaagcccatctctggccaggtgtggtggctcatgcctgtaatcctggcactttgggaggccaagacgggtggatcacctgaggtcaggagttcaagaccatcctggccaacatggtgaaaccccatctctactaaaaatacaaaattagccaggtgtgatggcgtgtgcctgtaatcccagctactcgggaagctgaggcaggagaatcatttgaacccgggaggcagtgagccgagactgtgccattgtaccccagcctgggtgacagagcaaaactccgtctcaaacaaacaccgaaagcccatctctgaacacttttttctctttgtatctctggggaagccctaggggcaggtattggcctttgagggctatggagagcagagcaatggggcaggaaaggtggatggagatgcccacctgggcactttcctgtccgtaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcagtggtacaatctcggctcactgcaatctctgcctcttgggttcaagtgattctcctgccccagcctcctgagtagctgggattagaggcgcgcgctaccatgcctggctaatttttgaatttttaataaagacggggtttcaccacgttggccacgctggtctcgaactcctgacctcaagtgatcctcccatcttggcctcccaaagtgctgggattacaggcgtgagccacggtgcccagctctctgcaagattttgggcaagtcacttaacttccctgtgcctcactttcctcatctgtaaagtgggaataattgctacctctgggtcaatgtgagaatcaaatgagttagaatagtggcatataccattttaatgtttttatttattttttaaaatttattattattattattttttaccattttaatgtttttattaaccactcagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaaccagagtctgttcgcgtgtgtgggaggatggaagggggtgggggtgcttgagaccaacaggggactgactggtcagggtgacgggctgtggtgggcatccccagggtgcttgctccctgagacctgagctggaaaagggggaagaggattttcgggttttttttgttttttgagagatggtctccctgttgcccatgctggagtgctgtggcacaatcatggctcactgcagccttgaactcctgggctcaagcaatcatcctgattgagcccaggagcctcccaagtagccgggactacgggcacctgccaccacacccagctaattaaaaaaatttttttgtaaagacaaggtatcactatattgcccaggctggtctgaaactcctgggctcaactgatcttcccgcctcggtctcccaaagagctgagattacaggcatgagcgaccatgcctggtggtttctaaacagcaggatgttctcatcccaatatgggtggttagcagagaactggagagagctgagtttcaagtccttactcctctacctgttagctgtgtaagcttggcccaagtgacttctcactttttctcctctgcaaaatgggactttctgcacacctcaggctgtagtgaggattaaatgcatcatatgtggaaatgactgtctgctgttgctgtctccctctgagcttttttttcttttcttttcttttttttgagataggatctccctctgtcaacccagactggagtgcagtggcccgatcttggttcactgcagcctcgaccttccaggctcaagtgatcctcccacctcagcctcccaaggagctgggaccacaggcgtgtgccacaatgcctggctaattttttgtatttttttttttttttttgagatggagtctcgctctgttgccaggctggagtgcaatggtgcaatctcaactcactgcagcctctgccttccaggttcaagagattctcctgcctcagcctcctgagtagctgggatttcaggtgcgcagcactgcgcctggctgatttttgtatttttagtagagacaggttttcaccatgttggtcaggttggtctcgaactcctgacgtcaggtgatccacccacctcagcctcccaaagtgctgggattacaggcgtgagccaccaagcctggtctttattgcttgataatgtctagcccctcttagtgtgcttagtgagcacttcctatgtgcctctgctaagtgcttgtgacagatgtgttttccctgtccaggtgccaacacctccatgtttccttaaggatgcatccctttccctattgcaggccatttggtttggatgggactgcctccaactgcaggtagggttttgccccatctctactaaaaatacaaaaattaggctgggcacagtggctcaagtctgtaattccagcactttgggtggccaaggcaggcgaatcacctgaggtcaggatttccagaccagcctggccaacatggtgaaaccgcatctctactaaaaatacaacaattaggccaggtgcggtggctcacgcctgtaatcccagcactttgggaggcagaggtgggcggatcacctgaggtcaggagttaagagaccagcctgaccaacatggagaaatcccgtctctactaaaaatacaaaaattagctgggtgtggtggcatgtgcctgtagtcccagctactcaggaggctgaggcaggagaatcattggaacccaggaggcggaggttgcatcaccccattgcactccagcctgggcaacagagcgagattccgtctcaaaacaaaagaaaacaaaacaaaacaaaacaaaacaagacagggactataacaacagccccatctcacagggttggtgggtgggtatttagagtttcctccccatggcctacaaggccccacctgcatgcttgcccgtttcccccagccccatctgctctcctgctctagctcgctggctttggccaccctgttcaccaagctggtccccagcccctgggggctccttccccacattatccaagagctcactccctttcctctttcagggtcccctctgaggtaccctgctctgtgaaggcactgatgcctgatgtactcaatttgccctccataaagggactctcccaaactcctgttccctgctttttactttttcatagatttactaccatctgacaaattccagtttacctccctgctcctctgggatctcactagcagggcctgcacacgatgggtgctcaacagacatttgttaaagtgaattaatttattgattcatccattccataaatgtgagctcctttgaatgttatccttgctggggggatctgtgcccccaggcctgggggctgtcacaggccaaggcctccccacaggagccctgtggttacagagctgcaggctcaaggagcccatgggtcagagaggcaaggctgggctgctggtttgcttcaggctgtagggggtgagtgggtggaggcaatgggagcggccccttgccccagcttgcctcagctcttggagtaacgcctctgcagcgattcccggtagaaacggaagacgtgttgcgaagcggcctgggccgcagccaggcactgctggagctgcgggggagagactggtcggtgctgggggccgagcccttcatgcacacacgacttggctgacccaggaggttctgctgaccccacctgactcccttaacctcccatcactcccctgcccccaagtgaggcaagtggtaagggattatttcccatttcatgaactgtttcttagagatcaggagaaataaaaagagggagaaggacttcaggatcagattctgacagcaacaggactcagacctatcaggcatcctcacaccttggaggaggccccagctgtgcagagctatggaactggagagtgcacagaattggagtggtcttgggattttacagccacagtccccttcagcccaaataatctaagagccatggaatcaagagactcccagtcttcactgccatgtattcctagattcatgaggtccaggttggacatgcttttgcagacagtcatgtccaagagtttccaggctctgccccttagcctgagacctggaattcccatggctcaccactctgagctgggagctgggggaccatcacatgccctcttctgacttcaaactgagctcatcctctttttgcctgtgttataaattgggcttcccttaaacatttccgcaaaggtttctgggtccacaaagtttgaaaactccctttttacaagaagaaatttaagaggctctcctgaagcctctcagaatccagggcagagttgggacaagaccgtatgtcagtgggaaggaaggttctggcttttcccctcatccccatgctggtacctcagtgtctgagtagagccccttggtgctggacatcagcagcttccgttccacgctgtccagggcaaaggtcaggactgcccgggcctcctagggacaaggggtagaaggcggtgggggacctaggaccttcccctcagataaaatctcagccagtcctttggccaggcacagtggctcatgaccataatctcaccactttgggaggccaaggcagggcactgcttgaggccagaaactcaagaccaatctgggcaacagagggagaccccatctcagaaaaaaaaaaaaaaaaaaggtagctgggtgtgggggtgcatgtctgagttcccagctactcaggaggcagaggtgggaggactgcttgagcccaggagtttgaagctgcagtgagctgtgatcgtactacactccagcatgggcgacagtgagaccctgtctcaacgctccccttcccaccacacacttgcagccagtcccactgaggggactccggacccttggcctccaggcctctccctttccatagccaggcgctcacctatcaagcatcaagcgcagccattttttgtctacgctaccccttccctacttccctgggtatagccctctgcctttcctttgtagaactgtactccatgccccttattccaaccacgtggttctgacaggggcttccaagctcagtattcctgccccaaggggctagccatagtgccactcacttatctggtacctctcggcctcccagtcccccttccatgctctgtcccacaggggctggaagccagcaagctgtatttcccagactcccttaccagctagtttccatcagtaatgaggtgggagaatggaagaaaagcagcaccctggtcctcatggacaatggcaggtgctgatggctgtggctgtgtgacagccatggaggtggggtgggttctggacctcagtggccagggcagaagcaggacatgctatgtgcatccagaaccaattgagatgatgtctccaacacgacagaacaggaggtggctcgcaggttcagtccaggtctgggaggggtttctcatctctgggtgtcactcctgcttcctttttcctcctctagttcctcaacactgttgttacaaagtccctgcatttaactccctccatctgaaaccctccaagtggtttccgtcttcttgactagaggggaccattatagcactgggcagaaaactcagaataacttgagcttaggacactgcacctgagccgatgaggaaaactctcttctcgtttgcttttgagcctcctaggatggaaatggagcttaaggggtcagtcccagcctcaggaaaggtgctggccagaaagaatgaagctgatgtgcagagaaaggcagggacgagaagtgaagcaaggacatcctgatggtgtttaaagtcctggttttattttattttatttttgagagtttcactctttcatccaggctggagtgaagtggtgcgatctcagctcactgtaacctccaccctccaggtttaagtgattctcctgcctcagcctcctgagtagctgagattacagatgtgtgccaccatgcctagctaacctttgtatttttagtagagacagggttttgcaatgttggccaggctggtcttcaactcccagcctcaggtgatctgcctgcctcagactcccaaagtgctggcattacaggtgtgagccaccacacctggccatacatttcctttctagtttatttatttatattttttgagatggagtttcactcttattgcccaggctggagtgcaatggcgcgatctcggctcaccacaacctccgcgtcctgggttcaagcgattctcctgcctcagcctcctgagtagctgggattacaggcgtgcgccaccacacctggctaattttgtatttttagtagagatggggtttctccatgttggtcagactgatctcgaactcccgacctcaggtgatccacccacctcagcctcccaaagtgctgggattacaggcgtgagccaccgctcccggccccacatttccttcctaattaagcaagtctgagctgggtttccagcacttgctgctaaatgaaccatgatgattagagcagcccttgctaagtgggattgaggtggcatgagccgactgtctgtagagaagcgaggcctggaggaagggacgggcagctgtctggcctctgcccttcagccaccctggtcttcacacctaccttttcttgcttggatgtaggatccagcacgagggtcccatcagagtccagggcgcaggcgaccccacagaagagagcccgcatgggcacacctgcatccaccaatgccatgcaggcggcattcagacaacaggccaggagctgagcaccacaggaaatggttaagtttcttttttttttttttggagatggagtttcgctcttgttgcccaggctggagtgcaatggtgtgatctcggctcactgcaacctccacctcctgggttcaagcaattctcctgcctcagcctcctgagtagctgggattacaggcacccaccaccacacccggctaatctttgtatttttagtagagatggggtttcactatgttggccaggctggtctgaaaactcctgacctcaggtgatccacctgcctcggcctcccaaagtgctgggattacaggcatgagccaccacgcccagcctaagaagtttctactgtaggcctggccagcagagcagatccatgcctccctccaccaggctgatgcctatggcagacatcactaatcggtcacagaagggcagtatggcagagtggttaaaagtggtccggggatcaagtagccctgggttccagacctagttttgctcagctgtgtgaccttgaacaagtgacttactccttgagtctcaatctcctcatctgttagatggggaatataataatattcaataggtatgtactgaagtacgtaccacacatttgttggcaaatagggtcagagaggggaagaaaccttccaaagacacgagggggaggcactggcaaagccaggcccgaaacttgggtagcagccactccccggtgacagagctggcagggcaatggaggaagagccacctcgctgctgcctgcaggaagctcacagtggaaagagagcacaggttgggagtcagctggctctgcctcagtttcctaatgtgtttcttctccaggcctagcagccagacaaagaccacagctttagtcaaccggttccagctctgctgctgatcctccacgccttcctctgggcttcactttccacttctgtaaaatggggtcacaataccttctctctctgcccatccataaaatgtctgtccagttcagggccacgttccagtaaagccttctacagtgtctaattctagtcctcaacctcaacctctcgcacctcagacatggagatcttacaaggccacgctcctgactcagctgctgtctgctcagggcgcccccagcactgagggcctgaaatccactgaggtgccgagtagaagtgattgccagccgggcacagtagctcatgcctgtaaccccagcactttgggaggccaaggtggactgatcactcgaggtcaggagttcgagaccagcctggccaacacagcaaaaccccgtctctactaaaaatacaaaaattagcctggcgtggtggcaggcacctgtaattccacctgtaattcaggaggctaaagcatgggaatcgcttgagcccgggaggtagaggttgcagtaagctgacattgcaccactgcatccagcctgggtgacagagtgagagcctgtctcaaaaacaaacaaaaaaacccaaaaaacaaaagaagtgattggcacaggctctggagtcagactggcctgggcttgagtcctgcctgtgctgccttccagctgtgtgaccttgggcaagccccttcccctctctgggcctcagttttgtcacctgaaacatgcgaacataagaacactcatctgccagggtccgtgggctctagaactagacggtctgggtctaagtcttggctctgccacttccacggggatcataagggcatgtgctatattacatgagttaatgtgcataaggcacacagaacagtgcctggcacataagtaagcacccaggctgtttgctctccttcttcagtgagctggtacctgtcaagtgtttgaaggctttctggctagcagtgagggtatatgtatccgccaggagggaagcaatcaggagacttcctggaggaggaggcctggcagaaaggatacagagccggcatcgctgacaacctgcagcaccacggtgatggaggtgcgggggtgcaacgtgcccagcaccaccgcctcgcacgtgttcctgatcagccgctcccggctcttctctgcaacacctggggaaattgaagagaggttcagggtcttccccttcatttgactcaccttcctccatacgcctcacccaaattcccagaaagggctcacggtctcagcctgggatggtgcagttacctgcagggatgatggaagattccagtgggaagaaggcaaggcctgactgccatccactgacccctgctacctccagcatccaccaagggaaccatccaagggaagaagacctgggagttccatgtctgtgctgctacccacgcccactcccaccctagcaggtccagtcagtggggactgagggatatgagggtaaaagggtggaaaaacaggttaatggtccaggcacagtggctcgcgcctgtaatcccaacactttggggggctgaggcgggcggatcacttgaggtcaggagatcaagaccatcctggccaacatggtgaaaccccatctctactaaaaaaatacaaaaaattagtgggcatggtggcacgtgcctgtaatcccagcgactcgggaggctgagccaggggaattgcttgaatctgggaggcagaggttgcagtgagctgagatcgtgccactgcactccagccggggtgacagagcgagacactgtctccaaaaaaaaaataaataaataaaaataaataaaagaaaaacaggttaatggaatgaatgagagtggaggcagagagagggagaaaagagggagggagaaattagaggcagagagagaagcaacagaagatgagttattaattagaggcggagagttaaagacagaaacagctgagtggagacccaagcggggagtggagactcggggcagctggtagggaggagctgggggggtgattttgacaaactgggcaccactcagaggttcagcagggcccaattaccaggcagcccaatcttcggcctcaggatcacttcgagtgtggccttgttgaaaatctctttgctgaccttcacctcggccggcccgtacacacccgccaggacagaggtgtcacctgaggagacagcagggagggcctcactcacagcttccctgctcctggggccccatttgtggcactgagcctgacggccagggctccccacgtcacccccgccatttgttggtactgattctttgagcactcacttcatttctctcatttgtaaaatggggaaaatagcagtccctccccgctagcgtcttgtgaggatcaaaggacacaattcacagaaaacacttagaacactgcggggctcacgctgaatgtgcaacagactttagctgtattagtaacattcgtccattcaggcattcaggcagggtctcactctcattgcccaggctggagtgcagtggtgccatcacggctcattgcagccttgaccttctgggctcaagtgatcctcccgcctcagcctcccaagtagctggaactacaggcatgtgccaccatgcctgactaatttttatatttttagtagagaggggattttgccatgttgctcaggcgggtttcgaactcctgggcaactgtaatcccaaggtgctaggattacaggcgtgagctaccacgcctggccctgatattagtaatttttttttttttaatgagatggagtcttgctctgtcgcccaggctggagtgcagtggcgtaatctcggctcaccgcaacctctgcctcccgggttcaagcagttctcctgcctcagcctactgagtagctgggattacaggcgcgcgccaccacacctggctaatttttttatttttagtagagactgggtttcaccatgttggtcaggctggtctcgaacttcctgacctcatgatctgcccgcctcccaaagcgctgggattacaggcgtgagccactgtgcccggctggtattagtaacttttaacaggaagttcttcctgaaagctaaccatcctccctcttactgcagctgctctcaacttctctttccaaagcttccccagcccagctcttcccttaggcactggcccccaaattttgcatcagtctggacacctgagaaagggataatatctggaatgaatcctgattccttatttccccagaagctatgaacggggtacaggaggtaaaacctaagaaataaacagcctggcttctagtactgtctgctgtaatcccagcactttgggaggctgaggtgggtggatcacctgaggtcaggagtttgagaccatcctagtcaacatggtgaaaccctatctctactaaagatacaaaaattagctgggcatagtggtgggtgcctgtaatctcagctacttgggaggccgacgcaggagaattgctggaaccggggaggcggaggttgcagtgagccgagatcacaccattgcactccagcctggacaataacagcaaggcttagtctcaataaaaaaaaaaaaatacattttaggccaggcatggtggctcacacctgtaatcccagcactatggaggcccaggtgggaggactgcttgaggccaggagtttgagaccagcctgagcagcataggaagactcctgtctctattttcttttttgggacagagtttccctctgtcacccaggaggctggagtgcagtggcgcaatctcagttcactgcaacctccgcctcccaggctcaagtgattcttgtacctcaacctccagagtagctgagattacaggtgcgtgctaccacatccgactaatttttgtatttttagtagagatgggttttcaccatgttggccaatctggtctcagaactcctgacctcaaccaagcgaggtggctcacgcctgtaatcccagcactgtgggaggctgaggcaggtggatcacagggtcaggagttcaagatcagcctggccaacatggtgaaaccccgtctctactaaaaaccacaaaaattagccgggcgcggtggcacgcacctgtggtcccagctactcaggaggctgaggcagaagaattgcttgaacccgggaggtggagggtgcagtgagccacgatcacttcactgcactccagcctgggcgacagggcgagactccatctcaaaaaaaaaaaaagaaaaaaaaaaaaagaactcctgacctcagaggcctcccaaagtgctgggattaccgctgtgagcaactgcacccggcctcttcttaattcttacgttcgaagaaactttaggtatctcaattcagcataagcgctaagcctgagggagggcctgggaaggtccttggttaaggccgtatttcctgggaagcccaatttgcccttacacggaaggtatgcttagttccaggagaaactgccctgaggactggagaagttaccaaaacagaacttgcctctggctccagatgaactgcctgtgttttgcccgagcacaagagtctctcccctctcaccttcttgaagacgtggctccagcaattctctcccctgttgaccccacaacaatctacaactcctgccccacttatctgatcctcttacagcagaactcctgaacagctgcctcttcttccttttctgtgaccccaccactccattgcggcagctcaacatcgtcaccactgacctccaaatgatcaaccctcccatgacccggctgtcagtaaggctgaaacagctggtcagccctcacatctcagacatgctcttttcttggccccaggtcaccaccatctcctggtttccccctaactctctgggcgttccttctgagtctcctttgctagcttgtcacatgtctctgactgctcaagttggaaggcctagggcttggtcctgggacctcttctcttttccatctacactcacttcgttcaggcaatagcctgaaataccatctatatagccagagagttccaaattgcctatgtccagcttgggtctctcttctgatttccagacttgtacagatctgggcagaaaccttagttatgcctgaatctttttcctcgcactcaaaccaaactatacgtaagttttgtccgtattactttcaaactacatccagaatctcatcacctccactactcctgctctggctggagccaccatcacctccctgttttcccccatactccccacaatcaacacagcagccaaattttgttaaaatgtattggggctgggcgtggtggctcatacctgtatgagcactttgggaggaggattgcttgagcccaggagttcaagaccaacctgggtgacatcgtgagacgctgtctcaattttttttttttttgagacagagtcttgctttgtcgctcacgctggagtacaatggcacgatctcggcccactgcaacttctgcctcccaggttcaagtgattgtcctgcctcagcctcccgagtagctgggattacaggcgcccgccaccatgcctggctagtttttgtatttttagtagagacagggtttcgccatgttggccaggctggtctcgaactcctgacctcaggtgagccacaggtcttggcctcccaaagtgtggggattacaggcgtgagccaccgcccccggcctcccgtctcaaacgttaaagagaaatattcttggagttaatctacttctgagagttatttagctaggaaaaggggatatttgctctataggtaagacttgccctaatcttttttttttttttttttttgacttgccctaatcttagggatatttacttgtgtggagagatgcagtgaggtagcggtggggatgtatttctcaacccagcgcaatgacattatcttcaatttgaggagtatttacgtgggtgaaagatccgccacagtccacagtatgcaaatagacaggtttgcttcagtccgggatgcaaggacctagagggtgtgtgtgtggggggtgggggtgggagggtggaggaggaatcgagttaagggggatatttaccctggcgaggtgattttccctattctgaaatatcaattcttgggcggacagtctgcccctcctctcattctcagagatagttacaaagatggaactatcttctcctttctagtcgtgagggagagatgtgtgtatccctgcgtatttagtagtattcaatcggacaagaaatcatgcatcaacgcaggagtgacatttaccagctggtatcgtgaggaggtgggcactcggttgcacagtacacggtagtccctctccaaaagaaagacctgggtgaagttcttaccttgcaggaaggaagcagagccatctggccgcgacagcaggttctgttcgcaggcaaagtgccggaggctgcagccaggaccccgagggctggaccctgttccattttcagcacggattttggcgtcagtatgcgtctcctcctccatcgcgccgagcccacgtgcggctgcagttgtcacttccgcctggcagcgcgcgccgcaaacaggctgcgtaaccagtgcgcacgcgccgggctgggccatcctcctgggcgtccgcacgtggcttagcgtttaccaacaatctggctccgcccagtcccacctcctaactctggcaacgccattggacatttgggaacagaaggcaggccttggcattgatccgctttactctgggcccccgggccctaaatccctgaggccctggtcaggttgccctcttctttgcctgttacaggagtaactacaatgaggcgattggagaaaattttgggtagatagatttttttttctccaaatctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctgtgagtacctgggccccaggcggttttcccaaaggggattagggatgtaaaggctatcttcagagtgtggggtccctgaaggatatgaaggaagggctgtcacaaaagggaaaaagagtgggagactccttggagaagacaccgaagggaagatctgccacttccttaggagacgaaaagaacttccacttctttaggagaggaaaaaacccgtttgcaacttctttgtgggccctgagggagacgacttgaagagagagatgggggttccttattagctgccactggtattcaggggaggctccttggaggaacaggggaagaccgcaagaccttctccctcagggtttggagaatgaaactgactttgtaagggagggactttcttctgggcaaagatccctcttcaagaagaagaaagaagagaacaggtccctgtcacaggctgcatagggccttgtatttctttgctcctttgccacaattctgattttaaaatgaattgtgtaaaaaatttgtttgattcctgtgtctcttgatcgaatatcaagacagagaattcgtgtgttctggacactgtacagaggagacgattaatatttgttgaattaatgaggggaaaaaaggagggagagaggtacagacagggcactttgcccacatttcttagaaacacttgagaaggctttgtttcttgtcaaaagggtcacaatcccttcaggtggatgctgctaagggcaagattacactgcaaaaaacctaggtggaagcctatctttagacggggagaggcaatgggttgcagaagagctttgaactacagttgacagataggagagtagtggttacatgggtggatgcatgtccttgctctgccgctttccacttgtgtagccttggccaacggactgcacttctctggatctatggagctaattttcctctctaaaatattaacagtggccacctcatagggctgtgaaaaatcaatatgtaaaatgctaaggactggacctggcacatcctaagggcaataggaatgttgatagtgagggtggagggaagggacagaaactaaccttggagatggggagaagaaaggggtgaccttgggaaggcctggattggtgaggccctggggaaaaaaatctgaaaagatattgtgaggttgagtctgatcctctgatccccaatccataaggaggggaagatggaatctgtagaaagaagctctgggtaggggaacaaacgggaggagggtgaagaagatgggccaggagtaggacgtagtaggtatctaggaacggagtcacttgaaacaggtaaatacagaagggctgcaggagcaaggtgtgggtagggcagtctcttgcctttgggctggagaccttttcacttttttttttttttttttttttgagcagttcatatcctccacagctgatctcagtcccaggggcccattggctgggcaagtggggcaggaggtgggcaggactggggcaggctagggaaaggtcatttatggctgattaaatctttctctcctgtctcaatctcttgattacctttcctcttgcttcccctacttcatttttggtggggagtggggagggaagaagtccctactttttatttatatatatttaaatttgtattatcttaagagttattgttttttcccctttatttctcccacctgttctttctctcttcttctttctttcctctccttctcctctcctctcctcccctctcctttttcttttcttttctttttccctttcctttcctttccttttctcttctcttttctctctctctttctttctgtacctctctttcctttttctttttttttcttttttgagacagagtttcactctctcgcctaggctggagtgcagcagcatgatcttgacttactgcaatctctgcctgccgagttcaagcaattctcctgcctcagcctccctagtagctgggattacaggcatgcactatcacgcctggctaatttttgtatttttggtagggacgaggtttcaccatgttgtccaggctggtctcgaacttctggcctcaagttccgcctgtcttggcctccaaaagcatgagccactgcgcctagccttttctttttttgagacaaggtctcactctgtcacccaggctggagtgagtgcagtggtgtgatcatggctcactgcagcctcaacctcctgggctcaagcaatccccccacctccacctcctaagtagctgggaccacaggcacgtgctactacgcctggctaatttttaatttttttttttttttttgagacggagtcttgctctgtcacccaagctggagtgcagtggcacgatctcggctcactgcaacctccacttcccaggttcaagtgattctcctgcctcagcctcccaaatagctgggactactggcgtgcgccaccatacccagttaatttttgtatttttagtagagatggggtttcaccatgttgaccaggctggtcttgaactcctgatctaaggtgatctgcccgcctcggcctcccaaagtgctgggattacaggcataagccactgtgcctggctgcgcctggctaatttttaaatctttgtagagatggggttttgccatgttttccaggctggtcttgaactcctggactcaagcgatcttcctgcctcagcctcccaaagtgcaggatgacaagcgtgagccaccttgcctggccatattattaaattatcatgagtttaagtttaagtagccacaagtgggctgggtgcggtggctcatgcctgtaatcccagcattttgagaggccaaggtgggcgggttgcctgaggccaggagttcaagaccagcctggccaacatggtgaaaccccatctctactaaaaatacaaaaaaattagctgggcgtaatggcgtgtgcctgtagtcccagctacttgggaggctgaggcagaagaatcgcttgaacctgggaggcggagattgcagtgagccgagatcgcaccactataccccagcctaggtgacagagcagccctctgtctcaaaataagatagccacaagtggttggtggctgccacattagatggtgcagggtttttgttttgttttgttttttgttttttcgaggtggagttttgctctcattgcctaggctggagtgcaatggcatgatcttggctcaccacaacctcctcttcctgggttcaagcgattctcctgcctcagcctcccgagtagctgggattacaggcatgcaccaccatgcctggctaattttgtatttttagtagagacagggtttctccatgttgatcaggctggtcttgaactcccgacctcaggcgacccacccacctcggcctcccagagtgctgggattacaggtgtgagccaccatgcctggctaagatgatgcagttttatccaggtggagatgaagaaatagtcagggaaaggttgagaggctgcatattgtagacagattggattactgggttcactggggaagattggattagaaggaggagtggggctgctttacttgtccccgacttcttgcccctgctctgcccactccttcattgaataccctgctgccctgcagatgtgtttgcctgattttcacctcccttcctgtctctgttatcatagcagacgttttagtgctcagggaaaggaggaggaaggaaactcagattgtcaaggaattgtgagtcagtttctcagccactaccccaggcctgggcttggctaagtcatttcacctctctgaccctagctagtggggtgaatagagtccctaccctgttggaagtcaggaagcccctggagctcgctctgtgctaattatcggtgactatttctgtgacccagctcttcaggggcagcctgtctgggggttccagtgccctgtgcagtatctccaagtggtaggtactcagtgtatgtattagtccgttttcaggctgctaataaaaacacacccaagactgggtaatttataaagaaaaagaggcttaatggactcacagttccacatggctggggaagcctcacaaacatggcggaaggcaaatgaggagcaaagtcacatcttacatggtggcaggcagacagagtgcttgcaggggaactcccctttataaaaccatcagatctcgtgagacttattcagtataatgagaacagcacgtgaaagatccacccccataattcaattacctcccactggctccttcccacaacatgtgggaattatgggagctataattcaagatgagatttgagtggggacagagacaaaccatgtcagtgtgtattgtgggatgaatggagatggtcattacagtcttctaagtgtatgggtccatctcttacttgctagtgtgttaagaaacctggcctcctttttcacatcttgaggcactgaatggtttacaaatccaactctaattttttattatatttaatacaccaatagtgcaaggcctttattggtagtactctcctattacagatggagagactgaggctcagagaggtgaggtctgaacttggagctctggactccaaaacccagtttcttttcatggtaccaggctgccaggaggagaaaggatggagcttagattcaagtcttgcaacattcttcttagtccagtattggcttattttgttttatatttttttgagacggagtcttgctctgttacccaggctggagtgcagtggcgtgatttctgctcactgcaacctctgcctcctgggttaagcgattgtcctgcctccccctctcgagtagctgggactacaggtgtgtgccaccgtgtccggctaatttttatatttttaatagagacagggttttgccatgttggccaggctggtctcgaactcctggcctcaactgatccacccacctcagcctcccaaagtgctggggttacaggcgtgagccaccatgtgtggccgggcaggtgatttttcttgtctttcgcctctttccacttcagtccccctggccatctttcccttccttgaatgtgcctcctcccacctggtggcctttgtaggtatgaggtccttcagatgatggctgacatgacacttcctcagagaagcgttccagaccccaaacaccaggtctctgtctgtgaaacagggacagtgatacctgcctaatctgcacgcctttcccttctcacgagatattctgggaagggggactcaactctttgctctgtttgagggcagagtgcctttgagctcaggagagagtgggtttgggtggccttagctaccctagatacggaggacttggagttaactggcaccatccacaaagccttgcatgcactggacctgaacaagttgcttagcccttgaggcggcgcctcagctaccacctgtctttgatggagttatgataacagtgcctgccccgtctggatgccttatgggttcagtgagcacataggtgtaaataaagtgctttgagtggcacctcagcatgtagttattctctgattgacctatagcagccatgccagtcttcagggtcccagggcgccaggctttcttctcttgccttggagccttggtttttccctaggactgaagtgttctgaccccttggctgaactcccccttctttaggaagctttccctggtgtgccatctgatgctggtgcttcctggaggggtactatctgatcctagctggtgaggcattcctgccagagctgcggcaggtgctttccccgcctctccaccagcctgtgaggtggatgccatccccacgagggcacgcaggttcacagagactggctcctgtccaaggccgcgtggctggaaagagacagaaccagattcaaacaccagcagtttaaccctagagaccctcatcctacctcctatgtgggtaaccactatacatcctgcctcctctgaaatctcccgtttttttttattttaaaattttatgtgagtatttacttatttatttgctgctgttgttattgttttgagacagagtcttgctctgttttcacccaggctggagtgcagtggtgcgatcttggctcactgcaacctctgcctcctcggctcaagcgattctcgtgcctcagtctcccgagtagctgggactacagacatgcaccaccatgcctggctaatttttgtgtctttagtagagatggggtttcgccatattggccaggctggtcttgaactcctggcttcgagtgaactgcctgccctggcctcccaaagtattgagattataagcataagccactgtgcccggccaaaattttatttatttatttatttttttgagatgtagtcttgctctgtcacccaggctggagtgcagtggcacaatctcggctcactgcaagctctgcctcccaggttgacgccattctcctgcctcagcctcccgagtagctgggactacaggcgcccgccaccacgcccggctaattttttgtatttttagtagagatagggtttcaccttattagccaggatggtctcgatctcccgacctcatgatccgcccgcctcggtctcccaaagtgctgggattacaggcgtgagccaccacgcccagcctaattttatttattaatttatttgagatggagtctcactctgtcacccaggctggagtgcagtggtgcgatcttggctcactgcaacctccacctcccaggttcaagcgattctcctgcctcagcctcctgagtagctgggactataggtgcgtgccaccacgcctggctaatttttgtatttttagtagagatggggtttcaccatcgtgatcagcctgacaggctggtcatgaactcctgaccttaagtgattcacctgcctcagcctcccaaatctgctgggattacaggcatgagccaccgcacccagccatattatttctgtattttcatttggcttacctgtcaacttgacacttttttgtttttttaggctagtcaggtgaagcaatgtgagtaagatcacctgtcttgattataacttgtgtgttcagtgtttgtcattcatccctccctgtctctagccttcagttcagggcatgatttggagcaaatgttcagtatctgtttaacaagaacaatcatgagaaatacttactcactacttgtgtttatgaaacattatgtgccaggcactgggctgagcaatccacacaggtcaactcggttaatcctcatgacaacccctgagataagtacttataccaccctcggtgtacacaggaggaaactgaggctcagggagtttttctttaaaaattttttcttttttttttccttgagacaggtcttactttgtcacccaggctggagtgcagtggtgtgatcttggctcactgcagcctcttgggctccagcgatcctcccacctcagcccctcaagtagttggggagtacaggtgtgcaccaccatgcccagctaattttttgtagggatggggtcttgccatgttatccaggctggtcttgaactcctgggctcaagcgatcctccctccttggcctcccaaagtgctggtattacaagtgtgaaccaccacacctggccttaaattttatttatatatttatttttgtagagacgaggtctcactatgtttcccaggctggcctcgaactcctggactcaagtgatcctcttgcctcagcctccagagtagctagaattacaggcgtctgccactgcacttggctcagggagtttaagtcacataatcaggcagcggtctgctcagttagagtccatgcgcttagccatggtgccttcaagtgactccaccagggtcaccccagtacttcctgggcagaccagaccatccagagcgggcaggttgtgctttcctgcatggtgggagaggacgtggcatgaagctttgtgtaaatctgtgcagcctctgccattgtaaatcactggccaccgggacagactcccccacccccttccaaaaactagaggaacagatgggtggagtcgcatccttcctctgcaggcatttggccacccactcccattatggagcatttcctcaggaccaggcacagcgtggagccctttgcatagctcactgaattggggcagcaaccctggggctggggactaccattatctccaccagcccagcaaagaggggaggagggtacagccgagacccagctgcagtatgtggagcacactggggtgccgtgaagatagctgtccagcctctagaggctgacagtcctgccctgacacagtggtttgttctcagactctggcctcccctcttagtgcccgtctgaagacttcagccttcggtcctcttccatcagcatgccgtctcccctgtgcctcagtctccctctctggagtatctgctggggccacagtttggttttattgttctttgagacagggtatcactttgttgcccaggctggagtgcaatggtgcagtcatggctcactgcagccttgacctcctgggctcaagccatcctctcacctcagcctcccgcaactccagtatctggactacatgtaaatgccaccattcccagctaatttttttttttttttttagatagagtctcactcttgtcacccaggctggagtgcaatggtgccatcttggctcactgcaacatccgcctcccaggttcaagccattctcctgcctcagcctcccaagtagctgggattacaggcacctaccatcatgcacggctgttttttgtatttttagtagagacagggtttcactatgttggccaggctggtcttgaactcctgacctcaggtgatctgcctgcctcggactcccaaagtgctgggattacaggcgtgagccaccacgcccagccttcctggctaatttaaaaatttttcagagacgagggttttgcctaggctggactcactatgttgcctaggctgatctcgaaccactggccttaagtgatcctcccacctcagcctcccaaagtactgggattacaggcatgagccgctgcacatcgccacagtttgattttagtatccactttaaggtgcagttagttcttcccagctcctcttttccctatctcatacagtgtagtcacttccctttctcccacttctcaccttcctagattttgtttttctctctcttaccaagttttgagtatgtaatacgtcccagatcggtgctgaacccctggtgtgagttaacttagcaacttttcacgtggtgttctgcagccttcttacagataaggaaattcagagaggtgaagtgtttttgcagagagccacacaatgagctaagaaattagaacccagggcagttgaactccagagccagggaacttaacagcccattcatgcattcactcaggaattccctcttgagtgcctgctgtgaaggcaacctggacgctgtctctgccttcctgggattgtggtgtgtgtgggagacagacacgaaacaaagcaatcttctaggtcagtgtctggctatgctgggtactcagaagggggaagcactgtgctgcaagaggccggctgtttcctcctcacaaggggaggcctgcagtgacattgccaggcctgaatctgccctgccattgggagtgtaatttcctcacgactacaaatgcaaataaatacacacactgaacatgctaccccgctagaactgtggacagcttgttcactgcagttaaaggaagacggagggacacatttgagcacgcatgtgtgagatccagcttgtggcaaaccctgccattctttaacatctgtgggaagtgaagccaccattactgacctcggaggaatcccgggagtagtgggaagaaaagttgcagatgtttgaaaatcaggctgcaggggcagttggggtgaggagcatggatgtctaggagcctgaatctcagcgttggaagcccagttctgatgtaatttttttttttttttttttttttgagacagggtctcactttgtcccccaggctggagtgcagtggcacagtctcagctcactacagcctcatccttccaggttcaagcagtcctcctgcctcagcctcccaagtagctgggaccacaggcatgtgtcaccatgcctttctaatgtttgtatttttttgtggagacagggtttctcactgttgcccaggctggtctcaaactcctgagctcatgtgatcctcctgccttggccttccaaagtgctaggattacaggcgtaagccactgcccagcatccccacctttttttttttttttttaaatttgtggtttggtgcaggttattttacctccccaggcctcggtttcctcatctactcaagggcaatggcagataatcaacctcacaaattccccgaggagttagtaggcttgtgcctgccaggctcagctggcttacagcaggtgcttcataagggggagctattgcaacgcctcggctggttctaggctgcctagctccagagctaagagtcccagtgggttcatatccctttgagcatttataggcttctcacaggtctcctgggctttctcagccattcctcatctgacctgaggaggtgtgatgtccttgcaggactcctccagcccctctgagcttttttttttgtttgagacagcatgttgctctgttgcccaggctggagtgcagtggtgtgatcatggcttactgcagcctccacctcctggggtcaagcgattctcccacctcagccttccaagtagctgggactataggtgtatgttaccatgcttgagtaatttttaaaattttttgtagagatgtgatctcaggctggtcttgaactcctgggctcacctgggctcaagtaatccttgagcccaaagtgttgggattacagatatgagccaccttgccaggccctgagctccttctgtcttccatgaaggacacactattccttgccttttgtctttttttgtgtgtgtggcagggtctctgttgcccaggctgggatgtgttggtgcaatctgggcttattgcaacctccgcttcccggattcaagtgattctcctgcctcagcctcttgagtagctgggattacaggtgtgcgcaaccacgcccagctaatttttgtatttttggtagacatggggtttcaccatgttggccaggctggtctcagcctcccgaagtgttgggattacaggcataagccactgtgcctggccactttttgtcttttgcatgttctatacaccttgccgagaatgtgctttccctgcctcctggttatccctcaggtttcagctctaacatcacttccccagggaagccttaccctcgctttcttctgctataggataatatgaaccaccatcattgttacttgtttagtgtctgccctccctgctaggcagcaaggacagatatcttgcctgtcttaggtccccagaacccagcacagggcttggaacatgtcaggtgctcaaatatttgttgaatgagtcagtctgggctcgcagagggagctgggaccagagtagagtggacactgaagcgtatgtagcagtttgccaggcgatagggaaagagaccttcttgtaaagcaagcagagatgagagggagaaatgagaattgctaagattgttttgagcatttgttaggtggcttacagatgctttgctgaacattttattcatgtgatcttgtttaagcctctcatttccatgaggggttctccatttttatagacaaggaaggggacacgtggagaggggaagttactttgccatatcaccctctaagggatttttttttttttttttttttttgagatggagtctcactgtcaccaggctagagtgctatggcgcaatctcggctcactgcaacccccacctcccgggttcaagtgattctcttgcctcagcctcctgagtagctgggactacaggcatgtgccaccacatccggctaatttttctatttttagtgggtacagggtttcgccatgttggccacattgatctcgaactcctgacctcaagtgagattcgcctgcctctgcctcctaaaggcagtaagggaattgaacctaggcagtctgactcttaagagctcaaagacttaagctctgtcctgagtagcttcgctggtgtatggtatagggatcagaagagagctggtctgtatgcctagagggcatcctgcagtgggcatgtgtgtctgtggtcacagtgggagagagagaggagggggcatctgtggccagaatggggaggcctcgaatgccaggatgaagagtttgggcctatggtaatgagaatagtaatagctaccagttattgacttgccagccacttgattgagtcatttaacctcacaacagtcctatgggataggtgttaactgttttcatcccagtttttcagatggggaaactgagacacagaagttgtagtcagttatccaaagtgtcgcagtgagaaagtgctggagttggggctcagaccctgtgagtcaggccccagagttcactggggccacatgctcaaccaccatgccgcctgcctgccgccggggctgagccagcggaaacctgggtgctgcttctgatgcaggtggtctcctctgctctcttccccagcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatgagtctcagcggcaggtgcgtggggacaggactaggggcggggggctggaattacctgaggtcccctacctgtgtttgggccaaaggaatggctcccaaggaggacagattcttttttgggggggttccatagagttctgagggttctcttgggactctggaggagaagtgtgagagcagtcctgccttagggcagaaggatggacctgatcactaaaaaacacctactgtgtgcctggctgggggctcgcctgtgtggggagagggcagggagaaggcctgacagcccttcctcttggaaatgcacagtcctgagaaacagggtgggtccccagtgcttcctggagtgctccaggggaccgccctaggcccatgtgaaatgggctgtgatcccctgataaatcctagtatcagggacaaggatccagtcaagccagtgtcaacaaagagggaagttattgactccaatgaccatacatccagagggtcctgttttggggcacagctagatccagggggtcttccaggcaggaagtagagggaaggcggaaggccagacatggcacatcccagctatcccacacccccacctttatagagctttctgggtagtcccacctagtgacatctgcatacatttcctgggccactcctagctgcaggggagactgagaaatgtattaataatactttagtcccggcagttgctgcctgcgggagattgagacctctgttaacagaggaggggaatagtatactgggaaggcaaccaggagcctctgccagtagccccgagtcctgatcctcagggggctggttgcaggctcttacccacgctaacctggacagtcctgccaggccctcagtactcagcaccgcccactcacttggcactggaatgtgcattaacttttaattggctccccacttagaagaaagcacacattcatcagtttcccccacagcaacgggaaagccaggcctgggaacacatggaggagggcaccgccgagccgcgaggagctctggccccggggtgtccctcagggtgctggccaggctgcctttgttccgctttacacatggccctgtgtgatctcatgtccatccgtatgccagggctgcccagagccccagccagactgcttgtcagagccctgcttggcttctcgccctggatgtcccacagcaaactaatcctgtctgaacttgacctcgacatcttcctcccaggcgtgctcctttgcctcacctagtccgtttctcagtgaagagcaccaccatccacctgcttgcccacaccagaaacctcatctcatccctgtctcctccctcccccttgctatccctttctcccctctcattccctctgtctgtagatatttcttttttttttttttttttacttttgagatggagttttgctcttgttgcccaggctggagtgcaatggcacgatcttggctcaccgcctccctggttcaagcgattctcctgcctcagcctcccgagtagctgggattacaggcatgcgccaccacacctggctaattttgtatttttagtagagatggggtttctccatgttggtcagtctggtctcgaactccctacctcaggtgatctgcctgccttggcctcccaaaatggtaggattataggtgtgagccactgcacccagctgtagctacttcttttcttttatgttatttttatttatttatttagagacggagtccacctctgtcgcccaggctggagtgcagtggcgcaatctcggctcactgcaacctccgcctcccaggttcaagtgattctcctgccttagccccccaagtagctgggattacaggcgcccaccaccacactcggctaatttttgtatttttagtagagatggggtttcaccacattggccaggctagtctggaactcctgacctcaagtgatccgcctgccttggcctcccaaagtaccgggattacaggtgtgagccaccgtgcctagcctgtctgtagatacatctttaggaagtgctcagctgctcagcagcacactctgagacccagccccatcctttctctgcttcactgttgttggtgagttgaccttcgtgctctgcttgtggcctcgtgttcacagcatggctgctgcatgtccaagcttcatggctgtctgcaaggcaggaagaagtagggagtgggtagggctggcaccagcagcagtggtctcttctatccagaaagcaaaagcagacttccaccaaaatatctggctaaaactgtgtcccatggccacctctggctgcaagggaggccagggacctgagtgcgtgtctttttgaggctcaggttaggggatttgggagaagggaactgggcactggtgtggccagctgacagggtctgctgccccctagcacagccgactcagcttcctcagacacatccacctgctcctctcccgcctccctctgctaccaagctgggcctctgccccctctctcctggcttgctgcaatcagccttgatgactccatccatttacctcactgcagcctgagagcaattctaaaacacaggtctgaccacattgctcccttgagaagactgtcggcaggttaccactattctcagagtaaaatcaatgtatcgttccctttgttatctgggtgccatctcctctccctcctcatctttccccacccctaccactgtatgtcccagcccttctggcctcatggtctatcattccctctgcctggaaccctccacccaccccatctttgcgcactggtcctcaccgatgcccttccgtggtggaacaggtgcttcctttgggcttctatcacagcaactcgatccctctggcagttctaagcagtctggcagcgtcttcttaaaggcaggaaccccagcatggcctggcccaggactggccttcaggaggactgtgaattcatggaggtgttggaagctgggcaggatttggatggctctctgtcattgcccagcataaccaattgtgggaccccggtcccctctacacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagacaagccagggttaggactctggagggggcagtcttcccactctgaaggccagaaagtgtagtggctcagggtctgtgctcttaaccctttgttaccagttgtcaggttttgggcaagtcacttcccttctctgagcctcagttttctaatctccagaagagggattatgacggtacctgcatccaagggtcgctgggaggatgcagtgaagtcaacgttcgctgtgggtgtggcctgtgcaggagaccctgtctgcctggtgcagtgatcccctggcccctcctcaggtgctgtatccttcggggagcaggagcaggtggaagaaccttgacagacctgagtgcggtgcaagattagaggggcccggcaagcccagatgagtgaaaggaaggaagggtcaaagaccaggaatgaagaaaatcattgagcaggaatgagtgcctgggagcgaaggagtgagcccagggagcagtgagtggggtcttccagggagcttgttggtgtggggccctgcatggggactaccctcagagtgtcagcgagcactgatagggccaggaaggcatatcttaaccctttgtcttagatgcttggggcaagttgcttaactgccctgtgcctctgtttcctcattcgtaagggggatggtagcccttcccaagacagctgttgagggcagtcttggggcagttggcaaagtgccctcagcacagagtaagcgctcagggccaggggttggtgtcatgatcggggactcgccctgggacagcccttcagcagggccagaccacgtggctgtccagagcccccatggaccagcatggcttgcagcctgctcctggactgtctactgctcacagctggaccaggcccttggccccacatgctctaggagggcaaacgccctgtggtgtttgtctaaggtctagtgtcatccgtgcggaaaaagatttccagacaccaggcagcaagctgggcccccgccagctgtgctgagcactgcacctgtttttgctgaagggttctcttgtgagggcaccaggcaggaccgagcaagcctcatgggaatcatgggagccgctgagctctccacatgggagagctggccgcctctgcaagaatgactgtccagcactgagggtcagcagaagtgtctgggcagctgcaaatgggactcatgcagaggcagcatggtgcagggtaaggagttgagtcacatccactctagacttcacttggcaggccactcaccttggtgacgctgtctgtcgtctgtgaagtgagaagagtggtgttcatcatgataggtagtgcctccctgggctcttgacaccagagtgctgttctttttttcttctccttttttttttttgagatggaatctcgctctgttgcccaggctggagtgcagtggcgcgatctcggctcactgcaagctccacctcctgggttcacgccattctcctgcttcagcctcccgagtagctgggactacaggcgcccaccaccatgcctggctaattttttgtatttttagtagaggcgggtttcaccatgttagccaggatggtcttgatctcctgaccttgcgatccgccctcctccacctcctaaagtgctgggattacaggcgtgagccaccatgcctggcctttttttttttttttgaggtggagtctcactctgtcgcccaggctggagtacggtggcgcagtcttggctcattgcaacttctgccttccaggttcaggtgattctcctgcctcagactccggagtagctggaattaaaggcatgcaccaccatgcctggctaatttttgtatttttagtagagatggggtttcaccacgttggtcaggctggtttcaaactcctgacctcaagtgattcgtttgccttggcctcccaaagtgctggggattacaggcatgagccaccgcgccgggccagccaaggtgctgttatatgtgctctttagcctcggagactgtcatttcccctcactgcactgcagagcgagggcacaccgggtgaggttagggcaggccccagtggtgttgcctcattgaggcacctcccccatccatgtgaggcaggagaggcaagcattaccatcaactctaaaagccaggtaagaacctgagtcaacaaaggtgaggtcatgggcccaggccacattctcctaaggagtggagccgagtctttttatggcagtctgacccagagacagctctcgctgtttcccacccttggctgtcttcccagggctatatgtggagtatcagtggtggcactggcagggagtggcgcccggtgaaaaggagtgttaagaggaagcacgtgccaggtgtggtggctcacgcctgtaatcccagcacttcgggaggctgaggcgggaggattgcttgagcccaggagtttgataccagcctgggcaacatggcgagacccccatctctaaaaaattaaaaaattagccaggcgtggtggtgcacacctgtagtcccagctactcaggaagctgagtgggaggattgcttgagcccagaggttcaagactgcagtgagctatgattccaccaccgaactccagtttgggtgacagagtaagatcctgtctctgagaccaacaagaaaagaggtagcatgtgtcaagcaagagcagcagttcccactggacctggagtttcctggtgcaaatcagcctgtgagtctgtattttcttttttcttcaagacggggtcttactctgtcacccaggttgaagtgcagtggcatgatctcggctcactgcaacctctgcctcttaggatcaagtgatcctcccacctcagccccctgaatagctgggaccacaggtgcacgccaccacacctggctaattttttttttgatttttggtagagacggggtttcgctgtgttgcccaggctggtctcaaactcctgagctcaagcagtccacctgcctcacccttccaaagtgctgggattacaggcacgagccactgagcctgacaagtttgtacttttagcacgttcccctgcccctgcccagtccttctcacatgggtggacctagtaccacattctgagaaagcctgattccaaggtcctgtatcagtcccttggaccttctttgaccctctacaagacctttctttccctccttaaccagagcaactcctgtttctatctgttacatatgcagcacagccacatcttgtgtggatttgtattatgtccattcaaaagcatgtgtcagaaaataccagtaaacctgtattaaagttggatgttgaagtagtgctaaccaccctcaactctaactaaaatatcaacaagtgggctgggcgtggtggctcacacctgtaattgcagcactttgggaggctgaggtgggtggatcacctgaggtcgggagtttgagaccagcctgaccaacatggagaaaccccgtctctcctgaaaatgcaaaaattagctggatgtggtggcacatgcctgtaatcccagctactcaggaggctgaggcaggagaatcgcttgaacccaggaggcagaggttgcagtgagccaagattgcgccattgcattctgggcaacaagagcaaaactccgtctcaaaaaaaaaaaaagaaagaaaattaggtagatctagtggtgcacacctggaatcccagctatctgggaggctgaggcataagaattgcttgaacctggaaggtggaggttgcagtgagctcagattgcgccactgcactccagcctgggtggccaagccagactctgtctcaaaaaaaaaaaaaaaaaaaaaaaaaggtaactgctgtgtgtaatgtgatctccattaaatttgtatctaaagagcgggttctgcggtaaagaaaggatttggaaagcactgtactagagagctccctctgaataatgttcccggtctgagtgcttgcagcattgatccacagcgctgcccctaaagtgttggtgtgaaggttgtcccactcttcaggcggggcaaagagcttgtctgagggcaatcacaaacccccttctgtcttctaacttcggaggaagggcccccttaacctggagcggttccctttgatggggaggtgggtgttcaccagaggttttgtttgaagaaaaggttttactgccatacatgggttagagtacttctgtagtccagaagttgtaaattagtggtctatgctgttatttggttcataatgatgattttttttttttttcgagacagggtcttgctttgtagcccagattggagtgcagtggcacgatctcagctgcctgcagccttgaacttctgggctgaagcaatcctctgcctcagcctcccaagtagctggaaccacaggcacacatcaccatgcctggctaatgttttgatttttttttttttttgtagaagcgaggcctcaccatgttgctcaggctggtctccaactcctgggctcaagcgatcctccaacgtcagcctctcaaagtgctgggattacaggcatgaaccaccatgcctggccatagtaatgatttatggttagaatatttcttaaaggtaattgaattagttgaaagcacttaaataccagacaatatctcactaagagaaagaaagaaaaaggctagatttctgctttcttttgaaaaatcagattggccttgctgggcagagtcagtcagtctgaacatcagtcttcctcttaaaacaagcctgagctttcctgtctgcctgccagcatgctgcaggtcacccacagggctgaactgtccccctgtactgcccactcggctaaccattgcctcctcccctcctaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctgggtggaattctgggttggtgacaccactagagccctggtctgtgctccagacttcttcttcttatttttttcttttttgagacggagtcttgcactgttgcccaggctagagtgcagtggtgctatcgcagctcactgcagcctccttctcccagcttcaagcaattctcctgcctcagcctcccgattagctgagactacaggtgtgcaccaccacgcccagctaatttttgtatttttaatagagacagggtttcaccgtgttggccaggctggtctcaaactcccggcctcaggtgatccacccgcctcagcctctcaaagtgctgggattacaggcgtttaagccattgtgcccagcccactttttttttttttttttttttttttttttttttggtctgagacggggtttcactctcgtcagccaggttggagtgcaatggtgcaatctcggctcactgtaacctccacctcccaggctcaagtgattctcctgccttagcctcctgagtagctgggattatgggcatatgccattgtgcttggctaaatttttgtattttttgtagagataaggtttcaccattttggccaggctggtcttgaacctgagttcaagtgatctgcccaccttggcctctcaaagtgctgggattacagatgtgagccactgcacctggcctgtgttccagactttgaatgcacctcttgtctgggacccttcagaagagggctctgttgctgtccccaccccattcaggggcctgaagcctgtgtgaccacactctggatttcccaaccacatgcctactgcatttgtctgctcacaaacatagccaacgtgtgcaccaggttccactgtgccaatgcttcacgttcatcatctaataaggaccctcattgtggccatggggacagaggttattatttgctcttgttcctgttttcaagagcaggatgcccgtgttttgtgtgtgtgtgagagacagcaagtgaatgggaaaaaaaaaagtgcaggagcctggccaacatggcaaagccctgtccctactaaacatacaaaaattagcttggcatggtggtgcacacctgtaatcctagctactcaggaggctgaagcaggaggattgcttgaacctgggaggcagagtttgcagtgagctgagatcgtgccattgcactctagccaaagtgagatcctgtctcaaaaaaaaaaaaaaggaaattgaagtcaaagagggaagtcactcgctaacggtcatgtggcacagagggagaggagcagggactcaagtcattgactgtgtacctccagagcctgggttcttggccctgacctttgtctgcctcagtcctcagagtcaagtaagcttccccaaagcttaccgtaggtgccctgaagtcccttcccttataagagcttttttgggaagcaaacccactgggtgccaggcctgcaccctcatagtgtggagaacaaggaatcggagccccttcctgtcctccggggcctgtagcctgatctagggttggtctgggccctggcttctttgccctagggcagctgagatgcatgagtttgtgtctctccaggcctcagcactgtgcccagcacagcaggaggctccacaccccttagctcatagtgttcttttgttgaggaacaagaagcagtttgagcctcttaggtgggaggtgggcagggaagctttctcagaggagggggcatttagggggcatttgagctaaaggtaatagggtttccacaaggctggggcgtggccctaaccttccctctgggtccctgctaagtcacttcaaatacacgaagttcctgccatgtgccggtgccactccaagtgcagggaacaaaagcaacgcaaacctcagccctcctggtgctgccattgtggtgggggagacggacagtaacagagatggagagggaactcctggagtatatgagggtgggggtcctgtagggagcagccaagccagccgggtgtggtgcactgtaggggtggctggggtccgtcactggagtgacactgaagtatggaccagaggatgtgaggggggagctgtgtggtgtcttgaggcaggtgtgagcctggcgtgtttgaggagctgggaggagcccagaggggcaggtgtggagtgagcaggtgtggagtgagcgggtgtagggtgagcaggtgtggggtggttggaggtaaagtccaggaggtggtgggtgggggtgcagatggtgcaggttgggtggggcctcaaggcctttgcctgttgcagggatgtcgacttttactcaaagtgggacaggagccgtgggtggggaggagtctgctcttccttggcctggctcacctcttcatggaatccgcgggctgccctgtggataagggattgggcagtgtgtgaagggctagtaaggaggctgctcagtaacttgggcttgaccagggtggtgcagaggaggaggtaagaggggttaggttctgaaggtggagtagatgtggagaatggcgggaagtttggcttggagatgatactggactcttcagcctgagcagttggaagggtggagttgctttcagctgagcaagaggagacctgggtgggcagatgctggggggcatcaggagctgaggtgtttcctttccccttgaagcctggtgactgctggcctgagccacgcttgagccgtgggtcatgtgagtgtgaatgagtgtgagtgcatgtgagtctccgcccctgctcaccaccctctcatcccctgcagcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattggtatgggctctgctggctgctccccaccccgctgggatcatctccttccctccccaatcctgccaccttcctgccacccctaccctccttcctggttctcgtcctgtgtcctgtggcgtctggcacttggtcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggtgcctgccgctccccccgtcagcacccccacagcactgacagccaccgtagcatcttcctcatatcgatcactgtctccaaaacatggccttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagcttgggaaggatttgtggaacaccgaactgggaggctcagggataaccccagtgatgtctcagatgtggcctgtggagccaggctgctggggccatgtgtgtcctggctctgtgtccttggcatgttgccctccacttccttgtctttgaaaggggatgctggtggtgcccatttcagaaactggtttgagactgggcatggtggctcacacctgtaatcccagcactttgggaggccgaggtggcagatcacttgaggtcaggagcttgagaacagcctggccaaacatggtcaagccctgtctctactaaaaatacaaaaattagggctgggcgcagtggctcacgcctgtaatcccagcactttgggaggccaaggcggacagatcacctgaggtcgggagtttgagaccagcctggccaacatggtgaaacctcgtctctaataaaaatacaaaaattagccgggcatggtgccgggtgcctgtaatcccagctacttgggaggccgaggcaggagaattgcttgaacctgggaggtagaggttgcagtgagctgagatcgtaccattgcactccagcctgggcaacgagagcaagactccatctcaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctggtttgaggattaggtggcaaaccgtggtggagtgtacatgccctgcccagagtcagtgtgccaccctccctggcccggtcattaggacccagggcccgtgcagcccagtggtgagggcagcacccggcatagggcagcaccgtgtgtcctgtccctgcccttctctgtgcctcagtttcctcattgcttagctgtctacctcttagggctgctgaaagccttaaatgattccacacacttggatagcacctgatccctgctgggatttgagggttttcattacacttctgctaggataatcatttccattgtcgaggtgggaacacaaaggcttggagtggttaattccttgccaaggccccgcaggaggaagcagggtcctgcatgggaggccggctagcctgcccactgccccatgtccccacaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaccacctctggtctttgtttcctggagtttgggggtgatttgaggccacccccagcttctccaccttagataaataaggtcaaggctcttgagatacctacttcccccggaagcttgcgcaagctggaaggttaacttcagcagacaggatgggggtgggggggtcctccagagatggtctcctgctctctcacagaatgggagaagcctgctgtccagcagagtgatggggagcccagtggagctagccctgcccagcaggggtgcaggggagcgtccaggatgaaggtcagggtgtggccaagccctgctccccaccactccagggccccacagatgcaaaaacaaccccaggcctcagagtggggagtgcatgtttttcaaaaacaaaaagtaggcaaaaacagtccaccaccccatctttcctgcccaggcccctggctgggggaggccaaggagtggcttaagttgtccagcttctgggccctcctccctcccatcaagacctggaaggaggggctgagccaggggccggccccagaggcccaggccaggtcagcacctccgccctccccaatgagagtcagcactggagccttgggtcttgcagttgtttccagagccgaatgctggcctgggggcccaggggccgtaccagcagcaggttgcggaaagcacagtggtccgcagtgcggtctgctggccaggctgtgaggaagcctgggtgggcctggggcaccaggcccagggctcggatgcaaaggccagtgtagacgtcctcaaaggggaagggtgccacacgggctgccgcccgcagcagccagggtgccaggcgcccggcaatgacgtagccacccccgcttgcataggctgggtagccaccttcgaagaaggactcgggcacatagaagggtcctcctggcttccggagaggcatggcctgggtaaagacctcacccaggtagaggcttcgggccgaggcaggtggcagggcccgcaggtgagccagcagggcaggggtgtgtacaaaggcatcgtcctgagctcgcaagacaaaactcacggtggggcagtggcggcccagccaggccagcagcagcaggtctttgagcgtctggttgaatgggacgtcgaggaagtcccagagcagcaggtcactgtagcgacggctctcccaggccactagtgagtctaggtcaggccccgcctcacccaccggagaccctagcaggaagagcagccggatccctggagctggactgccccacgtctctctcacggcctgtcgttctgcaaagcgccctggttctgacttgacggccaacagcaggtaggggacatcagtatctgagcagctggagacttggctgccaccacctccaggcagccactgtgggaagctccggcaggctgctgacagcaagaagcggcggaggtccttggggtaggaggcgaagtcagggatctcggtggcggcggcggccccccaagcctggcagccccccgtttcagtgctgtccccactgggcagggaccccagccgccactgctgctggttccagtaagcaaagggcagcgggatagtctggcccaggcgggtggagaggttggcaggtagggtgggctcagggttggctggcgtggggcttggcggggtgccccgagggctggggtaggccttgctgagccgggactcggatgtccactcgatgtacactttgaggcccaggagtgtgagcagtgctgacaggcagagaaggcacttggggcagcgcatgacccggcccagggaaggggcggccgcgggagctacaagggagccacaggggagccacggaggccattggggtgtggggatgggcctccagagagggcccagccaggccccaggcagacagcttcacaatctcccatagtccccgccaacccccataacagattctctcggtcccagatcctaaacagctcccctgacccagggacctcgttggtccttattcctagacctaggagtcccccattccaatcccgtaccagcaccctgttcttcccactccgtccaaatgcttccaccttcctaaaagcccaagggtctacctcttccctgtctccatccaggacaagggaccttgccgtctatctcctccctctccctccatttattgccctcaccaggaaatcaggagcgggattcctagctccctggggttagaaacccagcctgcctcccgcaacaccccaaccccagggactggggaaccagggatcccatgcttttttacctctgggtctggctcccgccagctccgggtgccggcctcaggtcaggcctccctcagctccctctgatctgcctgccccagcccctgtgttgtcgaccggcggggcccagccctgcccagccagtccagaggggcggggaggggagtggagcgggagcagggagggccccaggggccggggcggggctgaggcaggagagagggagggagggagggagggaggagggcaggaggccgacctgagagatggggctctggcgtgttagggctggtttctggtgagacagctgggaagggtgcagggggcagccacagaaacaagacgggggctttgtgaggcctgggaggggagaaccagggccagggggtgccagggagggtggggctgaaggctgggcctgggctggggagtgttagagtgaccagggcgaggcagggtcccactgaggcagagatggggaggctgagaggctggcgcccggctgcacccatggccaggaggcggcagtgaatgtgctgagtgggaagggatcggcgggcctgccagagggatgtttgttgttgctgcccagtcagggtgaggtggggggaacggggctggtgaggagaaggagagacagagacattgtggagagggaagagacggccagggagcagagagaggagaactggggtgagacaggcgatggagagagctgagggggagagagagagaagacgggcaagtgggaaggtggccaggagggagagggggagggaaatggagatggcgagaaagataaggggttgcggaagccctgtggggtgctcatggggaaagagaggttgagagaggcaggtggagggcagaggggagggactcaggcttccgagccagacccaggcagaggcggagagggagccaaggggaagaacaggagaggaaaagactggagcttcaagggcaatagagggtgacggggtggggcccacggggaaccccgggagctaagctgatcccctgtacctcctccatccctctcggcacccgggctgcctgcccagcagcgtgggaatctgttcctaccttacccccaacctccggcctggagccagcctcaccccgggcccctcccctcccccagcggcactgtgactccaggaacactcacatccagccccttggggcaggagggggtgtctgcctgtgtttgcatccctgccctccaggggcccctgctgttgggactgcatcagctctctgaagacctcccaagacatggggtaagactaaggggctcccactaagcctgggctgaccccttcactccaccctggtttggggcaggcctgtccccatcatggcaggaacacagtctgtcagcagcagcagttgatgatctgtccagccctgatttcctcccccaaagtttgaataatggagcctgtgggaacagctggaggaagagagtggggaggaagtggtgaatattaatggaataatagttggagtgggaaatgacagctaggggctgggggcaggggcccgagcacctcctgagggagtctgcaagcccactccactctggggctgggggagagggactccaggccccctgagctcatctagcttctgggggcagggggtgctgctcctcctggaagcattaggaagcttcacaaggtgcctttctttttgcctttgccatgtgcctcagtccgggtccaatcaggagagagaaaccacacaggaatgggaatagggaaagttcaatatacagaatgattaactctcatgggattggccactaaggggtgccttcttggggaacatggttggagggtggacatgctggtggaacacgatcattccaatccaacacttctgtctccccaagccttgggactcccctcacccatcttatgctagggcagttctggtctctctgcctcattaactttaggccactgttggatccaagttccggttaggcacccaagcaagctattagaactacgtccagctgcacaaggtaacccatgaaatccagaagctctagaaagcgcactcatgccagtaaatttggcctgagctagtgttacatccaccctcattggtgtaacatccttaaaatccccttctgcacacattccccaagtttctgactctgtatatttgcgaagccttgtcattcttatagtgtaaaagctgctcccgcctaggtcctagctggcacctgttcacctggagcaagctgatttcaccctaggtatttatgggtctagaggcagcaaggggcgctgtggtgagtcttaagaagaatggggtgtatctgttatttctgtataagagctggccataagaaaaaaaaaactgtggtgggacagtggctcacccctgtaatcccaatactctgggaggccaagagggaaggatcactttccaggagttcaagaccagcctgggcaacatagtgagatcttaccgctaatcaaaaaaaaaaaaaaaaaaaaaaggacgaccactttcaaggtgtctgcccctggtgaggtcatcacaaggttttttttttgagacggagtctcactctgtcacccaggttggagtgcagtggcatgatctccgctcactgcaagcctcacctcccaggttcacgccattctcctgcctcagcctctcaagtagctgggactacagacgcccgccaccatgcccggctaatgtttttgtatttttagtagagacagggtttcactatttctactaaagtagagtacttaggcaggatggtcttcatctcctgaccttgtgatccacccgcctcggcctcccaaagtgctgggattacaggcatgaggcactgcacccggcctctgtttttttttttgagatggagtcttgcactgtcgccaaggctggtgtgcagtggtgcaatctcggctcactgcaacctctccgcctcctgggttcaagagatcctcctactcgggagggttcagccttccgagtaactaggattacaggtgctcgccaccacgcctggctaattttttgcatttttagtagagatggggttttactatgttggccaggctggttttgaactcctgacctcatgatccgcctgccttggcctcccaaagtgctgggattacaggcgtgagccaccgtgcctggccacatcacaaggtttctaagcacaggaaggctggtaggttcctcagatgctgataagtcactcgcttggagtgacttgggggttcaagatcgcctgtttactctgggtccaattagatgaccccattccaaagaagtaaaaacttttgggccgggcatggtggctcacacctgtaatcccagcactttgggaggctgaggtgggtggatcacctgaggccaggagtttgagaccagcatggccaacatggcaaaaccctgtctctactaaaaacacaaaaattcgcctggcgtggtggtacacgcctgtaatcccagctactcggtaagctaaggcaggaaaatcgcttgaacccgggaggtggaggttgcagtgagccgagagatcacactactgcactccagcctgggtgacatagcaagactgtctcaaaaacaaacaaacaaaaaatctgggggctgtcatgaaagctgtctagttctcagactgtgacttgagctgagttagcggacccaagcttgtcactgtctgtgggcactcaagggcactctggagaatccatccaataccctggtcttcagaattggcacaactagcacagctgttgagcacagcagccacagggggtcccaaggcacgtgcttcagttggtccctcatctccgtcaaccacaggcacttgtgggattatgatgccattgcatgccatgggcctctggcatcctgtttcccatcagcaagagctcagcgcggcgcccaagcccaaaggcacaaccaaaccaatcctggaatcctatcttaagagtcatctcctgggacactccaggtatcaactctatatccatcaggatgcagtcaggagagaaaaaccacagagtaacttgaacagggaaagtttaatatagagaattactggctttaacagtgaactggaataatgagggcttcactggtaaaatgcttctgaattgactggaaatccatttggggtgctggggaacgttattcccagagaggtgcctcagtggaggcgctgtgtctcctacgcaacttctgagggctggagggtgccaagggcagctgctgaccgcctggtgcttcaggagctgggtgctggggaagccacatgcactgcggcgtccagaggcagaagcacaaccaacaagaaccacgaaggaggcgcctttcctcctataatgcctgtttggtgccctctactgacaaagcttatcccctttcaaaaaacagccaactgaaaaagctgaatttggaacataaagtcaataaatccataaccagcaatactatggggcctggggtgcgctggcctttagtgagtggagtggggcgaaggatgctgcatgtcctgcagtgggcacagcggccctgcacgggggagaaccatccctgtaaagtgtcagtagtagcccctgtgtcagtcagggtccctgcaagaaatggcagtgcactcacataaggacagtttgagaagagtctcctgacaaggtgagtgtggctctctgcggctactaacagcctgagcctttacctccccaggcctgaacaggggcatggaaagggctgcctgacagggtgacaggagctgtgacctttagccaagggcagccaggaataaatactgggaactcacgctctctcctgtgattggccagcaccactcccccaccctgacgttgagtgaagacaaatggaagccagaagtgtggtgagctaccagacattccatgcagcccgctgagaagccacgtgagtggggacagggctaaaggctaggcagggacagggctggctgtgtcccgaggctgctcctccggccctgacttcaggccctcagcccagtcgactcccacaacctcgcaattgggcagcatctcctccaccaatatctgagtgaggccagggttggacacggcagggaggtccgagatgtccagcctgcggaggttcctgaaaaggggtgagaaggacaggaagccagtgtaaggacagcatgtgtgtgtgtgtagggaggtacaggacagcgtgtgcgtgtgtgtgtgtgtataggcaggtaagccagtgtaaggacagcgtgtgtgtgtatagggaggtacaggacagtgtgtgcgtgtgtgtgtgtgtgtgtgtatagggaggtaagccagtgtaaggacagcatgtgtgtgtgtgtgtgtagggaggtacaggacagcgtgtgtgtgtgtgtgtgtgtgtgtatagggagataagccagtataaggacagcgtgtgtgtgtgtgtgtgtgtgtgtagggaggtacagacagcgtgtgcgtgtgtgtagggaggtacaggacagcgtgcgtgtgtgtgtgtgtgtgtgtgtgtgtgtgtgtgtagggaggtactggccccaaatttcaaccttacaggacagtgtgtgtgcgtgcgtgtgtgtgtgtgcgtgcgtgcatgcgtgcatgtgtgtgtgtatagggaggtactggccccaaatttcaaccttagcttcctaaaataaaatctttatagctgtccaggcacatgaagcccactgtgttaattgcaaatatgcaactccagctcctgctgttctgcaacagcgtcgatatcacacagttttgactaaaacaaaaaggaagaaaaccaggagtcatttaattcttccagagactcactgtgactgctcatctaccataaatactctaggtttgtgatggatgcagggggatatgagaactgcctaacattgcccctccccacttcctctcctgcatctgggttaggtgggagaggtgcctgggcatgtggcccagcctgagctgaggtctcactggaggtggtggaggcaggcgaggccccgttcggagatgcgggggcaaccggccagcgagagctcctgcaacgagtcggccagtgggtagaggcggctgagacaccagtcgtccacgtggcagcagcgctgcagcgacaaggactggagctccttcaggcggactgcggtggggagagggtgggatggcaccaggagcctttctggagcccatcaccaaagggaaaacatagaggcctgtcccatctccaccccaccgcactcacggaggttatccaggccctcgtagttgatgtcacagtcaccggcatccacagcttcgacaggcacttcacagaaattccagaactcctgagagaaatggccatacttatctggcctgatccactccttgtctcgaaacctggaaacgggaaagggagtgtcagcagggcacctgaacctgccccaggcctccagcctcttcagaaccttccccagccctatataatatgtataggtcacccttgacataactaattccatcttagaaaaagactccatctggctgtgcgcagtggctcacgcctgtaatcccagcactttgggaggctgaggcaggagaatcacttgagttcaggagtttgagaccagcctgggcaacatagtgagacctcgtccctatgaaaaaatacaaaaattggccaggtgcggtggctcacgcctgtaatcccagcactttgggagccgaggtgggcggactacgaggtcaggagatcgaaaccatcctggctaatacacggtgaaaccccatctctactaaaaatacaaaaaaattagctgagcatggtggcaggcgcctgtactcccagcttcttgggaggctgaggcaggagaattgtttgaacctgggaggcggagcttgcagtgagccgagatcgtgccactgcactccagcctgggtgacagagcgagactccatctcaaaaaaaaaacaaaaaaacaaaaattagctgggcttggtggcttgcacctgtggtctcagctacttgggaggctgaggtgggaggatagcttgaacccaggaggtcgaggctgtagtgagttgtgatcatgccactgtgctccagcctgggagaccctatctcaaaaaaaaaaaaaaaaaaaaaggaatgttttgccaattttacatacctagaaactgagggtcagcgagattacagataacataagagcaaagaggtaaaatgcaagaatccttgtagatgggcagaagttaagggacattttcaaacatgtatactgtttctaaggaagttgccagaggaagtgctcaaaccagatggaggggtagatgaagtctatgtgaactgtcttttccaaaaaaagaaaaaaagcaaaggaaagagaaagggaaggagaaaggaggcggggaagaaggaaagaaagaaaaacattattgagcacaggccaggcgccaccagtggctcacgcctgtaatccccagcactttgggaggccgaggtgggtggatcacttgaggtcaggggttggagaccagcctggccaacatggtaaaaccctgtctctaccaaaaataaaaaaaattagccgggcgtggtagtgtgcacctataatcccaggtacttgggaggctgaggcaggagaattgcttgaacccaggagatggaggttgcagtgagccgagattgtgccactgcactctagcctgggcgacaagagcaagactcttgtctcaaaaaaaaaaaaaaattattgagcacatatgcattgctaggcttcttacattgcaaaatcacagttaatctctcactccccctgacagg

SEQ ID NO: 1331 - DNA, 28833 bp, Homo sapiens
agggaactatcccatctcatcaggatggggtgagtcagctccttggtataagtcacaatccaggcggcttcctttggtctgcccacatgcaaatgtctgaaaaatatctgaaaaagaccaatcttaggttttgaaaatagtgatgttgtctacagaagcaactggggaagttacagatcttgtgaactctggctacatgactcctgagcatcagggaattacagaagaacggctggttatcatttaactatgcctgcattttagtggaattcatgcccctcccataatcctatcattgtggccttttattagtcttacaaaggtggttttagtccccagaggggtcacttctgagaagggactgctgtcatcctttttcaacgttaaactataaactaaattcctcccatagttagcttggcctaggcccagccagatttctttttttttttttttttgagacagtcttgctctgttgtccaggttgaagtgctgtggcgtgatctcggctcattgcaacctctgcctcccaggttccaaaaatgatttttgtggagaatgaggtctcgctgtgttgtgcaggctggttttgaactcctgggctcaagtgatcctcccacctctgcctcctaaagtgctgggactataggcgttagccaccatgcccagcctaggtttcaattagatttagattgaagttagttttgaaaacacacattttgaaaattgttgataattcccttcttctttgcaaaacatttaattatttgtttatttacaatagatgagacatacatatgggaatgagtgtatggtgaaaattctctcaccagaccccacatacccaatttcccttccacagaggaagccactggtaccagtttctgtgtcttcttccagaaacataggccgtgcaaatacaagctctatgagtgtgtgtttacatgtatctttgtatttttgctttattcgcttaacaatatatctcagagcttatttctttcatagctgcacgtatgcatttggttttgtcatataaataaatatatatatatatatatatatatatatatttttttttttttttttttttttttaagagtctcactctgttgcctaggctggagtgcagtggctcgatctcagctcactgcaacctctgcctcccaggttccagcgatgctcctacctcagccgcccgaatagctgggattacaggcatgcgcaaccatgcccggctaatttttgtatatttagtagaggcgggttttctccatgttggtcaggttggtctcgaactcccaacctcaggtgatccacccaccttggcctcccaaagtgctgggattacaggtgtgagccaccgcgcctagcctctccctttcttccttccttcctttctctctctctttctttccttccttccttcctttttttctttctttcttttttttttttttttgacaaagtcttgctctgttgcccagactaaagtgcagtcatgagatcacaggatcttcccacctcagcttgctaagtagctgggactacagggacaggccactgcatctggctaatttttaaattgtttgtagagacacgatctggttatgttgcctggatagctggtctcgaactcctgggctttaagcaatcttcctgcctcggtctcccaaagtgtttttgtttgtttgtttgtttgtttgggtttttttttttgagacggagcctcactctgtcgcccagactggagtgcagtggcgcaatctcggctcactgcaagctccacctcccgggttcacgccattctcctgcctcagcctcccgagtagctggaactacaggcgcccgccaccacgcccggctaatttttgtatttttagtagagacggggtttcactgtgttagccaggatggtcttggtctcctgaccttgtgatccacccgcctcggcctcccaaggtgctgggattacaggagtgagccgccacacccacccccaacatgttgtgattataggcctgagttaccgtgctcggccttggatttctttttagcccatttttccatgtgagacccagagagctggggggcccactcaaggccttgccaaaagccagaagccagtgcagaccagaacccagataccccatttcccacccatcactggccaaagggttaatggctgttggcagacacaatgtttttgttttttattgatttgtgtgtttacatttgacttcccaaaagtgtctgaggcaactgccactgaggtatcaggacttgtgtttgcttttaccgcactccctcctgctggtagggaacccagacagtccgagccatcacagccaaactagaacggagtcaagctgcagcccagggccaaggccgagggaggcaccaagagccaggggccaaaccagatcgatcacatttgccatcaggccaagcaccatgtcaccaccacagccaggtgtgagctacaggcccaagagccaggccaagcagagagtgtccagggcacacgccccaccaatccccagaatacagcgccttctgatactcagccccagctctgggctgaatcttacctggaggcagatatctaatggatggagaggcagggcgcggtggctcatgcctgtaatcccagcactttgggaggctgaggcaggtggatcatctgaagtcaggagtttgagaccaacctggccaacatggcgaaaccccgtctctactaaaaatagaaaaattagctgggcgtagtggcacatgcctgtaatcccagccacttgggaggctgaggcacgagaatcgcttaaatgtgggaggtggaagttgcagtgagccgagatcgctctgtcatccagcctgggtgacagagcaagactccatctccaaaaaacaaacaaacaaacaaaaagaaatggagagctgaggataaaggtaggaaacttgtgacccaggaaactggaatagccagagaaggtacaaaggcggaggagctgatgaaagtcaggctcaggccgcttgcggtggctcatgcttataatcccagcactttgggaggccgaggcggggggatcacttgagatcaggagttcgagaccagcctgaccaacatggtgaaaccccgtctctattaaaaatacaaaatacaaaattagccaggcatggtggtgcatgcctgtaatcccagctacatgggaggctgaggcaggagaatcacttgaacccgggaggtggagtttgcagtgaatggcgatcacaacactgcactccagcctgagcaacaagagtgaaactctgtctcaaaaaaaaaaaaaaaaaaaaaaccaaaaccaagagcaaaacttcgtctcaaaaaaaaaaaaaaaaaaaaacaggtcaggctcaggattgcccacccagccttgcaaccccaccaagccctgcactgttatcaggctgggtcctctcttccttcgtccagaggggaatggaacaggtatggagacaggatgtcattttggagacccaggtttgaattctggtgcttccatatcttggctttggcatttgagcaaaatcattcactcttctatgcaacaaatatttattgagcaactactatggtaaggcattagccaggttctagggaacaaagatgagtaaaccacggtccccccctcatgacatgagagtaggagagtcagatgagcccagatggtaacatgatgagatagtggtgtggctggggcaaaaacaggcatctgtggagctcagagggagcccctatccagggagagaaggcccaggtagagtctcctggggaattcccttggaccacccattcattcaacaaatacataaagtgcctactgtgtgtcaggcactaagcaagacaccagagaaacaatggtctacaagacagacttggcccctgaaccagtagaacttcacggttgagtgagggaggaagaccagaagtgcgagttgtgagaaatgcaatgatggaaacacagcattgtcatcgagactaacacaggggatacatatatgggacaggggacgtgaggcagaatgttgtgatgttggaccaaaattagagtgtccttgtgaacttatgcaatatgtatctatcctatctttgtctgctaaaagtcctcacttccaggaatgctgagtttacccggtgcccagatcttagttgctaaatatccttctccgtgaaagggcaccgttccctgaagaaatggcttctgatctcagggctggtgctgaggaagtacaaggtgcagctggaacatcttattatgaaagaaaggaatggaaggatggaaggaacagagggaggcagggaaggaggggaaggaaggattatagcatttctatatgaagtctatttgtgataccaagcttggtaatataatgaatgaaccagcttaaatatagcacatttatgttcttaaaataaccagtgaaggaaactagaaggcagaatggtaagaggccaaggaaggaggacttcagaatgagagtgggaaacaatcgtagaggctgcaaataagtaagatgagggccaaggtgtatctgctggatttagtacgagagagacctgtggtgatgaccaaccacgtggagcccatgttcactggggaagtggggagaagaggacaggagggtcatcagtgaagagaaggtaggtaaagtctggggaagagcccaggatgatggcacacgcctgtaaacccagctacttgggaggctgagacaggaggatcccttgatcccaggaatttgagaccagcctaggcaacataacaggaccctgtctcacataaataaataactaaacaaacaaacaaacagataaatacagacagacatacatctagggaagacggaggtggcaggtagaagtggaaagagaaagaagcccaggacagggatttgagttgtttgattgactgattaaagcttaaataaagcttaagaattttgaccaaaagtgagtgtggtggtggcttgggggtggcatttagtcctctcttgggtctgttagcaactcatcctggtttttccagaactgtcctggttttagcattgaaagtacctcatcctgggaacctccttagtcccggcaaactgggatggtcactgtccactctcaggctgctactatcaccatattcagtagtcactgccagactgggaaggctaggccatatttattcattcaacaaacttttgctgaccctggaaatacaatgcctgcaaagcatacacagtccctacccttacagactacgtgaaattctttatttgcatttaagtgatttttttttgagacggagtttcactcttgtcacccaggctaaagtgcaattgcacgatctcagatcactgcgacctctgcctcctgggatcaggcgattctcctgcctcagcctcccaagtagctgggatctcggctcactgcaacctccgcctcttgggttcaagctattctcctgcctcagtctcctgagtaagggggattacagacatgcgtcaccacacccggataatttttgtatttttagtagagacggggtttcaccatgttggccaggctggtctcaaactcctgacctcaagtgatctgcacgcttcagcctcccaaaatgctgggattacaggcgtgaccaccaggcatggccttgcatttaagtgatactaatcaagctggatatccaaaaagaaaaacaaaaaagaaaatgacaaagcctttttttcctttagtatcttggttgaaaatgtgaaaagtaagaaaagtgtaaaaaggcaggaataaaaaatattagcagatttcctttcagtatttttcctgcatgtttcccaagttacttcctatcagtgtcctaaaaaatgcaagttaattttaactttggccgcaaaccaagaacaaaaaggttaagtgtattgaattaatttttcaagccaaagttaaaggatctgaggatgatctgctgtctccaaggctccagtccctgtttttttcctttagcaggtgtgatcacacgctggctgagatgagtaatgactttccctctcctcagcacgcttgctgctgtacaatttttttctttttacaaattaaaatgctgcattcacctgataataaaaatcaagtagaggctgggtgcagtggctcacgcctgtaatcccagcactttgggaagctgaggcgggtgaatcacctgaggttgggagttcgacaccagcctgaccaacatggtgaaaccccgtctcttccaaaaatacaaaaattagcctggcatggtggtgggtgcctgtaatcccagctactcaggaggctgagacaggagaatcgcttgaacccgggaggcagaggttgcagtgggctgagatcacaccattgcgctccagcctgagtgatgagagtgaaactccatcttaaaaaaaaataggccgggcgcggtggcttatgcctgtaatcccagcactttgggaggccagggcgggtggatcacgagatcaagagtttgagaccagcctggccaacatggtgaaaccctgtctctactaaaaatgcaaaaattagccaggcatggtggtgcacgcctgtaatcccagctacttaggaggctgaggcaggagaatcacttgaacctgggagggagaggttgcagtgagccaagattgtgccactgtactccagcctgggtgacagagcgagactccgtctcaaaaaaaaaaaaaaaaaaaaaaaaaaaagtgaaaattgtgggcatttgcagtctttgctgccattaagtcttctggatttttctacaggttgactctaaaagttgaaatccagtcaaagatatttacattattatggccacatgaacgttgtttaccctcaggccaaacaatgggctggaattacacttgcttctccacacactccatcccataatccatgtgtcactcaaaggacaatgtggcaagcaagcactaaggccctaaattgatactgtatcaattaaatacaattatgttgtgttatagcttgtgtttcatttattttattttattttttatttttatttttctgagagatgaactctcactctgtcgcccaggctggagtgcagtggcacaatctcgcctcactgcgacctctgcctcccaggttcaagtgattctcctgcctcagcctctcgagtagctgggattacaggcgtgcgccaccatgcccggctaatttttgtatttttagtagagacagggtttcaccatgttggccaggctggtctcaaactcttgatctcgtgatccacctgccttggcctcccaaagtgctgggattacaggcatgagccactgcgcccggcctatttattttatttcaagcagttctcctgcctcagcttcccaagtagctggaacttcaggcgtgcaccaccatgcccagctaatttttgtattttttagtagagatggtgtttcactacatgttggccaggctggtctcgaactcctgacctcaggtgatccacccaccttggcctcccaaagtgctgggattacaggcatgagccactgtgcccggcctatttattttattttttatagagacagggtctcactctgctgccgaggcttcggttcaatggggtgatcatagctcactgcaacctcaaactcctgggatcaagtgatcctcctgacttagcctccacagtagctgggactacaggagcatgccatcgcacctggataatttttcttgtattttttgtagagatggaaaggggttctcactattttgcccaggctggtcttgaactcctggcctcaagagatcctctcgtctcaacctctcaaagctctagggttacaggcgtgagccatgatgccctgcccgtatttatttatttttattttattatttatttattatctttttttttttttgagacagggtcttcctctgcagcccaagctggagttcagtgcccagatcatagctcatggcaacctggaattcctgggctcaagcgatcctcctgcctcagtttccccagtagctgggactacaggtgcacaccatgatgcccagcctgttttgttgcttttttttttttttttttttttttttttgagatggagtcttgctctgtcgcccaggctggagtgcagtcatgcgatctcggctcattgcaacctccacctcccgggttcaagcaattctctgcctcagcctcccgagtagctgagattacaggtgcccgccaccgtgcccagctaatttttgtttttttagtagagacagggtttcaccatcttggccaggctagtcttgaactcctgaccttgtgatccaccgaccttggcctcccaaagtgctgggattacaggcgtgagccaccacaactggccccagctgtttcttatttacattgtgatttcagttttgaaaattttctggagattctaactgcttttctttctttgcatactcttttttttttttttttttttgacagggtcttactctgttgctcgtgttggaatgcagtggtgtgatcacagctcactgcagcctcaacctcccaggctcaggtgatcctcccatctcaacctcctgagtagctgggactacaggcatgcaccaccatgcccagctctatggatgctttttcttgactctctttaagtatattaggtagtactctttgtatcctgaattatctctgtttcctccaatgtcaaattttgtttgttaattttggtctttctttctttttttttttttttgagatagggtcttgctgtgttgcccaggctggagtgtggtggcgtgatctcagctctctgcaacctctgtctcctgggttcaagcaattctctgcctcagcttcccgagtagctgggaactacaggcgcctgccaccacgtccggctaatttttttgtatttttattagagacagggtttcaccatcttggccaggcaggtctcgatctcctgacctcgtgatccacccgcctcagcctcccaaagtgctgcgattacaggcgtgaaccatcgcgcccagccaattttggtccttccttccttccttccttccttccttccttccttccttccttccctccttccctccctccctccctccctcctttctttctttcttcctttctttctttctttttgagacaaggtctgttgcccaggctggagtgtagtggtgcaatcacagctcactgcagcctcaaactcctgggctcaaacaatcctcctacctcggcctcctgagtagctgggactacaggcgtgggctaattttttaaaacttttctgtagagatggggtcttgctcttgcccaggctgatcttgaactcctggcccccagccttggccttctgggattacaggcgtaagccacctgccggaccaattttggtgtttcttttgcatgctgctggtcctcctcagatgcttggcaatcattggtaatgatgggcttcagaacgtgctaccggcacagtgagtgttttaagctgaaggaatttgagaaaaccgcagaagccgaaggatctttcttaccttctcctgcccttcttccctgaaccaggtcatacaacctggaactccctgcccttttcctgaagaagcaaataacagcctcctgcgagaggcgccctccctgcacctgggggaaaggagggtccttatctctgaagacacagggacacagaagaatctgaaccaacaggccttcctgagttccccacctccccgcaggaggtgcccgcacacgcatagccccgtcgctcccgcggccgcacgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggtgaggccccgctgcgcaccccttcttgggcacatcaggagctgagactgcagaggggccgctgggggccgcgtgggctgaaggcaaggggaagggaggatgggtggagggtgagatgtcaggtggagcggcacagggtgacgctccctccttcccagcaggagcctgcccaggaggagctggtggcagaggaggaccaggacccgtcggtgagtgggcgtgggcgcggtctgcaggctgctggggcatgggaagtgtgcacagccgaggctgcaggtgtgtgcagctgtgccagccgtactcgaggtgtgtgcagggtgtgtgtgaacacagtgcgtgcatgggtgcgtgtctgcaggggtgtgtgtgcgtggtgacaactctgtgtgaggggtttgtgctggggttgtgccacctgagtctgaggtgtttattggctgggggtgacgtggttgtataagatatgtgagtctgcgtggaagaggggtgcggttgtgtacagggtgtgtatcctctgtgcgtggtgactgggtgcgggcatgtgtgcaatgtgccaattgaatgcagggtctgcgttggttgtgtgtgtgggtgggaaagtgtagctggtctagaggaaagggtgaggactggggcctgactcccagcttcacctttgcccggggccccagctgtagttggctgaggggcttaatctgtccctgacttctgtgtctattgctggctggtggctctcctgacaggccccgtatgtctcactttatatctctgggagtctgtggttgaaccctgccctaattcccctaggaactgaatccccagacagaagaaagccaggatcctgcgcctttcctgaaccgactagttcggcctcgcagaagtggtgagcatccctctatcccaacctcaggaagcgggcagagcaaaaaccattatccacagggagaaactgaggcacggagggtgaaaggagttcagagtcatgcagctaaccagccaagactcaaacctagggattctcgccctcctctgaagctccttctgtcatatggatgtgctccttcagaccctaccccaaacaggaaggcagggtggccatgagttagaagaactactgggatcctgatggagactaggcctggcagtcagaggcctgggccccggtaggcaaagagacttaggaatgggatgatggggtggccggatgaccacgtgtccaagtcggcatgcagttgtcctggcccccacctgttatctcggtgtgattaatagcagcttcccgttttgctctcagcagtatcccagtgtggatgacaaattatagtcactctacttactgaggaagatgaggcctgagattctaaggccaggagtctggacaagaataaggatgccagggttcctgagaggggaatggggctgggagagttgctctgggacccccactagggcccgctttgctcatctgtctttccttgatcctcagcacctaaaggccggaaaacacgggctcgaagagcgatcgcagcccattatgaaggtgggtgatgggtgagccatacccaggaggagaggggcaggtggcagagggtcagggcaggtctcaccagccttttcctgtactttacagttcatccacgacctggacaggacggagcgcaggcaggtgagaccccatcccccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagcaccgtgacctcagaacctcaaatccagcctcttgctgcttccccactccacaccctccctacccctccactccatctgacctgtgctgccatgctgagcccctaaacttcacttttcttgtggtattggctctctacatggcttccagtctcttcgtggtctggtctcaacctaatttccctgcactcttatgctgtcttcatgtttgctgcgctgacacccctgctcccggtgtgcctcttctggactttgcacataccatccccctcaccagaatgtctttccactgtgagaggcagggaggcatgaggagtgctcagccgaggggttcacagcagagatggtgagaagtggatgggttcagcctgtgtcctgaagatattactgacttatgggttggaggtgaagaataaaagaaagggaggaatcacagatgacttctagattttttattttttttaagacagtctcgctctgtcacccaggctggagtgcagtggtgcaatctcggcttactgcaacctctgcctcccaggttcaagagattcccgtctcagccttccaagtagctgggattacaggcgtgtgccaccacgcctggctaatttttgtatttttagtagagatggggttttgccatgttttccaggctggtctcaaactcttgacctccagtgatctgcccgcctcggcctaccaaagtgctgggattacaggcatgagccactgcacccagccagcttctagatttttaacttgggtatctctgggaagaatgatgccatttcctaagaagggattgaccaaggaataaataggttgggaagtatgtaagataattattaacgttgagaagtctaaaataaacaagcggataaatgacaataaagtaaattccagaaatggatggctggacattgtcgactagcttaggctaggtcaggacggataaagccaggagtcatggccatatggatggcttttttttttttttttttgagacagagtctcgctctgtcacccaggctggagtgcagtggttcgatcttggctcactgcaacatctgcctcctgggtccaagcgattctcctgtctcagcctcccaagtagctgagattataggcgggtgccaccacacccagctcatttttgtattttttagtagagacagggtttcaccgtgttggccaggctggtcttgaactcctgatctcaggtgatccgccagcctcagcctcccaaagtgctgggattacaggtgtgagcccttgtgcccggcctatcgatggcatttaaagccacaggattgggtgagacgccaggagaaagaagggccccacgaatgaagccctgagactcttgggcatcttgaagtggagctgaggggaaaaccagcagagactgaaaagaagctggagagagaggaagaaacccagggagggtggcatcctggattcggagaaaccactgtttcaaggaggatgtggctgtctgtgttgaatgcagctgagagatcacatgaaatgagaacagagaaatgatggctgggtttggtaacgtgaaagtcctgctgaccttaaagagggtggtttcagtggcatagttagaacaggaaggcagtgtgcattgggttgagaagaaaatgagaaataaggaactggaggcagggacaacctttttttttttttttttttttttttttttttttttttttgtgacagagtttcactcttgtcacccaggctggatccagtgcaatggcacgatctcggctgaccgtaacctccacctcccgggttcaagcaattctcctgcctcagcctccccagtagctgagattacaggcatgcgccaccacgcctggctaattttgtatttttagtagagacagggtttctccatgttggtcaggctggtctcaaactcccgacctcaggtgttccacccgcttcggcctcccaaagtgctgggattacaagcatgagccactgcacccggcctaggacaaccctttttagaagtttctctgtaacaaggagcagagaaataggccagtaggtggaggggtgtgtggaccaaggaaaagtttagttctgtgaacaatactattttcatctgatctaacatgtactgagggctttcttgagataggcactgtgtctggcacttgtgtttggtcttatctaatcctcacaacagccctaaaaggaagatactctaattacctccattttacagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgggtttgtagatttgctggggggagatgagggaacctttgctcgatgacttctaggtcctctggacaactagggagatggagacaggagatttgaggagaaatggtacaaaatctcaacttgctgattatgaaagcaagcttcgtgggggaatgtaagattgccaggcaggacggaatgtccaggtgaggtttgtggctggagacaagtgatataccaggcaagccctccgtgctcctgggcacaccatgcccttaggctacaagcagcctttgcttaggctggcttcgtagctaggaatgccctctcttctctgccctccctactcttcatgcccagatcagccttcctcccctctgtatagaccacttattttggcaattatccagacattcattcattcattgactcaacaggcattgaagacctactgtttgctaggggccaggctaggtgcccacagcaactaatatccagactcttttttttttttttttttttttttgagatggagtctcactctgtcgcccaggctggagtgtagtggcgcgatctcggcttactgcaagctccgcctcctgggttcatgccattctcctgcctcagcctcccaagtagctgggactacaggcgcccgccaccacgcctggctaatttttttttattttttagtagagacggggtttcaccgtgttagccaggatggtctcgatctcctgacctcgtgatccacccaactcggcctcccaaagtgctgggattacaggcgtgagccaccgcgcccagccggtcagacccatttttttttttgagatggagttttgctcttgttgccccagctggagtgcagtggcgccatctcggctcactgcagccttctcgggttcaagtgattctcctgcctcagtctcccgagtagctgggactacaggcgcctgccaccacgcctggctaattttttttttatgttttagtagagacggggtttcaccgtgttagccaggagcgtctcgatctcctgacctcgtgatccacccaccttggcctcccaaggtgctgggattacaggcgtgagccactgtgcccagcctcagaccaactcttaaggagtcactgtctaggagaggaaacaagcatataaatttgtaattacaggaacatacaaaaaaaattagccaggtttggtggcacatgcctgtaatcccagctactcaggaggctgaagcatgagaatcacttgaacccgggaggcggaggctgcagtgagccgagattgtgccactgcactccagcctgggtgacaagagtgagactccatctcaaaaaaaaatttgtaattacagtggaatatgacaagaacaataataaaagtggccaagatacctggcaacacaggggaagacagacatggctgtggagtcagggattctctccctgcatcgcaaggtgccgctgggccttgaagcaggagcgtaagacaagacaggcaaggggtcaagaatggtgggtgcaagcagaagcagcccctggggcaaaagccccgggtttgcccagagcatgatgaggctgggggactctaagttcagcgtggcagaagcagaaagtgctagaggagcgagatggggatgaggctggagacagaagccaggccacacggtggcatgtgggaactattctgaggtgagccatcggaaggaggaaggcgaggcgaggcgggcttacgtctgcatcttagagactcattctgtggctttgtgtagggaataaactggaggaagccagaatggaaacagggaatgctgtgaaaaccagacagaggcaccagatgggggagagaggggagagagctatttaggaggcaggatagataggaactggtgatcgattaatgatgtaggtaaaggagagggaggcttgaatatccccctggtggcaaaaccagaagccaaatgtggaaaacagacagtaaagcaagagtgggatgaggggggtcagctcagtgttggttgagatgagtttgaggggctattgctgttcagatggtgcagttggcagggtaaggaagggaaggaaacttcagggctggagactctgcagagcacaggttgtgggaacccattggtggaaataaaaatgcccagtgagcgttttttttgtttttttttttttttggagacagagtctagctctgttgcccaggctggagtgcagtggcatgatcttggttcactgcaacctccccatcccaggttcaagtaattctcctgcctcagcctcccatgtagctaggattacaggtgcctgccaccatgccctgctagtttttgtatttttagtagagacggggtttcaccttgttggccaggctggtctcgaactcccgacctcaggtgatccgcccaccttggcctctcaaaatgccgggatgacaggcgtgagccactgcacctggctgagcatgatgttttcaaggcacatctgtgccatagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcagagcagcactctgtcctgcacctggttcccattaacgccacctccaagggtgagcactattttaaataatggctttggggaggggcaataaccaggaactcgggctggcacttgggctcaaggggtccttataggtgaaagggaaagaaccaaaaagcacctgagagtgccaagaagtcctgaccgacacactctcacctccagatgactccgatgtgacagaggtgatgtggcaaccagctcttaggcgtgggagaggcctacaggcccaaggatatggtgtccgaatccaggatgctggagtttatctgctgtatagccaggtaaccccagccacactctgagcttcacagagggcctctttggccccctactgagggttcctgacccctctattcataccaaacccagcagacccttctttcttccctcgttagcgctcctgaggcctcccagaactgagccaggccatcctgttttcttcaacatctcccttccctgccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgagagccgtgtgggcagccgaaagcaggacgtctctgaccgggggtagcagtgcagggagctaccgctaggagggaggttggaaacctaaacagaggcgggtctgaggagtgaagtgcagaatgccgggtccttacaggaggcagaggaacggtggagctggagaaggcagggggaaacagggcatctggatggctgtgcttcactgcgaatctactttctctcttttctcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggctccatttcccccactgcctcgcctcagcccggtcctcgtacggggatctcccgccctcctggctctcctgtggcgcgccccccgccggatcaaggtactggggatgccgctagggtcaggcccgcgagcgcggagaagacagagcgcggcgcaaaagggaaagtggcggggccgccacgcgcggccgggcggcggatgtgcgcaggcgcagcctcgcgtagcgctctgggctggccagtcccgtggcgccggcgtcctcgggtagacgggaccgcgcgcttggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccggtgaggacgccccctcccctccccccagccctgccttggcctctcccattcctgggcctcgctcccaccgaaccggggcccagaggcccgcataggggcttcttaaggcccgtgtgcgccgagccatccaagctcgtgggaccggactggtgccgggttgcattctggtccccgaggatgaagtaggagggggctgggccggcctggcttgtgcgctccgttctgtcccagcgtcttgattcggttctctttaagtttccttcaaagttcttccccgtttatcagcctctgccccctgaaccatatccctggcatctgcacttgagatgaccgcagccttcccatgccccccgttcatccagggtgttagagaactgtctcccattccagtccagtttccacgtgcaagttgcattctcctcaagtaccacggttatcatgtccctgaggaaagaaactgcccttgttgggccctcaaaggacagccctggtggtattaaaataaagacgtagaacctggcagtgctattgggtttggcctggtgatcttagaaataagatctctgaggcctgctgcttagccattttcccttgtctctggactggggagagatgatggcacagaccctgaagggccccttgtggaccgcgttaaccgggaagatcttaagttaggagttttgcgttttttcctcttttctttatttgcatctgaatccagaggaggcatggccaggaagagaggcaggatctgcggtggggtgatgcttagattttgataccctgatcttttgtttttcagggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggtaaggtgggaaaggggtgtggggttgcgggggaggggttagggagggttaagagcctggagcaccaggagcctgttgccatggtgagagctgggcttaaggaaagtaggatggaagagtgccggctccagaagagctgcgaaatgtctccattaagccccactttgagcagaaagtaagcctgggagtgagcctggcagtttcccaggcagagctaggaaacagatgccctaagtaggtatcccgtggtcttgagcgcagatgagaaagggagatgtggtttacaaaaatcctgtccacacgaaatcccttgtcggcctctcagtataagaacccccgtgtatacatctccagagggtaccattcccaaagtgacgggatgggatctctcccagtagtggagtacatcatcttacagttgtgaaagaatatttccctttcggagaactccagccaaacagtttcaggctctctaggtctttattacatattctagtattcattgagcctttacaatatgctgggtactatgctgggtgtttggcatatagtggtgacaaatatcccgaagttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtaaggagcccttaagcaactagcctctctcccttctccgactcctagaggagagtctggaggcctcaccccctcctctctccctttccaccaggcatcttggacgaattccttcaaacgtatggcagcctcatacccctcagcactgatgaggtagtagagaagctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaat

SEQ ID NO: 1332 - DNA, 32450 bp, Homo sapiens
attctagtccccagaggtgattctggatcccagaattctgtccccgcattctctgtcttctagccgcccctggtcctgtctcctctcctctcatcttcccactctgccccgcctcattctgccccagctacacagtctacttgctgttctttaaaaacaatacaaggcaggccgagcacggcataatcccagaacgttgggaggccgaggcgggaggatcacttgagcccaggagttcaagaccagcctgggcaacatggcaaaaccccatctctacaaaaaaattcaaaaaaaaaaaaaaaaagctgggcctggcggcacatgcctgtagttccagccactccggagggtgaggtgggaggatcgcttgagcccaggagattggggctacagttggtggtgatcatgccactgcactctagcctgggtgacaaagcgagaccgtctcaaaaaaaaccatagagccccacaagcctcctgcagggccgctggctgtttgcgctgcctgcgatacccccagacactctcatgactcatccccggtgtctctttcaggcccttgctcagttgtcaccttacagtaaggtagaggccctcccactaccttcggggaccccactttgcacctcctatcacttccgcactgtatatttttgtatcccccgtgacttactcccatctggcatgtgagctattgtactggtttgcttactgttgttctccctgcccaaccagaatcaaagttccatgaaggtagacactttgtatgttttgttctccactcatctcccatgcggggcacacatcctcgctccttcctcatgctcagcagtttgagttgaatgaaagaatgtcccctgcccatgggagaggacatagacaggcaggcgatgatgtggggtgggatggtcgcttggaataaggagctgtggcttcctcctggagaccccctcacgctgtccctctccttgcagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagagtaagtgatgggccctgagacggggatgggagaggggtcgaagaactgaggagtatggggtaggggtgagggtgggagaaaattctccataatggctgtgtgaaacagacagacctaaaggaactggggtctaaatggagtagggaggtatgggtttctctctgctataaagtatggcattgaatttaaaaattagctgggggccaggcacagtggcttacacctgccatcccagcacttttggaggctgaggtggggagatcgatcgtttgagcccaggaatttgagcccagtctgggtaacataggaagactacccccatctacaaaaaaaaaaaaaaaaaaaaaaaaatggccacgcagggtggctctgaccgctccgctctgcaaagactcctcggagcccaggatcctactacattttttttttttttttgtgacggagtctcactctgtcaccgaggctggaatacagtgatgcaatctcggctcactgcaagctctgcctcccaggttaaagcaattctcctgcctcagcctccggagtagctgggaatacaggcgcccaccaccatgcccagctaattttttggatttttagtagagacagggtttcactgtgttagccaggatggtctctatctcctgaccttgggatcccccctcctcagactccaaaagtgctgggattacaggcgtgagccaccatggctggccagttgttaataaaagaagaaagggcggttcctaaattgttatggagaatttacattaaaataacgtaagctattgattggctatccattgctctttgtatcacaaattccagaaacctgaagataaagagtaacactggtcaggcagggtgggtcaggcagggtggctcctgcctctaatcccagcactttgttttgtttttgtttttgtttaagatggagtcttggtctgtcgccctggctggagtgccaaggcgccatctcggctcactgcaacctccgcctccctggttcaagcgattctccagcctcagcctctcgagtagctgggattacagatgcgcgccaccacgcccggctaatttttgtatttttagtagagacggagtttcaccatgttggccaggctactcttgaactcctgacctcaagtgatccacccgcctcggcctcccaaagtgctaagatcacaagcatgagccactgcgcccagccaatgccagcactttggaaggccaaggctcttgttgctagtggttcgagaccagactgaacatcaaagtgagacaccatctctaaaaaaataaaacaaacaaaattagccaggcaaagtggtgcacacctgtggtccagctcctcaggaggctggggtgggaggtcacttgagcccaggagctcaagtctgcaatgagctatgatcatgccactgcactctagcccaggtgacagagcaagaccctgtatcttaaaaaataaaagactgggcacggtgcctcacacctgtaatcccagcactttgggaagccaacccaagtagataacttgagctcaggagttcgagaccagcctgggcaacatggcgaaacctgtctacaaaaaaaatacaaaaattacccagacctggtagcccatgcctgtagtcccagctacttgggtgggctgaggtgggggtgggggcatgtggaggctgcagtgagctatgatcacaccactgtactccagtctggccaacagagtgagaccttgtaaaaaaaaaaaaagaaaagaaaaatagctcagagcagtctgaggtatgcgagctatgcaaaatttgtttttttgagacaggatctcactctgtccctcaggctagagttcagtggtataatctgagctcactgcaaccttcgcctcctgagctcaaccaatcttcctaccgcagcctcccaagtaaatgggaccacgtaccaccacacctagctagtttttgtatttttgtagagacagggttttgccatgttgcccaggctggtcttgaactcctgacctcaggtgatccacccacctcagcctcccaaagtgctcggattacaggcgtgagccaccatgcccagcctggaatctgtatttaccacaagctctctaagtttttctgatgcacaggaaggtctgttacaccactgtcttaatcatctagttagttcaaaccaataacttgctgctgatctcctctgtgtgcagctccatgctgtgacccactgtgtccgagacggcctggagctcacaatatggaggaggagacaaaactgtctccagatagtgatggtgtagcatgaccagtgatgggatagggcagttgagcaagctctgagaagccagagggggcatctgacccaggctggatggtcaggtagggcttcctggaagaggggacatctgagctgacagaatgcatcgtaagcacctgtcattactgtatgctttggtctgtgggtgtgtagaatgagggacaggaactttaacctaatttgagggacaggaaggcacttcatttattcattcattcttttcacaaatatttactgaactcctcatagtggattctggagacaccttgctgacgacccagatctttcttttttttcttttcttttcttttctttttttttctttttgaggtggagtttcgctcttttttcccaggctggagtgcaatggcgcgatctcggctcaccacaacctccacctcccgggttcaagcaattctcctgcctcagcctcctgagtagctgggattacaggcatgcgccaccacgcccggctaattttgtatttttagtagggacagggtttctccatgttggtcaggctggtctcacactcctgacctcaggtgatctgcccacctcggcctcccaaagtgctgggattacaggcgtgagccaccacgcctggctgatctttctttcttttttttttttttttttttttaatttgagatggcatctcactctattgcacaggctggagtggagtgatctcatctcactgcaacctctgcctcccgagttcaagcgattcttgtgcctcagcctcctgagtagctgggattacaggcgtgcaccatcatgcccagctaatttttgtattttttggggagatggcatttcaccatgttggccaggctggtctcgaactgctgacctcagatgatccgcccgcctcagcctcccaaagtgctgggattacaggcgtgagccactgcccccagcccaacacagatcttttttccctcccagagctcacagtggggcatggtaattataaataacatttcaagtacaaattcagtaagtgccctgagggggaagtacagctaggtatgtccgtgtaacaggaattcctgatccactggggaaacctgaaggcttccgggaaaaagaggaattcatggaatgaataaaaactcttactccaggcaagaaaagggggcaggggaaagggagacccaggtagagggaacagcatgtgccataaccccggagtcagagggatgcctgggtcttaatctccacttgtcctacctcctaccccacagcctggagggacctccctcctacaagccaccaaccccaaaagcgaagctggaggcacaggagatggtgagcactttccctggagcccaagctatccccacctccacacccaccccagggctgggaggggcctggcagggagaagctggctgggtggtgggggcagttcctgacctccccgcccctctcccactacagccctcccagctcttcactctgggggcctcggagcacagcccactcaagaccccctactttgatgctggcgcctcatgcactgagcaggtaggagctcatgggaagacaaaggtgggttgggggtctgggttgaagggccaggggtcaggcctggcaaaagaggtcaaagactaaaggtcataactcaaggtcaagggtgtgtccccggttggtgcttaatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcgagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcatggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaacaaaaaaaaacagaatgaaagaaaattgattatctacatttgctggatactgtgcctgaagctgggacaagacaaatcaagtcactcccctcagtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccaggtcttgccttttctgtgggatgtgaaggggatggggtgagacatgaaggggaatgaggaaggagtctaagggcttgagagaatcagtgaactggggtcaagagagttaaagacaaaaacaaagggaccaaagatacaaaataagaattgagagagtaatgagcaaaaatgtatcaatcaaaaacaaaattttttttttttttgaggcggagtctcgctctgtcgcccaggctggagtgcagtggcatgatctcggctcactgcaagctccaccttctgagttaacgccattcctctgcctcagcctcccgagtagctgggactacaggcgcccaccaccacgcccggcttattttttgtatttttagtagagacggggtttcaccgcgttagccaagatggtctcgatctcctgacctcgtgatccacccgtctcggcctcccaaagtgctgggattacaggcgtgagccactgcgcccagccctaaaaacagaatgttgagtaatggaatggggaggggtccagggcatgctgtttaatgaacattcataattgcaacagcagtatgatgaatgggacaaagataaaaatagcaattggccagatgcagtggctcattcctgtaattccagcacttcgggaaactgaggcgggaagctcgactgagtccaggagttaagagaccagcctgggaaacacagtgagaccccgcctctacgaaagttagccgggcgtggtggcacgcacctgtagttcagctactctggaggctgaggtaggaggatcgattgaggccagaagttcaaggctgcagtaagctatgatggcgccactgcactccagcctgagtgacagagtccaaccttgtctttaaaaaaataaaaattaaaaaagcagtaacgaaagtataagaggctcaagtttaatgaataaacggcaagtaaaagtagactaaaggcaaaatcatgaataatgttgtaataggagcccaaggcatgacggataataaacctgaatgaatgggccagaggcagagtgatgaataatggaaaaatagggaccgggggcaagggaggtaacggacaggagttcatggatccaaaacatgatggctaattagagaagggccggaagaacgacgaaagtgagcaggcaggctggagctaaaagtagtctgggcaatgaagctcaaatgaatggggcagaggcatgatgggtaatgggagaggaatgaatgggccaaagatagaagccgcagtgacgcgaggaacaagaggcatgatgggtaacgaaaggggtgggtctaaggcaactgtttcgctaagaggtgatgagggcattgtgggtaacgaggagcagcgcagggttcgcagaacagattagaattctcccgaggcactctgggaagggccagcacttccggttttaggtcggctactccgaaccagaggtggggtgggggcccggctgccgcggtgcctggtgggacgcgaggcctgaccttgctgcctagccgcctctgccgcgcaacccacctttacctgtccttcgaccctggaacgttagccaatgagagtaccaagctgatacgccaccaaggtcgaccccgtacacgctggagccaatcaaaatgctgcaagggtcaaagccgaccaattatcacagcaacctcgccgcggggcggaatcaaaagagggcctcctccaggagagaggcggggcgatgcctcagcgggcgtggcaaaatgctcagcacagaccaatggcgggttagcaccggaacccgcggcgacgcgagccaataggcgcaggcgctgcgagccaatgggaagggtgggaggggcgccgtggctaccctgcgagtgagaaccaatacaaaaggacatttcagggaaagtgggcgggactttatgcacaagtccaatgggaagaccgagtcttgacgctggtgggcgggcctcagggcacactaaaccaatgggctaggtggggcggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaagggtgaggggcgaggggcccccgctgggctgcgatggcctggatctcgggggaagggggaggacactggggactctgggatttggcgcgcaccattggaattatttaacagcactaggaggtgatgttgggatcgaatggtggaacgttggacttggggcttagaatgatggaatcaaatgctggaaacgggatggaatgtcatagcagtagagaaaagcctttagggacctgaggagccccgggatcagccaagccagacttctcttgtgatcgggaaggcaactgaggcccaaggtcacggtgtcagcaaggtgtcagcgaggttccttgggtatgggacccaaagcctccggatcccagcctggagcaattagagtagtagtagtggtggagatttatggagttctgttctggtgttcattatacgttaactcattagatccttgggacaattctgtgtggtgagggtcccatctttcagatgatgagtttgacctaaagttgctcagcttggtggcagtgagatttgagcaagcaaaggccctggccctgtctaactaggctgtactgcctctttacaggtggaatcctttgtgagatgttctgctgtgggtctctggagagagctgggggtggtagggaaggaagagatgagagttggtgtggggttggagtggagtgtgacagcgtttctcttctccagagctgtttcccattcagatggagggtgtcaagctcacagtcaacaaagggttgagtaaccattttcaggtgagccttcctggtgtccttacccaccagagatcgtccccgccgtccccctccctgcatctgcacactcggcccaattactcctccctcaagagctgggctccctgatacttgaaaagactcggagatatagtgccagactgactactcagtttggggacctagaatccagaggtactgtctccccatagcagctaggctggagtgaaggaacaggtctgtgggcctaccggcagcacctcctttctctgagtctcttagtcaggccgtgcctcccagtcttcatcccctgcccagcccagagaccttgtccttgccctcttcagtgggcaagcctatctgtccagtatcgtcacagctctcgctttccttccaggtcaaccacacagtagccctcagcacaatcggggagtccaactaccacttcggggtcacatatgtggggacaaagcagctgagtcccacagaggtgagcttcctttttcatccattcattgtatccttctaataacaaatttgtagccaaatgtcaagctaagacggcctcatcaggaaaaggtcacagctaccgagagcctggagatggggattgcatctctccgaggtgcactgggacacaaataattccttcatccagcaaacatccgccaaacccctgctctctgcctggccccatgctgagcagtgctggggatgtggccacagccaccctgtcaccagacagcgatgacccagggtggaaagggctggactgtagatcatgcagaactttgaatgccagactaggctttggactttctctagggggttgtggagagtcatggcatggtttggtcaagggaaagacgtggtccacaggttcccgctgtagaaatctctggggcatctctggggtggccatgtgggggctagttattaggaagggcaaaactggaggcccagacagggttggggggactgaatgaggtctctgcttctgtcatttcccttcagcaaatgtgtttattctgcaaaccttcattgcacaacacattctgtgcccagccctgtgctggcacacatgactgaaacagcatgggactcacccgtggggcaggggacagactgttcccagagagtaacaagccaggatgggcaaggctgacatgggggaacccaaaggtcggggagcctaactcagcttaggtggtcagagagcacttcgtggaggaggggacccccatccgaggctttctgaccctaggcttctcaccccggcccatctcacatacttgcacagtgcaccacctctgaccccttccgttctctctgcctcacaggcgttccctgtactggtgggtgacatggacaacagtggcagtctcaacgctcaggtcattcaccagctgggccccggtctcaggtccaagatggccatccaggtgagtggggcacggaggctgctgctcccctcggccaccgtgagcagggagccgccctcacaccccctcctctccacagacccagcagtcgaagtttgtgaactggcaggtggacggggagtatcggggctctgacttcacagcagccgtcaccctggggaacccagacgtcctcgtgggttcaggtaagaggcggagggcttggagggtggtcacaaaactgcagttctggctttgccagcaaatccaccccatttgtgaacctccttttctgccactggagaagtggctcagcaggagtgattttgaaacatcaggcaacatactacagtgggtgagacggtcacccactgaccatgagtgggtgagtcagagcagtcttttttttttttttttttgagatggagtcttgctttatcacccaggttggagtgccgtggcacgatcttggctcactgcaacctccatctcctgggttcatgcaattctcctgcctcagcctcccgagtagctgggattacaggcatgcgctaccacgcctggctaatttttgtatttttagtagagacagggtttcaccacattggtcaggctggtcttgaactcctgacctcaagggatccacccacctcagcctcccaaagtgctgggattacaggtgtgagccaccacgcccagccagtcagcgcaattttaactgagattttcttttgtattaaaaaatgttttaagatggggtcttgctgtattggccaggctggtcttggaactcctggcttcaagcaatcctcccaccttgaccttccaaagtgctgggatgacaggcgtgagccacctcgcctggccagggaaacagcttttcagcctgcaagtagtgcagtcgggactcgtgaaaggaacttgagggaggatggtcccctggttgcataaggctttgcagagccttggccttcgctctgagtgagtctggggctttcggaaaccaaggcatagcttctcacaggaccctgcagctggcgtagagagcagactccaaagggggtaccactgggagggagtggacggggagaggaggttggattctggatgttgtttgaaggcagagctgccaggatttgttgagaccggatggaggcgatgactctgtagtttttggctggaactggaaggatggagtttcggattgccagctttgtgtctttgtgcagccatccactgtgtcgtggagagcaggctcttgagcgctgagtcctgagtgaatgactcgtgcaggcggggaggggagctagggttggccttggacccctgggagtgcctagggagagtcaccacttctcgctgcaggagcccagggagactcaaaagtgttgacttttgagctgccagaggaggagaaggggctaccccggctgggggacaggagcaagaagattccaggcagggagaagcaggaacaggggtgagggaagggaagggccatggcagaaaacccaggagacagggaagctggaggtgcagcaggtgcagagaggcctcctaggtgaggctgatctgtaggggccccatgaggaagaaacatttcctgtccccaactcacctggtgacatcaccccatcttctcatacactacagttgaaccacatgagccttttttgttggtttgtttttgtttttgagacggagtcttgctctgttgcccaggctggagtgctgtggtgcaatctcggctcactgcaacctctgcctccctggttcaagcgattctcctgcctcaggctccctagtatccctagtagctgggactacaggcgcgcgccaccatgcctggctaatttttgtatttttagtagagacaggttttcgccatgtcggccaggctgatctcgaacttcttacctcaagtgatccacccgccccggcctcccaaagtgctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcgccctctgtcgtccaccattgtccccatcttgcaaggccaagaggaggttctccactaagggcacatggccagtgggactccagtgtccctgctcttcacggcgccagcaaccccgttccctgtgccgcctcgctcgcctggtcctttcgtgctccccagcactggcctcctggagcccagggccaccagtgacgctttggtctctagtcctttccagtgcctcttccttcccccagacaccagtgagaacagggcctgccgtgtgccggtcagggctgagctctcgagtctcttgccaccaacagctccgacttgacccagggtgtctctacctccaggcggctctgtgacctccggcaagtggttccagcccttctgggcttcagtctcctcatctgtcacttgggcacaatagaagcaactacctcccagtgaaggagtccatgagagggcccgacttctcggcctcagcactgggccacatgcacagtcaccacttgctccactctggcatctccatggggacaatgcccgcaggcacccccatttcacagataaggaaagcgaggcccaggggtgaaatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgccctcatgggggtcccaggtcaggcacagtggctcacacctgtaatcccagcactttgggaggctgaggtgggcggatcgcttgagatcgggagttcaagatcagcctgggcaacatagcaataccctgtctctacaaaaaaaattagaaattaggcatatggtggtacatgcctgtagtcccaactactggggacgctgagctggcagggcacatgcctatagtcccagctacttgggagcctgggaagggggagtggttctattctgaagctgaggccaagccatccaaggccttgcaggtgtgctgaggaacccatatcttctcagggcacgagggagccatggcaggttctgggcagggggtcaacagggtcaggtttgtgctttaacatgatccctctgtctgctgtctgtgaggtcacttgaagttggggcatgagactagagaggaggctgtgggtagagaaactgggggggtggcccaggagatgggaaggatggttagaaagatacttgagggtctcatggcctcagttccaacagtccctggaactcagaggccagagattctaagtcactcactctagatggctgcttttccctctgggcttcagtctcccccttgattgaatgaggggataacactgaccagagtggtaatggtagtgattttttttttcttttcttcccctgccccacctcacatacctctgccctgagacgcagtctctgttgcccaggccagagtgcagtggcacagtgtcagctcacctcaacctccaccttctgggttcaagtgattctcctgtctcagcctcccaagtagctgggattacaggcacgcactgccacacccggctaatttttgtatttttgcgtcgtggcacatgcgtgtaatcccaggtactcgggaggctgaggcaggagagtcacttgaacccgggaggcagaggttgcagtgagccgagatgacgcctttgcactccagcctgggcaacaagagcaaaacgccccatctcaaaaaaaaaaaaaaagagagagagagggagagatgggggtctcgccatgttgccccagctggtctcagactcctgggctcaaacaaccctcctgcctcagcctcccaaagtgccaggattacaggcgtgagctactgtgccccgcccgtgtgatggtgattcaacaaccagtggggggttcggggattcatttgcttcatctcctctgggaaggagagtcacacagtcgcttgcccgagcccatggggaccagctgcagcctacttctgatctcagcctccccagaagatgccaccagggcactggccatgaactcacggcctctctcacacccaccaggctcatcttgggggttgccgcctaacactcagcccctctgagagctccacccagccatgcctgcaggtatgaaaggcccctattcctgcagctccagagagctggctccaggctggctccatgctagcaggccagcctgctcccactgtggggcccctagtctgcccctctggtcatcttggtctgggaagcatcttcgcacctgctttgctctgtgctgtctcagcttctctgtgtgccctcagtctcgtggcccccaacctcccttcccttctccacgtgtcttcctctccagggctgcaccctaggagattgctcgatcgtggtggatttctcaactgtgaatcttcagtccctcttcccccttcatttctgtctctgcagatgtgttgtttctttttttttttttcttttttttttttttttgtctttttgagatgaagtcttgcactgtctcccaggctggagtgcagtggcacaatcacaatctcagcttactgcaacttccgcctcccgggttcaagcgattctcctgcctcagcctcctgagtagctgggactacaggtgtgcaccaccacactcagctaatgtttgtatttttagtagagacagggtttcaccatgttggccaggctggtctcgaacctccgacctcagacgatccacccacctcagcctcccaaagtgctggaattacaggtgtgagccaccgtgcccagcctctttttttctttaaaaattttttaggccgggcgcggtggctcatgcttgtaatcccagcactttgggaggccgaggcaggcggatcacgaggtcaggagatcgagaccacggtgaaaccccttctctactaaaaatacaaaaaattagccaggcatggtggcgggctcctgtagtcccagctactcggagaggctgaggcaggagaatggcgtgaacccgggaggtggagcttgcagtgagccgagatagtgccactgcactccagcctgggcgacagagcgagactccatctcaaaaaaaaaaaaaaaaaattaaatttcttattttttgaaacaggatctctgttgcccacgttggagtgcagtggcgtgatcatagctcagtgtaaccttgaccttctgagctcaagtgatcctcctgcctcagcctcccaagtagctgggactataagcatgtgccatcatgcctggctacgtttttaaatttatttatttgttgtttgtttgcttattgggacagattctcactctgtcactcaggctggagtgcagtggcactatcatggctcactgcagcctccacctcctgggcttaagcaatcctcccacgtccacccccttagtacctgggactacaggtgtgcaccacctcacccaactaatttttgtattcgctatgtttcccaagctggtttcgaattcctgggctcaaatgaacccactttggcctcccaaactgctgggattacaacaagcatgagccactgtgcctggccttgatttttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttttttttttttttttttttttgagatggggtctcaccatgttgcccgggctggcttcgaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgcagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaaaggagcccttgagggaggcctgagagcaagcccaagcctccagccggggtgagcctagagggcttcctggaggtggagtctagcctggcactcagggtgggtggaaactgatcgtcattttgcccacaggaatcctcgtagcccactacctccagagcatcacgccttgcctggccctgggtggagagctggtctaccaccggcggcctggagaggagggcactgtcatgtctctagctgggaaatacacatgtgagcctggcgcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccacttgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccagggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggtgacagagcaagactccatctcaaaaaaaaaaaagtaggtggacaaccctctactatgttttatgcttggaaaaaaaaagtaggtagagcagccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtgcaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtggcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatgggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggcccggcactgggggttccttctcgaaccaggagttcagcctcccctgacccgcagaatcttctgatcccacccgctccaggagccaggaatgagtcccagtctctcccagttctcactgtgtggttttgccattcgtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgccctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctcccatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctaggattacaggcgcccgccaccacgcctggctaacttttgtatttttagtagagatggggtttcaccatgttggccaggctggtctcaaactcctgaccttaagtgattcgcccactgtggcctcccaaagtgctgggattacaggcgtgagctaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgtattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtcgggggcacggggatgagctcaggggcctctagaaagagctgggaccctgggaacccctggcctccaggtagtctcaggagagctactcggggtcgggcttggggagaggaggagcgggggtgaggcaagcagcaggggactggacctgggaagggctgggcagcagagacgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgttgttgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggagttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctatacctccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttctcctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtggcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcgtgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctgacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaaagcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaacttttttgtagagatgaggtctccctatattgcccaggctggtctcgaactcccaggctcaagtgatcctccctcttcagcttcccaaagtgctgggattacaggcatgagccaccatgcctggctaatgcaggtgaggtttttgcagtgtcatccagctaaggcgacccgttcccctcccaaaaaagggagactgagaacca

SEQ ID NO: 1333 - DNA, 90526 bp, Homo sapiens
tcagcctcccaagtagctgggattataggcatgcaccaccgcacctggctaatttttgtatttttagtagagacggggttttaccatgttagccaggctagtctcgagctcctgacctcaagtgatccacctacctcagcctcccaaagtgctgagattataggcgtaagtcaccgtgcccagcctttttctggtttttaatttcttagacataaacagtttttaagccatgctatacagatgatgctagcatgggtccctctagactcttttagcctagtattttccaacatttaagaagacagatcaaatggcacctcctctatgagattattagagacctccaaaattggacctcccaattttttcccatggtgtcttgactctgcctccattttataacacattttataatgctgtgtctctttcagtaaacagtgaattcctcaaaagcactgacagtcctcttcaccattataactatgtgcacggcctgacgagtactcagtaatatctgctgaataaagactgatttttcctggtagatgttatatcctaatgaaattacttcagcaagtattatcactataggataatatttaagcacgttattaaatataaatcacatgaacagtgtagagcaagcttgtctgattcctggcatgtgacccaggatggctctgagtgtggcccaacacacattcgtaaactttcttaaaatattatgttttttttgggattttttttttttttagctcatcagctatcgttagtgtattttatgtgtggtccaagacaattcttcttccagtgtggcccagggaagcctaaagattggacacccctggtgcagagcgtcgtttatccggcatatctcaagaattagactgtagaggaattctgttttcctagatcaaatttcaaattaattttataataaataattgtgatctacacacacacacacacacacgagctgaacatgtaacctccttccaacagcacggtcccacgatcatttttaaggggctgttggggaagtaatcgaccctttggctaatttttctcaggagcaacaactcatatcactaatgatcaaaacaaaatttttgtttttgacaaatgtcaccaaacacctagatagactgatacattagtgctttaataacctaggggggcatgttttacagtctgctgtagaaacaacagtagctctgacaatttggttatgggtaacttctttcctcctttgtgaaatgggatcataatactagtctcacaggtatggtttttaatatatacaaaatgtttattttagctttatttatactgtcaaaatcttaaaccaaactgaaggtccaactggaaaggaatagttgaataaaatggctacactcctgaaaaacaaaccaaacccaaaacaaacccaaaaacattcctaagagttcaggacaggagagacagacatcatttgatcatctacattgtcctaaaaagaataacaagatttgttactccttatttatttgctccttatgatagttttaagatgttatgtaaaaatcctttcaaaattttaaaaaaggaagtaggtagggacccaagatgaaataagagttgataagcttggggccaggcatggtggctcacgcctgtaatcccagcactttgggaggctgaggtgggcagatcacctgaagtcgggagttggcaaccagcctgaccaacacagagaaaccctgtctctactaaaaatacaaaattagctgggtgtggtggtgcatgcctgtaatccctgctactcgggaggctgagacaggagaatcgcttgaacccaggaggcggaggttgcagtgagccgagatcatgccattgcactccagcctgggcaacaagagcgaaactccatctcaaaaaaaaaaaaaaaaaaaaagagagttgataagcttgaatggataattgttgaggctggtgatgagtacacggaatcactatgttactcactctactttcatgtctgtgttcaaagttttaaacaaaagtattttttaaattctttagaaaatatggcatcctgtttggttgaaaatatggcatcctgatttgataaagctagggaatgagtacgttagtgttaatgtcttactctgtgttctttagacatatgttcctttaatacttcatatttacagttgctgctttgaagtttttatgggttaaatccaacttctaggcccacacagtttctttggactgcttgtttcctgagtatgggcctcactttcttgtcttgctcataatttctgattgaaaactagacgatttagcaagtattgattctgacatagtttcatggtttttttttttaaagcttgattgaatgtaactgcagaatctgtctcccacacaagagaatgtagctgctgatgtctctgcttacagtcttttttacagtctgttttacagtctttttatcttttggtctggcttccccagggtcactcctgcatagctaaatgtcagaggaggctgtgctagttaaacacctcgagcctctcggagggcttctatgcaccgcgggtggatctgagtgtaggctaagcagctcactcaatggccagtctcatgtttgtctaggcttttccgtcccatggggcgctctcaagtctcagccatggcccttctatgcctctctgtttcaggaggtcagcattaaatttctgctgaccaccacctgtcctatctggaattgcaatctcaggctagcaaaacggagttttctccgtttgtttccttccaagctcaccacttttagttgacatcatgggttctgcaccacctaacctccaccattgttcaccacctcaggcaacaaagctgctggttttcataccagctcagggctagaaaagccaggaggtttgaggggtgacagaagccccaggtaggaaggccacagactccaggttcccacccaaagctctagaagcttttcaaaaataacccaatttcttctctgcctttggtcaatttctagagaccccaaatggttggttttgacaactttagttttatacttgtttcttgcaaggagaattggctgacctcttcacatcatcatagccggatgtccctcctaatatccaattgtctcctttgtatgtgttttaaacttttgacacatacacatgcatacacacaaattaaagaatgacatcagggccaggcacggtggctcatgcctgtaatcccagaactttgggaggccgaggtgggcggatcacttgaggtcaggagttcgagaccagcctggccaacatagtgaaaccccgtctctactaaaaatacaaaaattagccaggcatggtggtgcacacctgtaatcccagctacttggaggctgagacaggagaatctcttgagcccaggaggcagagcttgcagtgagccgagatagcgccactgcactccagcctgggcaaaagagtcagactccgtctcaaaaaaaaaaaaaaaaaaaaaaaaagacattggggtgaaatttattttcagcaagtaacgctgatgtctaaatgggggaaaaaaagtggaaagactcagaaaaaagtcttaattcctcaagtagcaattttatgaagaattgatttttacggtcatcatatttttcaacacaggagttaccaagctgctgagcgcaatgctgacgagagcagtacaggttgaatgcaggcagctgagactaccctcggagtacatgtgcatgtggcatggaaacgctttagggagaagactttaaaatgattccaaaaaatttcaaaaactaagcagtccatataaattttcaaaaataaaacttacctcattagatcttgtaagtttatcaccaccaccgtctttttactccgagagtgtctgaacatacctttagtaaagtgatccttaggtaaaagggatttatgtgttgactcacagatgataccacagtttttaaaatacatctaaacagatgaagaggaaataagaagcaaatatatattttctaattcttaaaaaattcatgtctcccttcaccatctgggggtgggaaacttgtcctttgggaaacgtacacatttcgagtacagtacgttcccgtttacacatgggttaccaaggacttgagactgactcatcgtgtgaggaaaactcacaggatgatatccttcaacatctaagtgccttacattttacagaaagaaatgatgtatcttacctttttaagagtccatggacacttacaaaacaactttaccaaactcttatattaagttcgcaaatatttccaaatcattgagatttaatttttaaggtcaaaaataattcaatgaagtcaaagaatgttagagctgaaaagattactcttgtaaaaatagtcacagctgaaaattatcacagttaaaatatcactacagtgcaaattattactcttaaccccagaaaggctaaaagactgatatacaggaagattccattttaggagctaagacacaaaccaactaaaggttcaaatatttgccctaagtgatccattttttaaacatttttacatttttctctcagggacgtttttgaatttttctttatcttcaagacaaatattgttataattatagtggattattaatttactggatgtactaaattatgacaataacatgctataaaaccctcagctataccattattcacatgacctaagtcccaagggcaggaaaacaaggttctgattagtgacattttgtattccagtagaattggttagggcaagaaccactaggcttttatgtgacatttcatttcctagcttgctaagtgctcaaacactgtttctttcaagatttgctgaacaaccactccccctcctcccatcggtctgccaggcccaactcagggcccctagtgcttggcatgagcccccccaagcatttctcgtacttctttagtcatctggacatgtgtctgtctctccctcctgtgaatttctcaagccccaagccctactccccttgtttttagcagataagctccccttcaactgcagagaaaaattcccgcaacttctcccacccaaatccccccacatctacatctcccctctcttccatagtgccagccccaataaaggggtccttcccatctaaggccaatcccttcaaaactgtgctccgatcctgtttccctttctcaggaactcttctctgtatactctcttcagcctctccatctaatcatgtcctcaccataagaatttaccataagctcaagtctctaagcttcaaacaactctccttccacccccacttgcctctcctactcatgccctcttccccctctgcaatctggtttctcagcagagttgcctacaaacactatctccacttgctccctgcccactcaacaatgaggctttgttcctaccactgcatctacacggatctagtcaaaggcaacaaccaccttctggtcctcgagtccgtacagtcttcttaaaacttacctctccagccctcgcagcagcaggcacttcatgcattgacctctccttaccttttggaaagaactcttggcttcagtaactccctgacattcttatctacccttcgacagtgataaacttttaacatctgcatagaattttggactttagaaggcatttctgtaagtggcacatttattcgttaataaacattgcaaatgaatgtgtcatttgatcctaacaaccccatgggatttactaggtaggtgtcagctcattgcagagacgagaaaaataagacccatagtcaaggtaattctgtgacaggtcacacagaaagggtcaaaatcagtactcgaatcatgctgtcaactttaaaagccatgatccctccagtattgccatcatatgagccactagaagcactcaagatccgcatctaagaaaaaatgaagacatactgattatcttgcaaaaggaccagaggccaatgatgtacaataccctctgaaggaaaaaaaaaaaaaaaggctggttaaaaccgctcagatcctcttttttttcatcttttttttgggataaagagtctccctctatcacccaggctggagtgcaatggcgcgatctcggcttaatgcaacccccacctcccaggttcaagcaatgcttctacctcagcctcccgagtagctgggattacaggcacgtgccaccacgcctggctaatttttgtatttttgtagagacgaggttatgcttgagattatgtatgaaaatcttcttttcatattcatacataatctcaagcatcttttaaattgttcatgcttaaaatttccaaggctcaaatagtatcctaatagcagacatccggtgaataaagacagtagcttcagtagttaatcaactactgctacaaacaacatgtgtaaatcatttctaaagaaaaagtcagcagctgtttgctaaaaattttttttattgtgactgaagacattgccaacttacatatatcatttttatttggagtatttttttgccttgcagtgctcctgagaaattcaaaaatgcattaactttagctctataaataacacaacctaatattaaggttgcgttggaaatttcccacgtttagatatttccctaaaaatcaaaagacaatttaaattgttttacatagagaaaccttaataagtatttaactttttaataagttaaaaagtaaagactggcaaataatcacaaatgtcagaacattaaagtagcattttttccataggaatatataaaataaatatcatctatacttacttgatatttacaaaacttaaagataaatttttgtggatggaagatgtcttgaatacttcaatatgtggaaaacttcattatctttaaatatcaggtccaaatgcttttaagtttgatggataatagtgttttctaaaaaattctcatcactctactgtccctgaagacatagcttttccccccattgattggataagtattttgatagtttctgtactcttttcaattaaccattaagaggttaaaagaaacctaaggctttatttggggagatactggacgttttaattgactagttggaaagaagccattcttttcctagggttttgttgtttagttttgtttcattttttaaaaatcaaaaatgacaggaatgaaaattcaaacaatttgatccagtattatgctaaaattaaattcagtagttagatgaattttctactacagtatagaggttgaaaaccattaggaatgtggtaaaaaactatggcagcgaaggtggaattcaaccacaaattctactgagtggatagagaaataaacagaaaaattactgtagttaaaatattgcagttaaacgcactgttagcaatgtcctattgccaacattagaattatatgcttcatcactggttactaagacggttcagtgagcaggtggttcatctctgacacaactaagtttcagaaaagtcaatgacttatatctggtttagatcaacgaacacttagtatacataccagtcagctatagtttcaatgacacaatgaaaacattaggtactatagcttttttttttttttttttttttttgagacagagtctcgctctgtcgctcaggctggagtgcagtggagtggttgctaactgcaacctccacttcccggggtcaagcaattctcctgcctcagcctcctgagtagctgggattataggcgcctgccaccatgcccagctaatttttgtatttttagtagagatggggtttcaccatgttggccaggctggtcttgaactcctgacctcaggtgatccacccacctcaccctcccaaagttctgggattacaggcgtgagccactgtgcccggccagtattatagctttaggacaaggtcacatatttatttaaatagcagccatttaatatcatgctctgtgatgtttagctatgcaatccacccacaacagcttttaaacttacgttaaaccatgggatgagaggcggacaagttgttttggtcagagaaggaaatactcaaaaatgtcacaaaaggcatttcaaatatgatgacatactacttaaataccaaccatgcatctctttttcaaattaaaagagaaaactttttacatattctatttcttaaaaataaaggaccatgtgtcttttttaacttagaaactagtatttcatttctccacactgaaatgaaatttcaatggcaagcagcaaataatgtaggatagtcagtgaaagtatctttgttaggagcatataaaaaccaaggagtaacaactcacagagaaataataataggcaaaaaccaagaggcagtttgacagttctaatatagaacttgcatgacaacttcctttaaagtatagtaaataaagaatggcaatataaattagttatctaaggagatacaagacattctgaagcagcattttcagttacttcatttttcagaaaaacaagtttcacccatcaacatggaattaagacttccagtcttccaaatacattagaaagtacagttaatcacagtaaaacttgcaaataaccaaatttagttctggcctcagccaggactattcacatatttgaatttgttttattttcatccttccttgttatacaaatgtttctattttaaaagcatatagaaatttacaaaatttgcaagaaatatctttttaaatgtacaacttcaacaactaataaaaatatgaacatccagatacagttaagtttcaagtcgggattttttttttatgatgggtttatgaaaaattaaagaaatactttcttaagtttcaaacatctgggtactggtgctatcaaagtgatttcactgccctcagtggccaccgtgataacagttgactctcggattgctgtacctcatatgtcaacaccgcagacggaggcaggaagtggcatgttcagtgattttgctaattatacttacgtagatgcagctgtatggtttaatgcttatatgaaagttgcatgaatttgtgtaacatttagttttaagatggtatctttaaatagataccttagctgttaaaactaagtgatatatctgcactatatgctcaacaataaaaaggaacaaactagtgatacatccaaagccttggatggatctcaagggaattatgctgagtgaaaaaaagccagtctcaagagggtatatattgattccatttatataacattctcaaaataacaaaatgactgagatggagaacagtaagtggttgtcagggattaaggagagggccagggagagaggtggcaatgattatgagagggcaacacagggggatgcttgtaatggaagtcttccgtgtcttgcctgtggtggtagtcacatgaatttacacacagggccaggcgcagtggctcatgccttaatcccagcactttgggaggctgaggtgggaggatcacttgagcccaggagtttgaggccagcctggcaacatagtgagaccccatctctatttaaaacaaacaaaaaaagaatctacacacatgataatattgcacaggaccaaatacatacttcacctcagggaacctatgaccttccagcaacaatcttgttggcctgtctccacaaagtcctctaaagatgatcaatatatgcttcaaatcaactttctgcactatgcagagaagccactactagtatttttttattcttcgtttaaaaaaaaaaaacactctcttgataaaccacaatctctagcttaaatgagcttggaaatcacaaaaggaaataaaaagctgccatatagctactagtatttttgtctgtctgtatttttgtaaattaaggtaaaagataaattaaatgttcctagcttaaattaggtcaaatcagaaggaataaagcagattatatagcaaacacttgctcctgacacctgcagtttctaaaagcattaggaatatttttattaaattcagagaaagcataattgcgaacaaatacatgactttctccccaaaggccactttgtgataaagtacatacatatagtgttcatggtttctttaaagtgctagattgtctctggcttgagaatcatctattgctttaaaaggtctttcagcacaaccccagcactgttgtcaggtaacgctggcaaaggtgtaaatgtgggcaaaacatctgagatgggtttcagaagaagatgcccgggcccaccaggtccaagtccagctgggttaataagaggtacagctgccgagcgaggagccaaaaacggatttacatctgttcttctaccagacctggattctgctgtatctaaagaataaaatatggatttagtctcctatctttcacaaagaagtcaaaatgaaataactctgaatgtaatagcataaagttatctgtgtaatattgttaaattgattagcatagataaataaaaataatcaatgtatcacttatcaacttaaaaattctcccttgacggtaataacactggcatccagcacatctttttggactggtctttattcaaaatgaaaacgcagccaggcgcggtggctcatgcctgtaaccccagcactttgggaggctgaggtgggcggatcacctgaggtcaggagtttgagaccagcctggccaacatggtgaaacgccgtctctactaaaaacacaaaataaaaaattagctgggcatggtggcgggcgcctgtaatcccagctacttgggaggctgaggctggagaatcacttgaacctaggaggtggaggttgcagtgactggagatcgcaccactgcactccagcctgggtggcaagagcaaagctccatctcaaaaacaaaaaattaaaattaaaaaaaaaaatgaaagcacaaacaggcctcaattcctaaacacaaatactaatttgtatggctaaaatctgactaatgttcactcttggtaattcaaaacattttctgataaaaaaacaatgctatacatgtgttttaagttcccagatttggcccccaagtaaatttaattcatatgctgcggggttctggatcccacaagcaaggtctatgaaatacaggaggatgaaagaggataaggaataagaggaacgaatagggaaagaaaaggcaagagaagaatatttgtatgcttatctaataccttattaaacacattacagctcttgttttatacttaaataccagttatgtaactgatgaacttcatttaccataacaacagctttttaaatggtgtcatctatgttgcaaggcaaactctttacttacccatctgaataatgaaaggcttaaggagttacgttctccccaaataattacaataaagaaaaacaaacccatattacaatgataacagttgaattaatatttgccagaagaaaaaacaatatatacataccttacctgatcatcttttaggcagtcaaaggtttgaaaacaatcttgattagattatttttctatgaagttgggctaatacaattcctttttattggaataggtaaattcctaatgtcttagtggacagattctgctttaatgcccaagacctctgacaacttcaatggtaacagacaagcaatcctttgaaggtgcctacttcagcaatgggaaactcaaataaaaaagacctcctaaagcaaagaaagcactaagacaaatttgtcaaatctgcttatcattgagcactcttagggttcccaagccgtactttcctatgaatgacaactttccgaactctgggcaagcttctggtgttacctagtgagctctgacacacttccaaattcaagattaaagattaagcttgctttgttcatgcaaagcctatatcaacccaagccatcaccagcttttgtatcctatcaatacaaatcaggctgggcactggacttgatacaagaaaggggaaaggtaggaaagaggaagaaaagtgagagaaaagaaggggaaaggagggagagggagggagaataaagaaggagaagggaagaaaagggaaaggaagggtgggaaaagaaggggaagggaagagaggaagggaaagagcctgccataatgaatttgggaatctgtttcaagatgctacaacctagtgtaaaagaaaaactgttttcagtatagcctacacctcttagataaagttatgacttttcacaaaatttagcaggcaaaactacttactacctaaaggactgataaattttactactttcccttcctatacaagttcagaaaaatagaaatatttgtctaaacgacagaagtttcaaaaatttcagaatataaattctttattattttatccaaatttaagcatctgatgtgtgatatgagtatataacatatacctttacagtccaattagtaaacatattagtctattaaaatatgaagatttcagaagagctcttccaataaagaatttgtttatagtccaacagattataattcaatttcaattgataaattttcttgcgtgccagtatatatgatatgaacataaataaaacccttacaatttagtgagacagaaaaatatgtacacgttaaccaccaccaaccgtccgctctaggcagatctttcaacataaaagagtgctttctacattcttggagtctcaagtcagtttgttaaactgcgcttatatatattaacatgccaatgtttggttactgagtgtagcacttaaattttcaaaggagaaaaacccttctcaaactataaactacacatctaactcggattagcaagaaccaccattagtgagaaagcaaagcaggtggccaagaaagatgtaaccaattccccatcacttccagaggaataattcatagctggttaggcagacagagaagaattattctgatatacaaagggaatatatttcttaccatttaaattaatctaagtcaattaaatatcagattgctacaagaatatatgaagcaaaagcctgatgccttattggaaaagcctgatgccttattggaattctggaagtcctgattacacatttccaaaaatactaaaaatttagttaatatcactgtgaaacataatcatacattaaacattcaattttcaaattatagaaaaattaaatctctagttttacctttaaaactttctggtgcatttgtatctctttttcttcttcctggtgaatccagaggtttcatatcatgaacagaaagctttggtggtggaatggatggatgagattctgtttctagaaatttaacaaaaagttctgaaaaagactaagaaaaaatattttggttatattaggctagataattaagttatattcactacaactaaggaaatgtaccagcttttctaattaaatattaaaaattaatcatgccacttgaataatttttttttacaaatcagctttatgaacaattgaaaatactggcacttttttttttttttttttgagacggtgtcttgctctgtcgcccaggctggagtgcaatggcactatctcggctcactgcaacctccgcctcccaggttcaagtgattctcctgcctcagccatctaagtagctaggattacaggtgcacgccaccacgcccggctaatttttgcatttttagcagagacggggtttcaccatgttggttaggctggtctcaaactcctgaccctgtgatccgcccacctcggcctcccaaagtgcggggattacaggcgtgagccaccacacctggcctaaaatactagcactttagatagatgatcatcattacaaaaatttaacaatttaatcaatagtctgatggtaacactcacttctaacacctcatggtcagaattagccaactgataatacttatttttcttgccatcaatgaatagcacttaatgaatctgatcattttaataactattaacacaaacataaaaaattatatgaaaggaaaacacacattagacataattttctagtcaggtctaaccaatgaatataataacaaaagatcacaaataacattgtcagattaaaataatgtagtgtagacctttcctttaaattaaattttatgccagccaagtaaaatagggttttatctttaaccagctctgggtaaatcacctatccttcgtgtcctctttattaaaaaactaagagaggccgggcacagtggctcacgcctgtaaccccagtgctttgggaggctgaggtgggcggaccacgaggtcaggagttcaagaccagcctggccaacatggtgaaacccagtctccactaaaaatacaaaaactagctgggcgtggtggtggtgggcgcctgttatcccagctactcgggagactgaggcaggagaactgcctgaacccaggaggctgaggctgcagtgagccaagatcgcaccactgcactccagcctgggcgacagagcgagactctgtctcaaaaaacaaaacaaaacaaaagctaagagaaagaaactccacattctaactgatactactactcaattcaattaatattcatctagagcctacaacataccaggcactgtgttttcatgtttattaactgcttcctccttcgagaatctaagttttatgagggcaggcgccgtttctatccagtttgcagctgcatcctcaatgcttagaacagtctagttcacagcaggtactcagtaagtattcactggctcaacgatttggaacatacatagacgaataaaataaatcctctatcttgctactataatttagtagcaagactgcctatggcagcatgatcaagtacaaaggaaaagttaatattttgaaaaataaaagcaccatatagagttaaaataaaacctatatgcaataaagttatgaaaactggcttgttatccttaagcttaatcacctctctggaactcagtttctgcaacttcaaaataaaagggttgtataaaataattttaaaaaaaaatctgattctttgcaaatgaatgtaatatacagtcattttactattcaccttaagcaagaataaaattgtttcttacactattaaccacagattgctgatttggtctcaaaggtgtgttgggaacactttttgatcctcctccaagccacccagtcatccacctggtaacaccgccctgatcgtcatgaaacaactgaaagattattttaaaacagacaaatattatcagtacaagaaaaaaaaaaaaacaaggaccacttttatataatttctgatagttgtaaagcatgcttttcaagttcaagtcctagtaaatgtttcctactgatagagtctacaaatacaataaaatgccatcccaagcaccatctcaaatgaaagtctggggatatttcaacatttcagcatcctgatatgagtagtttgtaagttacaaaacatttaaactaatatcatacatattgaacaaatctgcctcttcaatgttgtatgaagtaattccatttccacactgagaaaattacactcagtaaaagttacatacagtaaaaggaagtaattgtctacaaagccactatctggattatgaatgtgttcagatggctttcatcgtccagtcacctgctccatctcctcccttctgacgcccaggatgctccccattaaccgtaacacttcatgacgctgatttttcggtgtgtggaaatgaccaatgaagaggtttctcattaggactctatgaaaataaaggcagaaacagctcaagtgaactcaacattaagtacactcaaacactaagcatagaaatatttaattatattaaacaattaaatatttacttataaaaaagtctaaacaaaatattttaaagtgtctttaaaaaatcttgacaagtctaatatttcaaaaaaaataaaataaaaaagaatatttcaaacatcccaaaatgtgtatcttttaaaatctcacttactagccacccactttattcaacccagttactgaccgaggtggcgcctccttagtaattccaagctcctgactgggctaatgttcacctgaagcagaaacttaaatggtgatgactgttgtgtttaatgttatgcttatatttccccatccaaatgtattaaaaatttactaataatatatacatttaaaaaatattaaatgagctactgttgcatatatactgaggtttcagatctaatacatttgagcaagattatgttcatttaaggacagtaaaagaagcaaaaaagaatggtaaaaataaattttttattttctaagtacttcttactgaggtgatattttagctcttctatatggttttaagaaaaagaatgagctggaaaaaaatccacattaaaaataaaagaaggtaagtgattctgctgactcctcattaaagctgcatccttcctcactaagagtgaggggaaaaaaggcttttgaaaaatttaatcacatataaacatctacatttagaagtttttttttaaccataaaagtgatttccacaaaatatacaaacattaaaagcaaaaagcatacttgtctacttttccttctgagctgtttgctaagctcatcaatttcttttgtacatcatccagcatttcttgtcggagctcatctgttgtaaaatatgtgaataaagatagccattaactgattaaaatagtctggatgactatataatgaaatttatgagatctttattataacctctgaatatatacacttattctaattgggaatattcaataacttctatctcttctttggtccagggaactaggctctcatatagaaatcctctaaaagccagagtgcattaattcacatggtttactcccaagaaagtaatcaactttgtaatacaatactgaaaaaccaagaaacgttttcatcctctttaaaaacttaatagcaaagaagagattttcatcactgcctccttgcatgaaacatttccagagccactcttattaacaggaggaagtagaaaggactttaatattttcctttttctattttcctggccagactctgtttttggtgagctgactaagaagcgtatctaacacaactaagaccatggctcaggatgcagtggataggacaaactattatgggggtaaggaaattgcaaaatataattcaggtaatcggctctaatatacaaatcaagatactatagcttatgactgacttagaaggatgcctggactattttatttttaaattattatttaaaaaggaagcaaaatccataaaatcttggtggaatagttggaatttaagcagtattaaaggcaaagtctagaattacaacaggagataccctgttcctaaattcagccatgccacagggcaaggatttctggactaaggaactctcagtcaaacagagtttacacctgttctgttatgccagaaacgaatagtttgagctgaaagagatgctcagtaattttaagctagattataagtttttgttctgaaagaaataaagaggagagctctatctagaaacattcacatccaaacgctagactctgccacaaaccttttcctttgaattatgctgcattttcctagtagtagctggatacaagttccgttatcagatatgatttacaaacatgttttccccattctgtgagttgtcatctcactttcttgatgatatcttttgaaacacaaaagttttcaatttttatgaagtccaatgtactttttcttttgttgcttgtgcttttggtttcatatctaagaaactatacctaacccaacacctgttttaagcgttttatagttttaattctaaaatttaggtctaccagccattttgagttaatttttgtgcatggtgtgaggtaggggtccaacttcattcttttgcacatggatatccacttgttccagcattatatggtgaagaaactattcttttggcaaccttgttggaaatcaattgaccataaatgtatggtatatttctagactctaaattcccactgtaagaattctgcaaatgttttgtcattcttttctttttttttttttcctgcctggaaagctcttttccatcaggactgccctcacctttcatgtctctgtttccaactcactttcttaaagaattttcctttgagccttacagattaggccaggtctgtttgctttatgttttcattctgctctgtacaatgcttctgcacaatgcccaaaattccgatttatggtactaaattcgtatataaaatgtctcgtttaactgtttacgatggcttgtggttttcctaaattgcaaaaatctaacttgcaaaatgtcattcatataataggccaattttaccaaaatagagatggttgccataaccatattataaaagcaaggtttgtatttggaaaatctactacgaacttttcctttcctgtctttccagtaaggaatttaaacttggacgagagagggagagagagaaggggagagagagggcgaaaaggtgggggtggacaggactattattaaagtctgagtcagtaaaagacactttagattcctaatgtgcacatgtatactactagcacatggtgttatctgggccttttctagcactatattctgaatgtaaatagaactcagcaaataagttaatctctcgtcactgttttgacttaaccgtcccactcacaaactaaagtaggagacagagtaaagatgggcatggtcttctcctccttcctcctccattcctccccaaggctacagaaagatagcagaaaaacagaggtcaagcttagctaacctacctccaacccccaccttccctttccctgagacttcccttctcctacctactttcctctaaaattagtaatttgtatattgattacatgtctatataataatttggttatactgggttatatataaaatatatatgtgtgtatatatatttgagacagggtcttgctctgttgcccaggctgtggcatgatcacagctcactgcagcctcaaactcctggggtcaagccatcctcctgcctcagcctcaggaaatagttgagattaccagtgtgcaccaccacaaccagctaatttctaattttttgtagagatggggtctcacgatattgcctgggctgatctcaaactcctgcgttcaagtaattctcctgccatagccttccaaaatgttgggattacaagtgtgagccactgtgcctgtccctatataaaacatattatcaaacaatttcacctatagctttttactgttttaacatggccactaaaaaatttaaaattgcacgtggctcacagtatattcctactggacagtactgcttttagaacataaccaggatataacactactctatactatctcttattttaaaaagagaggctgggcgcagtggctcacgcttgtaatcccagtgctttgcgaggccgaggtaagcatattgcttgagctcaggagtttgagaccagcctgggcaacatagcagaaccctgtctctacaagaaatacaaaaattagtcgggtgtggcggcatgaacctgtaattccagctacttaggaggctgaggcgggaggatcgcctgagcccaggaggcagatattgcagtgacctcagattgtgccactgcactccggcctggacaacagagcgagaccctgtctccaaaaaaaaaaaaaaaagagagagagagagagaaagtgaaatgacagacatcttcagagtaaaattcacaaagcagagctgagcctgataaaaattttagtaaaataaagtagaaaattttaactttgctctatgaaaaactgatcaagaaatcaaactgcgtagaagtccaaatcaaaaatactttcttgatgaaaacttactaagattggtatggtttttattaaagtctctgtattcagaaaggtagagtcaaaacatccttaaggcgaaaatgacagggttaaaatttcctaaactcactatcagaacatacagtttgtccctgagctaatgtgatgtggaatgcaaagggctgttgcaaactcaagcagtagttagaatgtactctgatatttgagtctagggggaaaaactcagaatttaagggacggtgctagaaggatggtattaactatgaggggtttggaaaggaaaagaaagtcaaacacctactacaaaggtccctacagatgcctctttttcttcaagcacccttattttcctcccatcagagattctgaatatttctctacaaaaactgaaccctaattcaaaccacaatttgaaatcagaactgtatttatatgggcagggaaaatatggttattcagaaatgagttttaagccaaataaaatatttctgtgaaataatctcacatgccaaaataattttttggaagttaaaaaaaaaaaaaggtggaggggggaactttaaaagttcagcaataaagcaactgagatttagtctagtttggagaaagagttactctacatctgtgacatagtaaaacttgccatatcagagtctcttctctggaacacctagacatggtgccatggtcttcaacatttggtttaaaataaaaattgaacataaaatgtaattgattgcaacaaattggcacatcataattttacatttcatttgtaattaatgacagtacactacaatgctgccttcagagaacatcttaaaatgaatcatactacatcttaaaatgaatcatactgcttacaaagtcatttggatatttcatgagtaagctcctgtaggcaagatccaagtcagatttactgaacagtcacctgactgagaaaaaaaaggaacacagaacttgagagtcagaagtggatatgaatcatggtcctatcaccagggccagactttgttgcctattttgtaaaatgaacatgcttatctcaaagaatttgatagaatcaactgaatgatcaaatgtgacttttctaaatagtaaagtgctacataaagcattagtacttatcatccaatttcttaaaataactaaaaagttcatatttcaatctagcctgaatcagtatcacatatattactctgtttaatgttaatattttgtgaggttttcccccctccattttgcatgtttgtcatctttgaggccaaggagtcaacagaaggaagaaaaaaatgttagaaagatgatttcacatacatatatatatgtcaataaataaattgcatctggtgtcttatctgcatctggataccttaaaactaaatttaaatctgatacaatattaaacctaataaggaaatttaacctcttcatttaattaaatataatcaaagcaaaagctagaaattagatcttttttattacagaatttcaagttatacaagatcacttttaacatcaaattttatatgtatattatatatatatatatatatatattttttttttttttttttttttttgagacagagtcttactctgtcacccagactggagtacagtggcgccccagctcactgcaacctccacctcccaggttcaagcaattctcctgcctcggtctcgcgagtagctgggataacaagcgcctgccaccacgcctggctaatttttgtatttttagtagagacggggtttctccatgttggccaggctggtcttgaactcctgacctcaagtgatccacccacctcagcctcccaaagtgctgggattacgagtgtgaaccaccgcacccggcccaaataatatatttttaaaagatattatactatttgcaatttgaggttaagctttacaagcatctgttttgtcttttttgttgttgtttttttagacagagtctcgctctgtcacccaggctgtagtgcagtggcacaccctctgctcactgcaacctctgcctcccaaggttcaagcgtttcttgcacctcagcctgctgagtagctgggatcacaggcatgtgccaccacacctggccaatttttttgtatttttagtagagacaggctttcaccatgttggccaagctggtctccaactcctgacctcaagtgatccatctgcctcagcctcccaaagtgctgggattacaggcatgggccaccgtgcccagccctgctttgtcttttaactcaattattttcaactgtatccaacacagaatttgaaggtctagagtatatggtaaatgttttgttgtcccataatcataattgttcactgctgagtgaaaagtatcttttaaaattctaggccaggcccagttgctcatgcctcttgtaatcctagcactttgggaagccaaggcagaaggatcatttgatgccaggagttcaagaccagcctgagcaacatagacaaaccgtctccacaaaaaaaaaaaaataagatcctgcctcttaaaaataaaaataaacttctacttcttagcaatgaactcacaggaaaagaattatattaatacagtataacttcattaatctgaattccactagatcagaatctgtgattggttgaggtctactggattatttgtagaccaaatttggattattcaccagagttactatgtacacttgattttatataaatatttttaatataaccaaatcaaatttatttttcctcaccattctcttcctttaaccctttattatgaattcagataatctgaactatatttctccatattgaaacagaactaattttttaaaaagagtaaatattatgagtggttatatacttgttactcctctggcatgtgagacagaatatatatttaattttaaaagtgttacaaactttcttactttcaggcgggagccacacattgggtacatacggacataaagatgggaacagcagacactggagataccagagggggaaaagggagagggggagaagggctgaaaaacaacctaatgggtactatgctcactacctgagtgacaagatcatttgtaccccaaacctcagtgtcaagcagtaataaacctatacaagtaaccctgtacaggtacccttgaatccacaagttgaaattaattttttaatgagatatttcatgaaaaaattgcagatatccagggtctcttcaaagatctgaagacatggcaacactgggcccacattcctgcatggcagcagctgggcggagctgagaatctgctgcctccataagaaacacttcaaatgatcagtctttacctagtttcatgtgctcttttatattatcatcatagcctcagtttacaatttgtgtttgtgatccatactaagagattcttatttccacacggcaacccacttctacctccaccttttcagcactccactccaacacatgcatgtgcacacatacccaccacccttggtcattactagtcaactgtatcttcagccagtttccagattatgacacacagtttcacaggaattcctccctctgtctagaacacttttccccaactttctgccttcttagctatacctattcaccattcaagtaatttcaagtgagcccttcactaaccttgtctacccttccatgctaccaacaccaagtacaaaggatagctctttcctttctaaaccatttgtttcatgtatttgatgcatgtcatcttcccttcctgcctgactgtaaacctcctgaaggcaggacccttgtctcctgtctttatttatatctttagttctactgcagtgcttagcacacagcaaataaacaatgaatatttgagaagtaagtcaaataatgattgattttctctgggaaaagagaatatctgcaaagaacagaacactggacaaaaagaacaatttatgttctgaattatgaactcatccatacataaagaaataagggcaaggacacaaaacacattaactcaaaacattcttattgctatatcatttacttttccctttaaacttagaggaatttttttaaactgcaatttctaaaatacagttcagttgaaaaaggtttaattatttacctaattgacatacacttttttcttaactcatattttggcattgtctagtatacccagatgtttatatcatcaaaataattttttaaccatttatggcaactcagaaaactgcatctggtacttcttatatgtttcctctaaaatcaccacttctgccaaaaacatctataaagaaatctctcaaaaggtttgggtaacaaagcgtctgggaatgtatttggcctgtgttcaacaggacattatatgttttcttgtataaatcatgtcctggaaaacggaatgtctttatttaaaataaaaactttaccatccagcaccgtaaaggtagttccacgaaaaatattttaagcttcttttatatctgtagctttaaaacatgtttttatgcttcatattacagtaagttttactgggactcattttatacattcttctagattttcttttaaaaaatggtccaaggaaattttccattctcaactcttaggagacttttaaaagtagtcattcaaccttcttaaaaaaaaaatcagttatgctgccctttcagatacaggtataaactagcagacagaccaaaagatcttcctgatgttagaactaaatttgtattgcttatgaaaactcacttttctttgcacaccataaaattcaccacctttctgaatcatagttatcaaaataacaatatcttgtgctttttatttcaatttatccaatcattttttttcttttcttttttttttttttttgggaccaagtttcactctgttgcccaggctggagtgcagtggcgtgatctcaactcaccgcaacctccacctcccaggttcaggcaattcttgtggctcagcctcccaagaagctgggactacaggcatgagccaccatgcctggctaatttttatatttttagtagagatggggtatcaccatgttggctaggctggtctcaaactcctgacctcaggtgatccacccaccttggcctctcaaagtgctgggattacaggtgtgagccaccacgtccggccaaatcattttcaattagcaggaatttatgtcaaggatgatggcagagaacaagaaggaaaggaaaatgtcaaatttgaccataaatatagcaagataatgcattttaatggttcagtcacaggtgtataatttctcatcaatagcaattccatggaattctgaactctgatcagctcagagtagttaatgaaaaccactgtcatatgtgcttcataggccactctactgagtttggatatgggatggcatgtgaagtctttggaactgtattgaagaacactttcaggtaaaatgctgaaagaataattttttaaaaggaaggatagcagtaattcttttaacagccaacactgtctattaaactatagtacttaggatcgtaggatttattttcttcgttactttcccgggaagagggatagagggggagggagacagggagaaatatttaaacagttccctactgctggtttatgtctctactcaagttccttttctccatggaatgctgcctgacccttaatgggattctggaggaactaaatatgccctgtcttatgatcactgttgtgcatcactgtcttcaattactaacctacggggtatctacacgatgtgtcatttccttagctaaactccttggaaaagggatactatctagtatctcatatagcacctaatgggaagccaagtagttggttctcattaaatatttagtgcctgataagcatctgtcttcatacttttcacacaaggcccaaaaatactcttaattcataagcacagatgcacatacatactcttaagaaatgactgaaattatcaacagtctactgtttcaatattggcattatttgcaacagctctctttttcatatgtttgaccagactgaatcatctcatctctggtagcaatgatataatcaaccatttggaataaaatacttttaaaagtgagcttcctaatattgtttaaatgctgaaactgtgtatcaattaatcattagtctacagatgcttagaagtaaccaatactttgcctttacgattcaagtctccatgtactttcttccaacaaaaggcaatctgtctttttcaaaattgtttctcctggcaaatatttttgctgtctggccaagttttgtgttaaaaataaagtacagtattacaacatcaatcaacatttaaagtacttaatgatctaggagagaaaatatacagcgattcttttgaaacaagtgagctaatcaaagttttgtttacattatcaaatcaagagtgcagctttgagaaaataaaattgcatttgtatttagagatataaaagtgatattaaagcacttaggtaatataagaaaacagattgttaagaagagctgtaaatggcaagaatgacttacagacataacagaaccaactgtctctttacaccccttcctgtttgtgcaacactggcctcttgcctgccctttcaaataccagttatacaagcataatcagagctttctctgtagctaatattgattccacaaaatgaatccaaagttcgtatacgtttacaatgaatattagtattttccacctaagctttatcatctataatcaagaacatctgaaaatattctactagtgggggcttaaatgagtgtctgaaaaagtactaaatacaggttgagtatcccttacccaaaatgcttggaaccagaagtgtttcagattttggatttttcagactttggaatatctacattatagtactactggctgagcatccctaatccaaaaatccaaaatccaaaatgctccaataagcatttcatttgagcatcatgtcacctttcaaaaagttttagactttggagcatttcagactttggattagggatgctcaacctgtatttcaagaactctgataatatttattaactacaataaatcttagaattttaaatttaccatcaactattgggaattacttaggtaggtgtctaaaagaggatgtggccttagatattatagtagcataacatatagcactgagttgtcacaaagcaatgagctggttcacaacactgctgtttcacctccattagtctagcccaacccgaagattatcaattcccagtgtgtctcctctcagttgcccatatgtcttccagataatgttgtagttgcactggccttcgatctaactagactgttttctaaataaatactgctcttggtaaaggcaaccatttcaacgttagggcacaatacagaagatgctaccatattttcaggggaaactggagatatacagaacaaaatacaagtcagactataaataaccattttcctgatagggctacaataacatgaaaagaccacgaattatggtaatagttaaaaagatcggagttcaaatcttgcctctttaatctataaaatggataataccacttattttagagatgcttataaaaagtaaatgatgagaagactaaatacataaatgttatgtcaaatgtccataatagacactcaatacataattgtttccttgctgcccattttcaggccctctactagatttagagatcctagcctggtcaagacttacaaggtagaagacttttggtttggcagtaacttgcctcagaatcaagtcattttgaggacaattacttcacatctatctttttttctctgtattcctaaaaatctcccctgtcctgtctcctgctggatttaggccagcttactttggcttgtcctttggtctccatgcgtcagtggttcctgccggcttgcctccctagtgtctaagtcactgcttctgttgttgacagctcctctgctgtaccatctccttctatttttgcttatttctaatttcatgttaggtggtatgtatttcttaactacatgccttgttactattgtgcctaacctagacatctaaagttgatgcatttctaggctccgttatcacctttccaataaccctgaatcattacctactaaatgcagccctagaatagttttgacttcctggttgcctctaaatcagagatgaaatgaggatatgccatctttgtcagctgttggattcaacaaagccctgtaagccacctgatcactgaaccaattaataatcctaagcataggacataccttagggtatggacagggcatatgaggcaccttataaacatcaaaaaatacatgatgcacctgtggtaaaacaccatctacaatcataaaaatctagctatacccagacattcattctacagaaagttgctcttttatttgagaattctgccttctctaacagatcagatggccttaggcaagatgcacgtgaactgataagggagaaatcatatccataaaaagtcaaatcagtccaatcaacccctctgatggtcaacagggtgacagccaatgcaatggcattgcctcaacatccaggaaaactaactggacagccagggccaacttaatgactctggtttcactaggaccatacttaaattgaagcaagtcagtcagggaagatacaaatggaagtcacacatcaatgaagttggtctcactcaactatgccaatttatgacagaagactacatttgatttaatatcagtattgtagtgggggaaaaatgaaaagaaaaaaacctactttgtcttttaagttcttcaatttgttcttcttttacatctaactgttctgtaagtcttgatgctgaatccaatgcagcatttgcttcatccaaacattcctgagaaagaaaactttattaaaaaaaagtatgcaaaaattatttcacaaactataaggctgagagacatcttagagtcaacctctacatttcagctggtgaagctgcacctctatgaccttgggcaaatgtatccaaccaataagtatcaaaggcagaacccacattcttttcaatacaatactgcctcatttagaggaactaaataaaaagagcagatgccactgaaagacaacatgatgacagaagtaaaaaaaaaaaaaaaaaaaagtaacaacataaactacaaaaaaacaaagatacaggaagtccagaaatatagcaacaaatgttctctttttcatttttgaaagtctaataaagtgatgttgattatgactttgttactttaaattttatttccctgaccactactagtgaatttgagcattacttttcatgtttacagggcaagctggatctgtccttctgtgaaaacctctttgcatacattgcccaagattctactgagttctatttctcctgtccatctgtaagagcaccttgtatagcagatatgaagctttttcacctgtgctaagcaaataccgttaccatatctgccatttttctactgactctataatatcttttgtcatgtaaacattttaaatactatatagtcaaacatgttctactttgcttttacagcttcttaagttttagtcttggttaggatcctccttgcccttagaatgtaaatgtagtcttccagattttattacaagatattttgtaatatagttaaatctttaacacagtgtttcttaatgggagtggctttggcattccttgcccaataaatgccatctatccccagataatcagcaccactcccagttgaaaatccctgctttaatacaattagactttacttttgtttatgatgtaaggtgagggtctgttgtttttttttccttccttcctatggacagctggttttatcaacatcattaattagataagctatcctttttctcattaaattagtttaggttttagtttcaaattctcaaatatatcctgggctctatttctggattctccttaatccactaatctagtcaatattgtatcgatttatggctctattatgacatctagtaggcaggtctctcctcactgcattatttctcataattttcttggctattctcaagtattctcccatgtaaatttaaggtcaagttttgccatcttcaatcagtgtgatagcctttttactgtgtcatcctggataggtcacagtccccagttattcaatcaaatatgatctagatgttgctgtgaaggtattctgcaaatgtaatcaaagtccttaatcagttgaatttaagaaaggcacattattctggataatttgggtgggcccgactgaaccagttttaaagttcttaaaagccagggtttagccttccccctaaaaaagaagaaattccttctttggaccgcaggttccgcctatgcctatggagttccatcctgcttgtgactttcctttcctggctgcctgtggacaacagctttggcccatgcctgctgagttccagcctgcctttgatgtgggcttcccatcttgactgccaaccctacaaatttcagacttgcttatccagcggctgcaatcttgtagccaattccttgtaataaattgcatgtgtgtatccatatatatcaatatataaatttgacacatatacatacacaccctactgatcctgcttttaggggctgaaacctgattgatatatagagggaatgaaattgaaaattttaaataaaatatttactattcaaaaatccacaaaactaaatttagtgtgaaggaaatgtaaactttcaaatgatttttttaacccacaccatttgtacttatgaagttattaaagcttaaatctacgcttagattttttccaaaatcagcatttagattttgttattctttctaccagttgtttggtttttatttcattaattacagcttttatttttattaattccctcaatttcttctcatttattttgttcttcttttaaatgtatattacactttaaattttaaaaaataaaactagttttaaaagaagatttggctgggtgctgtgacacatgcctatagtcccagctagtcaaaaggctgaggcaggaggattgcttgagtccagaaatgcaaggctgtagtgcactattatgatcacactggtgaagagccactgcattccagcctgggaaacatagcaagatttcatctctaattaaaataagaaaaaaatgccaggcatagaggctcacgcctgtaattccaacattttgtgaggtcaagacaggaggactgtttgagcccaggagtttgagaccagcctggacaacaaagcaagactctgtctctaagaaaaaagagaagaagatctggacttccattctagcagttccacagactgtatactctggatccactagaaaccactaagagtattagataaaatacatcttttaaatgtattaatgagctgacaagaaagtaagtataaatggtcaataaacatattaaaagatgcttgacctcactggtaattagggaagtgcaaattaaaaccacaggaagacagcccttctgctatggcttgaatgtatacccacaagttcatttgctgaaaacctgattcccaatgtggcagtattgggaggtagggcctgatgggaggtgtttggttcatgggggcaccaccctcatgaatagattaatgtccttattgtgggagtgggttcataatcaaggaagtaggttccttgcaagaggaggagtttggctccctcttgttctctcaccttaccctctctttgccacaggatgatgtagcaaggaggtttaccagttgctggcaccttaatcttggatttcccagcttccagaacccatgagctactaagtttctgttcattataaataaaccagtctgtggtattctattgtatcagcacaaaatggactaagacacttcctacccatcagattgtcaaaaactttgaaagtctgataatgtcaagtgttgacaaggatgtagaacaagaagtcatgtgcctgctagtgggagtaaattagcacaaccacttcagaaaacaattaatcatctaataaagctgaagttgaccatatatgtcctataactcagcaattccaatcaagatatacatctaaaaaaactcttgtatgtttagaagatatctgaaataccctttattaataaaatgggtaaattatatattaatgcaatgcatacagaagtgaaaataacaaatcgcctatatacagtaacacacagtaatatgactgaatctcataaacactatggtaagttttttaaaaaagcaagtctcagccgggtgcggtggctcacgcctgtaatcccagcactttgggaggctgatgtggatggatcacctgaagtcaggagttcaacaacagcctggccaacatggtgaaaccctgtctctactaaaaatacaaaaattagccaggcgtgatggtgtgtgcctgtaatctcagctacttgggaggctgaggcaggagaatcacttgaacccagggcaaaggttgtagtgagctgagatcacgcccttgcactccagcctgagcaaagagcgaaacgccgtctcaaaaaaaaaaaaaaaaaaaaaaaagcaagtctcagaaaaattactgaatttacatatagttcaaattccatttacatagacttcaaaaatatgcaaaaccaaacaatggattgtttggagcgtcaaacctatgtgataagaaccataaagaaaacaagcagaaaaagaaaaaagaaaaccaaacaaaataaggaagtaataaacataacattttggaatagtggttgcctaagaggtggaagatgagaatgggatgtgaaggggtgcataaggaacttcaaaggatgaagttttatttcttacactgggtggtgacagtgtgggtatttgctgcattgttagtcttatattttatacatattatctaaattgttttgcagccatttaatacttaattaaaatgttaaaactttattaggaagtatatcttcacttacttgggacgttaatgttcctgaagaacagcataattacctccactaatgtcaggtaaatgaattttatcattttctaccagttattgacagtctatttatgacatagaaaagcttctcctaggccgggcatggtgggtaatcccagcactttgggaggccaaggcgggcggatcacgaggtcaggagatcgagactatcctggctaacatggtgaaacctcgtctctactaaaaatacaaaaaattagccgggtgtggtggcgggcacctgtagtcccagctacttggaaggctgaggcaggagaaaggcgtgaacccaggagggggagtttgcagtgagccgagatcgcgctactgcactccagcatgggcaacagagcgagactccgtctcaaaaaaaaaaaaaaaaaaaaaaaaaaaaaaaagacaagtttctcctaaatctaaaagcacgttgttttggtgtcctatctcttcataggggttcatttttatatattccttatatataatttttgtcctatgtgtgaaatatagatggaatagaaaaatattttaaaggatgttattatacaaaaaaaaaaagatttaatgggataatatatattgttttaatccatgtgaaatgagtgctcacagaggtacaaatttaaaattttgttgaaaaaagaaaattacacgccaggcgcagtggctctcacctgtaatcccagcactttgggaggctgaggtgggcagatcacctgaggtcaggagttcgagaccagcctgaccaacatggtgaaaccccatctctattaaaaatacaaaattagctgggtatgatggtgcacgcctgtaatcccagctacttgggaggctgaggcaggagaattgcttgaacccggaaggcagaggttgcggtgggtcgagatcacgccattgcactccagcctgggtaacaagagtgaaactcggtctcaaaaaaaaaaaaaaaaaaaaaaagagagaaaattataaagttaaattatagattaatttgggtgttttttccccggagacctctaaaatacctctatgtgccaaaaaaatttaaatgtcctgtcatcttacatttgccgtgtctactctaaactatgacaccttagggaaatcctgggtatcttgttcactgtcaggctacagcagagggctggattcagggtagaaaatttactaaatgaacagtttaggagattatttccaagacaaagactctacaagtaactgttccatgaataataaaacctacaagagaaaactattttgtcctacctgtaatgatatcacttttccttccagattttctgcgtttttcttccattcagctataagctgtttttgcttttcgagttcagcagaatacatagctttttcctctaaagagaaaagaaagttaacattagtattttgcaatcgtgtgttaagttagaatgttaagccattttaaattttaataatccaacgaaaacagttcaaatgtctcaaacagaaaagaatatatgccttagtgataatgttaagcggtactaaactaatgagatcactttcctctgcctaaacacttctccatcttgtctatcttgcagattcttctctcccttcgtaactcttctcaaatatttcctctttggcaacactttctctacagtctcagttccacactgctttgtatacatacccactctaataattacattatactgtaaagtagacctcaaaaacttttttttttttttttttttgagacagagtctcactctgtcacccaggctggagtgcagtggtgtcatctcggctcactcactgcaacctcctcctccagggttcaagccgagtagctgggattacaggcatcttccaccacacctggctaatttgtgtatttttagtagagatggggtttcaccacattggccaggctggtcttgaactcctgacctcaggtgatctgcccgccttggcctcccaaagtgctgggattacaggcatgagccaccgtgcccggcaagaattcttatatctaaaatttaagatttcaaccctgaagtaacacagaggtacaaatttaaagttttgcttaggcataaaactacaagtccttgttacttcctcattctcatatcccctaatcacctccgacaactagcagttaatttactgtcaataattactgaatgcatgaataaacaaatggatggatgaatgatctaaagtgaataaatgtaaggataggaggtagaatgtgaaaaggtatatttgtttctcagggtagaactgctctggttactattattgtgtctccaaaaaagcaccttccatatggactagaaaatgtagttacctcaaagcatagatgaatagctatgaacatgtgaatcaccatttcaaagaacaataattaatgatgattatctgaagtaggttcaacctccagcccttatcttaaaacctaactattctttgtatgtgcgtatctctctttctttgtattctcctcttcattacttgatcatctttccttgtattctcctctttattacttgatcatctttccttgtatttcctcaactctcatctctcactggtaataggatactaaaacaaatttttaataattactaaataaagtttattttctcgtcttaattgtaaaaggagtctaaattaactttttgatggctactcacccttcccctctaccagtgggtaacctttcagagatttccccgtgcctcatctaaaatagctctcaaattaggcaaaattaccaataactacaatttttcttcattgaaagagtgaccgtagagcttaccttgttggaaatgctctagtaccatctgcaggttggccagtgacagagcatactgctttacttgttcctgagagacagaaagctgcagcgcagtttcatccctttgcttggaaactacattcaactgttcttgcaatgactctacctgcacactggcttgatggcttcaaacaaaaagaataaaagtcaaactgcttcatctatttagatactttaacaagaagaagccaccttccctacatcttattactttattttattttatttcttttttttttttttgagacagagtctcgctctgtcacccaggctggagtgcagtggcacaatctcagctcactgcaacctccacctcctaggttccagcgattctcctgcctcagcctcctgagtagctggggttataggcgtgcacaaccatgcctggctaatttttgtatttttagtaaagatggtgttttaccatgttggccaggctggtctcaaactcctgacctcaggtaatccacccaccttggcctcccaaagtgctgggattacaggcatgagccaccgcccctggcctcttattgctttaaattcaagttagatttcaaagtatttagatactttaataagatgaaacatcctacattttttattatggtaaaatatacataaaatttaccattttaaccagttttaagtgtacagttcagtggcactaagtacattcacactgttgtacaaccaccaccaccatccatctccagaacttttctcaccttctcaaactgaaactccatacccattaaatagtaattcccctttcccttgaaaactaccatcctactatctatctctgttaatgtgatctttcctacactttattgcattaaattcaagttaaatttcaaagaaacttgaagagttcttctggtacctgttgccctgtttttgtaaattcaatcactcttcctgtgaaagtgactttgaacaaatggcagtccttttaaagactaagaattaagttaaataagaaaagtcagcaaaataaaaatgtagtccaggtgaggcggctctcacatgtaatcccagccctttgagaggccaaggcaaaaggactgtttgagcccaggagcttgaggctgcactgaactatgatcacaccactgtactctagcctgggcgacagagtgagatcctgtctctaaaaactacaaataaaagaaaaaggtacaaatgaatagcctgcaatttttgtgcttccaggctaaaactctaagatgtaatttatcataaaatgttttgtaaggaaccctggaagtcattttgtccagctcccaatttaatacaaaatggattctatgacactcccttgcctttgacccccttgtattcatggtgaattcacaactttccaaaggctatcccactgatgaactgctctgaatattagttatcttttactatcatctttctgcctatattaaacacaataacctctatctctgactccagagagtcctaagaggtagatatagataaagcacctatctaggcttatgtcactggtgtacttccttaatgtataatgattacattcaaaatactgcaatagtctcccaggggttttaatttccggttaaattcttattcaagagcagcccattaaagctcattaggatcaactcattttgaagagactttacccattagcaccctcttgtggaaagagcacaagttggtaatcagaagatctaaattcagctcccaaatatctctggaccttgttcaactttgttggttagcaatcactcagtgggtgattgtaggaatgaaatgagctatgatggcactctagaagttaataaataccaggtgttactattgttaagtaagggctcacaccaccataatccggtttgtagatctgagttactcatacaacaagtatttactgaatagctattaaactctgtgtaatatatgctatgtgataggtagaaaatgaatgagcccattcctacctcccagtgactttacatttcattgggtgggaggcagtataggacacgtcgacaattacctgtaccctaaattaaaatataagtgccctcaaactataagactcaaactaaatattatgcaagttcaaaggaaaaacatcacaccaggaagatttgtttttggatatgacaagtggggtgctaaataaagcaccctttaggaagaaaatggaattgaagaataggcaagattcatagaacaacttgcaggggatcaggttcacccttcaggcagaagaaggcatatgaaaagaaaaagcagaagaaaaagaaacaggaaaacagtggctctgagaaagtgagtaatacagtttggctggatgtagctgataacatgaaataaggctaaggtggtaggagcctgggaccatccttgagtcaagaccagtttttgaaaaaaggagtaaaaagatcacacctctatgtaaggaaggttattctcaaagttattatgaaaaataaatgaaaagtgcagagactagaaactattttaattaagagaaaataagggcttgaaaagtgcaaaaaaagagtgagaatacagaatgttacagcatttctgccaaactgaaacatatagccaaatgatcactcattgttttaatccccgttttaaacaagttttccagctgagtctgaaggtataataatatactctgcaaaggtggggtaggggttaattcgcaggaatattgtctctactagcctataatttatttgcagacagatagaaatgattatctcattttatctccctttgtgtcataaatagtaaaaagataaatacaaagatgcatatacaactaataggaatacaaatggacacaattttttgtgaaataatttggcagtataatctcagaagttttaaaatgcttcttgatctagaagttccgtttctcaaaacttaccctaaggatataatctgtcatcaacacaaaaatacatgtcttgggatatcatgtcaacactcagtgattttgaaaagttaaaacacataataaatgactgcgttaatcatggcaaatccaaataatggcatattatgtagccacaaaatattgcaaacatacatggcttaacatgtactgacattcatattattgatagaaacagattacaaaacagtatgaatattataatctcagttttgctttaaaaagggtatataatgtatacacacagacataaaagtataaaaaggcacacaaaaagattatctctgggcatgtggggctctgtgtgatttgtgtgattttcctaaacatgaaaaatataacctttttacaactaaaaaaaaaaaaacaagaaaaaagttttcttgagagaaataaaaatctaaaatatataaacagggaccgggtcactcaagagtgctaataaacccagttaattcttcatactgaccttggtctctactctgctacttcctttactctcttcctgctaacatccacatcctgttcaacttaagatcatttgatgaaaaatacaaccacataaatagttattttggagttgaacagagccaattaaaatcagtcagaatttcaaactatactcctaaaatggtaagaggcagtgatctagggtgatggtcaaaacacagacagtttgaatgccagatctaaagagtcacagactcaaatgtgaaacccccacacacactctgagtgcctaccttgggcaggttatttaatctctttaccttcagtttcttcatccataaaatacagataatgaattttgcaaggatgagctaacatacaaaaaatacttactgagtctgatatttaagaagtgttcagttaaagttaatgcaaaaaaatgaaaaaattaccttgcattttccattgcattagaggatgaaactagcttttcctccaatactgtgactttctttcttagtttagcctctctatcttctgcagccaaagcttcacgggtataagaatcttctgattctaaaagatgattacgcaatctctctagctcttggtttgaacgaaattctttgtcacgtaaacgttgaacctaggtagaggacattatttttcttttacaaaatgctccctttccactgctacaaaccattttgttatcaaatctttttcccattattgaagatattaattgtataccaatttctcatactgcaaaatgtatttatgctaggaaaaaattatcttgaaatcatcttgaatatgcatctggaagctttacttcccagaatcttattcccctgtggctataatggaaaatggaattataaaattcattctgtataaagtactctttgtgacaggccactttttcagcaaatctcatttttttcacactttatgggtgggcaatttttcttatatccgagatatgccatgattttcacttttgaagactgaaataaaatgcaccatgggagattaaaattttactactgcacagcagaggaagaataagaaaaatcacctaacagagaaattcattttcactgatcacctttccagttctcttaatagttattaaacttattgtttgattcataattcttttaaagtgaaagtatacctcattctgtagggcagtattttccatttgtttttgtttcagggccaacatgacttggtctctctcctgttgaaacacaactgtcttctcctgcattgatttaactgcatttaaaagctgatttaactctccagtcttgcccttttggaaagaaaaaattttagctttaaaaaacacacacacacacatattttaaaagagacattttcttcactcaattattaattcatttaatttttaaatagggcagcctcccgatttactctctgagtaggctcagagagactcctagttaatttaaaaacgtagttaactatgtcaaagtcatgaaaaaccaaaaaagtcagagaatctgtcacaatctagagaagcctatggagccatgacatctaaatataatgaatataaagcggtatcctgccggtacaggaaaaggacatttagtaaacattaaggaattcgagtcaagtatgaactttagttcagtaacacctcaatattggttcattagctgtggcaaatacctcataacaatgtaagatgttaacaaggaaaactcagtatgaggtctatgagacctatctttgcaaattttctataaatttaaaactattctaaaagaataagtttattagaaatgttttaaaaggaacccaaaggacaaaaatgtcttcaaatttaccctatacaacaaagtattcagaacccccaaatcaacaaaaagtgtacgtgtgtgcacacgtatgtgcgtgctgtccattcataaagtatccacaattgttatgagagaaagtaacttcactgcaaaagtagggccacaagtttcagacaatagctgaaattctaaaaagcacaaaaacgtgtcaggctgctttacagccactttctttttttttcttttttttttttttgagacggagtcttgctctgttgcccaggctggagtgcagtggcgcgatctcggttcactgcaacctccgcctcctgggttcaagcagttctcgtgcctcagcctcccaagtagctgggattacaggcatgcaccaccacgtctggctaatttttgtatttttagtaaagacagggttacaccatgttggccaggctgatctcgaactcctgtcctcaggggatccacccacctcagcctcccaaagtgctgggattacatgtgtgagccaccatgcccggtctacagccgtttcttttctccattttaaatatgcatatcttatgaacctatttacagtttagtatatttttagttttcatgtaaactttccacttctttaagaatatgtaatgtatcccccaggataaatcattataaccaaaatataaaacaatctgttcctttaatattaacacttctggatagggaggccaatattttccaaatagtttttcagttttttttttttttcacactacaaagaaagagcaaatgcttgagaaattaaatagatctgaatatctcctattgagaacatccttttctccctaaaaaaagatgttactcattatattcaagatataatctaaaggtacttttatattatatacagagtattggaagaaattagtttacactaattaccctcaagtaatacaatagttaagtaccacttagctaacttagggaagcttcctaaaagtgaggagagtgttaataatatctgcacactttagatctgcaaaggtcaatgaaatagaactaaattgtacaaaacgctaaaactccaaaatatctataaatgacagaagacatcattgtactttattcctctgttctactcttataaccttaagaagctagagccaatttgggctagtgaacaataggaagctctagcctctaggactctcttcacatcaattatagaccagtaccattaaagctaagaagttatctcagaagaacaccttaacactgataatcagtgtgcctacttcatcagatgacaaaggaaaaaatgaagttttcacaactttaatccaagactctaagagggaacctaactggcaaatgaagttgaatcactttgtatcttatgcctggcagcaagtaatgctcaagaagtgctagttgaatattttattgttttgcctatcatctcttttcaaaatttctgctactaaaagcatagaaatcacagtaaaaaggcactactaaacaaaccctacacagcaccctatacactgccaaacaagccctacactatactatcatatagtacagtatagtatacagtgtaacaggaaatcctcaataattcttactaaaatgaattgcatataaaaatttaaatattatcaaaagctactggcactatccatataactgctatgaactcctgttttatagctgaataaaccaataaggtcaaaacatacccaaaatcacatcagtgacagaactgggattagaatatttactgagcctactatgagaaaagtattactcatggctaatacttttcaaattccaggttgtgactaatcaatacataaaaatcaatttaatgagtcactcagcacattttcttattattttaaaaaaatttctaacccaagtcactctacctgaataacacattctttttttttttttctttttcttttttattgagacagagtcttgttctgtcacccaggcaggagtgtaatggcatgatctcggctcactgcaacctctgcctcctgggttcaaatgattctcctgcctcagcctcccaagtagctaggattacaggcacccaccaccatgcctggctaattttttgtattttttttagtagagtcggggtttcactatgttggtcaggctggtctcaaactcctgacctcaggtgatccacccaccttggcctcccaaactgctgagattacaggcatgagccaccgcgcccagccagcacattctttttcaaacagagtatcacacgtaataagagcaatttctggttcctcaaacttttcagttagacacacacgcacacacacatacatactcttactgtgtcacaacgtgaaatgtatttcttactgcagatggttaaagacatatgtgtattttacagtgctttccttatatataagaatctctaaaatgttaacagctactgtaatacctaaaatttgattaaattgaagtaacttcaaaattctctcatgagacacatctgtttcctaaagaaaaatattaagtactacttagcaatctgtaaaaaattaatttactaccaaaagcatttggaaatatctaacaatttgagggagaacttccagatgtctctgaggaaaatttacttagaatgaatcacaccttgaaataaatatttctaaatgaacaaatgcacagtccccttcaaagacaatataaatgaaataacattaaaaaaagtctcctccacccccaacttccttctacaatactccatccagaacacacctgttctttctctttcaatagctgttcaaaagcaagagccttctccttcattgagtggcactcaaactctttttctcgcagcatcatagaaaacttcatgttagtctcttgtaacgcttgatattctgtttcctttcccctgtatgtttccactattttttcattttctccttttagtttgccaatgtccatctctagaattaatattctctccttcaggtttgttactgcctgcctcaaaagttcgttttcatttactttgttagtgaaattttcattggaagaaagtagttgatcacttttggctttgattaagaggtctttttccttaagtaacttttgcaaaacatcttgtttctcctttagctgcttgatttctgaatcggtttgttcgtgttcttttctttctagctctgaggtggcagcaatcgaatcagacaatctgtggttattttcctggagagttctaattgttgcatctttttcctgtagtgattttcttagctcttctaactcttgctgaagcaattcagaagattcactcaatacttcagacttacttgctctaagacactctgcagactggggagtaagcaatgatgcagaagacagctggggtgaaataatatcaagttttcctaaaagaagatccttggtattgcaaagctgcccaatgctgtgctgaacttgtgctaattcctgcccaaaatttttgagtttggtttcattctgctcataactttggatcaggccagtatagtccacttgtaatttagaattattatcactgtcaaccaaaacctgtgcttgaagttggtgaagctcttcctgaagctgggctgactcgtgttgcatattttgtactgtggtcatcacctgctgcttccactcttccattttctttacttgctgttttaacttgtcacgttcctgtagaagctcctcaaattgattactattaacacctccagcctcattaccagtgctggatgtttgtaaaactgccaataaagtctgacatttctgacttagtgcatctatttcgatgtctttttctcgaatgatacgtgataaattctgaatagtttctctaaacatatcttggccactactttcaaatctagtggacaattttttattttcatcttgcagtttgataagagctgcttccttggcagcaacaatatccatcattttgtgatattctgtttttagatggctattttccctagtcttctcattcaaaacagcaaataccttttctctttccatagcataagcctgcagttgctgttgaaggtaaacaacatcttgagtatgggaagttgaagaaattctagcatgaagagcttgtatctccaaatctttctgctgaataatctgagttagtttaccaacttcatctttggacaactgatcaatctgtttagttaaagatatattcttttcatttagaagtttaatctccagttctcgctcttttattcctttcactaatctttccgtttcagctttagataaatcatgcttttcacttccattttctatattaaggctctgaacttttgtttcttgaaaaatatcagagttatctgtttgaatgtcctgtctttcttcatgcaactgggttttgatttgttcaattgttttttgcaaactcttaatttcctcatccttctctaaaaagagctgggtgtgtgtggcgttcatttgctcatgctggtatctaaactcatccatttccttcttttgctcttgtaaagactgaagtagttgcatcttactctggttttgatcttcaattatcttttgatgatgtttaatttcctcttcaagatgttccttgatcgtgttcagttgagatacctcagatgctagttcagtaacactatcaagggttttagggtcagccacaggtgcggttcgactctgctcttccctgagtcgttccaattcttcttgcagatgattattttcctctttcatggatccaagacttcggtctttttcctctatggtctgtcttaaaatttcattttttcttaaggcctgagaatatttatccaattcctcctgcagctttgaacttctttctttaagcttttcaataaaaatttctttcttgtttataagttgtgtcaactgcttctgctcttctaaactagatgacaaaacgtccttagtttctttatggtcagtatccatttgttcaatattctttttgagttctgctatttccatgtctttcttttgattgagtttaattaaatgctcatgttccagctgtaaggcagaggtattcaaattacgtgcatttgacagttcttcaatggttttctcatacttgtttgcttcttccaacagcctctttttagcccaacacaattctgcctctatctctcctttttccatttttagagtctccacaatagtgtttttttccagagaaagctgattgttaccagcaagacattcttctaactgatgcctcacatcttcacatgctaaaactaacttttcattttccattttgacatcaaaagcaactttctttaaattttcattgagctgttctaattctgaaagattttgctttaagtttctaacttcagcttctctttctttaagtaaggtatccttaaaattactattagagtcttgatttagagactgcattaactcattccttattctagaaagctcctcctcattttgtctaatatgctccttaagttctaaattctccttctggatgcttacattactttcttgtgatttatttagctgatctactaaattttctactttgtcctcaagtttctgcttggttaaatgtaaatcatttagggccacttcactttgaattagcttttctttctgtacatctaactctttagtaatgtccattttatcatcttcaagttgatgaactctctttttttcatcatttagatcttgtttcagtttactgatgatgctatctccttcattttgttgttttgatagctgatcttttatcaaaatcatgtgctgaaagaaaaatttgcatggtgactttacaacatgttctcattttagtactcaaagaaaattttataaaatctcatacataatagaaaataatcctcaaatatttctaatccttcttaaaaacattgtttttctatcaaaaacacccactacaaaattacttattattattttacagcaaacccatcttgtcttttttgttttttgagacggagtttcgctcttgttgcccaggctggagtgcaatggcacaatctcggctcggcgcaatctcggctcaccgcaacctccgcctccacctcttgaacctcccaggttcaagcaattctcctgcctcaacctcccgagtagctgggattacaggcatgcgccaccacacccggctaattttgtatttttagtagagatggggtttctccatgttggtcaggctggtctcaaacttccaacctcgggtgatctgcctgcctcagcctcccaaagtgttgggattacaggcatgagccactgtgcctggccccatcttgtcatttcttaaagcattttagggataagaatttaaaaccaaagatggtaaatagtattttttttttttttgagacagagtcgctctgttgcccaggctggagtgcagtggcatgatctcggctcactgtaacctctgcctcctgggttcaagcaattctctgcctcagcctcccgagtagctgggattacaggcacctgccaccacggccggctaattttttgtatttttagtagagacggggtttcaccatcttgaccaggctggtcttgaactcctgacctcgtgatccacccgtctctgcctcccaaagtgctaggatgacaggcatgagccactgcgcccggcatgttgtttatttttaactctacactagagtaagagtcaacgaactatagccattggccaactcagggatgctgcctgttttgtaaataaaattttgttgaaacatggtcacactcatttgttggtatcacaacaacagagttgagtagactgagacaatatggcctacaaggccaatgatatttactatctagcactttaccaaaaaggtttgtcaatctctatgaactaaaatattaattaaatcacacccaccatttctgtgtttagtttacttagtagaatgtgctgccttactgtatttaatacagtgttacctttgtagcttcttgattctgtctgtccaattcttctatctcagctatcagtgtttccttttcactaatactctgattgagttcttgttcctttgcctccaaattaagtcttaagtcatgtaattctgaatccaaacttatgtctcttgtagctgtacttttaattacttcatattcattgttcaattttaaaagtgacatctgaagttcttcctgaaatgataaaaggaaaaaagcaacacatactttcaattggagacaccaaaagattaaaaacatacatagaagcaaaacttgggattctatttaagtgctctatattggaaataatattgaacaatacctcaataattgtatgtgaaattcaacaaaccacatccttcattcatgtgcaattttacttgtagcttcaagcaaaacatttctataaccctagacagatgcagcgactgtaagtttgtcctctagcaccaagttcttctttataaaaaacgttcccatttgagagcctctcctatcctgctccaccgtggctaccctttatccatcccctggccccacctaccatacatacatactttccaaaatgtccgcaagtctttctgccttcctcacttccattctctaacatccagtcatcaacagcctcagactaaataaaaatataaaaaatcaacactccttcacccaaatgtttagcctctctaattagaaaataaaaggtttcttttctcttactaaaggaatttcccttattacttttgcttctgttagaacatggaactttttcttgaccctagaaagaatcctccttccttcctttaccttttaaccagactaggttcccctctgtcacacctgacattcctaaagatagtatatatacattttatagtctactacctggtatttaatgctttctccaaaatctcagaagtgggacagttctctatgcttcaacattatttcagtctctagttatgatgtttgtaataaactatatattaaagccttctttcattgacagatttttaaaaatcaaacccatatggaatctactttaaatagagtattgaaccaggcatgatggcatttatctatagtcccaggaggctacttaggtggctgaggcagaaggattacttgagccaaggagttcaaggctgtagtgcactatgatcatgccatgatcagccacagcactctaacctgggcaatacagcaagactctctctctctaaaaaataaaattaaaaaaataagaatctcaaattccttcaaagaaacagcctaatataaaccttataaaagaaactcaacattgctatggagagttggttgaaaaaacagagatccgataaaagctatactagagtatctgtatcacaattcttatttccttctaattcaaaaatttattctaactacagctgaaagatggaaacagcattctcttaagtctttctaaagttatctgttcaaattaggagaatcacagacattttctttaggtagatcttaaaagcacacacagcctcataggtactttttaaaaaaattatttagtgtttttttgtagatatggtgtctcactatgttgcccaggctggtctcgaactcctggccttgagcaatcatcccaccttggcctcccaaagtgctgagattacagcgtgagccaccacactcggccctcataggcacttttggtattcttaatcagtaagcagacacaactcaaggaagagttacaatggactactttaacatcaaaagaaaggagaaacagctatcaggacaagctacagaaaccaaacacatcatgaaaaggttacaggccctgccaggtaagtgcagagagttctgcaaactacaaacgactaggtcagtcaggtaaagagcagaatacaatgggagcaaaaacaggaaagataaaatatatataatatagtaatttttaaaacgactgggagatactgctggcacatagtgggtagaaagagtggcagcaagaatcccacaatacacagtgtagtgcccacaactaagaattttcctgcttaaatgccaatagcagtccctttgagaaacactgcatatatactaatgtggaaagatgttggaaatatggtatgtaaaaaggatatttataatatgctgacatttgtattttttaaagctactgatacatacaatcatacatgcatagacatagtccagaaagaaacactagaaattggtaacagagactgcctctgggaaagaggccaagccacagaggtacaaaagatactctacttgtactatccgaaggttttcagtatgtatgttttctgaacacatatatcagaaaatatgcatcactttttaaaattaggaatttaaattaagacactggcctttaacttaataatactagcttacaactctcctatatttaagcacctgccttagccaagaaatttccccaaagtggttcaaacataaaaatacttctaaatacctttccctttcagaatcttattccttccttgctatgaatacatacaataaagcccttctttctaccactgaaactgttgctctgtacccctataaagaccttctttcaccaggcgtggtggctcacgcctataatctcaacactttgggaggccgaggtgggcagatcacctgaggtcgggagtttgagaccaccctgaccaacatggagaaaccccgtctccactaaaaatacaaaattagctgggtgtggtggctggcgcctgtaatcccagcaactcaggaggttgaggcaggagaatcgcttgaacccgggaggcggaggttgcggtgacccgagattgcgccactgcactacagcctgggcaacaagagcgaaactccatctcattaaaaaaaaaaatagaacttctttctaccactgaaactgttgctctttatgcctcaccactaagaaagtactgtccaccaaaatggacacattctgaagcacacaagcagcatatacagttattacagtatgctactccagacctcctgacctacctgtgtatgttcctgctgtcaggacatcatcagaaaccaaaacaggacctccacctatcttttctgcttgattctgtgtgcctactagcttatttctaaatacgaactcaagccagccacttatactctgaactttacccaggtacttccacctagcctgaaaagcatcagtgagatcagctttattctaaggacttgagctcaattactcaacattccatttggatatcaactggcccttggctgtgacctgttacacataccattttaattctgcccccatttttacagcacccaccttttcttgactcagtaatgacttctctttttctaaaacttcgatacgcattttaagtttcagattgtcttcagcaagactgttatcctacaaaaatgttaaagcagtgttttcaggtaacaagaaatttccagtttataaaaaagctggcaatctatacaattgtgtgtttctattcagtatttctttaatgatatgtagtaattataagaatgcaatacttggccagacacggtggctcatgcctgttaatcccagcactttgggaggctgaggcaggcagatcacaaggtcaggaaatcaagaccatcctggctaacacagtgaaaccccgtctctactaaaaatacaaaaaattagccgggtgtggtggcacgctcctatcatcccagctactcgggaggctgaggcaggagaatcgcttgaacctgggaggtggaggttgcggagagccgagatcgcgactccagcctgggtgacagagcaagactccgtctcaaaaaaaaaaaaaaaaaaaaaaaaaagaatgcaacacttataaaagtgtctaaaacgaatgaaaccagtcatgcattttcgacactcttacagaagacttccttattatgcttggaaaaatataaaaatatatttacaaaataacttctaattattagaaaaagaaacaactctttgaatctcttaaggaaaattaaaactcatttctcacttggtataggatctgcttccactgtctctatgcacataacatttgtcaaaattaatttacctggtttaaactactcaatctcattatttcattttcggcatctgtaaaaacagcaaatgaacttgacattaaaattatttagagtaacttattatcttcaatattaaactcagaaatgcaacccaattaaagtgtatataagcaccactggcaagcagtaacagttctgagtgaaacatatatttgtattcctgttttgtcatatcaaataaatcataatgtaaatgccagttaaaaaccacattaaaatccaagtctatggataagcataagaaaaaattgaaattgtattgtagatgagtcacaagttattgccttgataaaaatgctaatgacaaccaggtttcaaaatgaattgattcatttgagaagcaggaaatagtacatggtttaagattggaggaaaacaatttaaaagtagtattttattatgtatatttaaaccaccacaataccataatctctcaattatctaacgtgatttagatatgaatgctgagaaaaagaccattcaatttggtattatagatagatctataaaaagaagagggtacacaaaaaaacacagctgaaatcattgattcaacattcactcaggaaatatttagcatttactatgaggccaggtgctagacaaaaagctggtaaaatttagcccttgctctcgaagagcttacaattcagagaggaagaaaaactagtaagcacaggattataacatagtatgacagagcaagcacgaggtgctatgagaacaaacagggtaaacacctaatctagattaggaggagcaaatggggccaagaagtggcagtgctaggtacttctcagtggaggttaatacctgcactgaatcaatatactgagagtcggctaaaagagccatagagacactccacacagagaaagcagaaaatgcaagggtaacagagtgaagaggtaacattgctgctttaaggagctatagaaaattcaatatggttcaagtttagaatgtcaggagcatgggaatagttgaaactgaagagataggcaggaactagatcatgagagacattatcatgtctaactaagaaatttaaacatcatcccgaagttcacaggcagctataaagtactaaatgcaggggagtaacctgctttgcatttctgacaaattattctggctgcagaatgaaaaaaatagattgaaggaatcatggagaacagagaattttaaaagctaactcttcagctgggggcggtggctcacgcctgtaatcccagcactttgggtggccaaggtgggcagatcatgaggtcaagagatcgagatcatcctggccaacatggtgaaaccctgtctctactaaaaatacaaaaattagctgggcgtggtgacacatgcttgtagtcccagctacttgggaggctgagggaggagcatcacttgaacccgggaggtggaggttgcagtgaaccgagatcgtgccactgcactccagtctgagctacagagcgagactctgtctcaaaaaaacaaacaaaaaaaaagctaactcttcaacatttactattggctagacactatcctaaagagcggcagaaagtaactcatataatcctcattactaaaactacaaggaagataccattattatcccaaccctatagatgaaataaccaatgcatagagatgttaacctgtccaaggtcagctaattagtgatagagctcgattccaacccagtcatgtccttaaccactacgctattctgctccattcagagagctgccatagttaacataggcaaaaagcaattatgactggctgaagtaattctgtgtcaatggaatagaaaaaagaggaaggactaaggcagtgggtttgtcttttaagcacataaactcatctggatcacccaatatgataagtaagtaaatgtattagtcttatgtaagtaaatttattttttaaataagtaaacttattttttaaaacgtaagtacaattactttaaaatttattttatttactggtgtttggcctatttcatttagtactaattttctgtaacacagaatactggtacagtaactaaatatcatcatgagcatagaaaatggtggaagacctatggctctaagcactcagggctttgcttggatataggagatcgtttcaaacaggtaacaactgactttgaagaagaaaggctgtattccctaactggaggatgtgggctgtgatgagttacagaaagtatagcaatacctaatcctttttaataggaaattcctatttgcaatctattaactcttacactgaatccaaaccacacaattctacccaaatgacacacagtcatttccaggaatatgccatttccactaagtattcagttagtgaagcatctgtctctaaaaacaactactatgcaatgaaacagcaatctgaaataagttccaaagactgtataccagacagtgcttgttgtagtctgaacacttcttccactgatgcactctgggcaagaattctttccttttctgtcatagtatcactttgcttcacagcagaaggctgcaatttactacattccaatttcaagttttcacattcttccattatttgtctcttttccacatttagctgttcttgttctctcctcaaaatatctctgtcattttctgcagaagataattttttatttatatcttttattttatcctcaagttgttccatttttttggtagactccactttttctatttgtagaacttgaatagttttttgcatctcatagattttagagagatcagtttctataactccagagccacctagaacataaacacaaaacaatgacatcaaatgtcaagtaccaagaaataaacggtttgctatatacaactaagagatataagacagttcagaatttggaaagcttaaaagttaaattactataataaactaagtgttttaaaataaataagttgggggaaaatatttgaatcaactacataaaggcctatgtatcttagtttgaaagaaagtgataatatctctaatcatttattaccaaagtatcatcaccaaacaatgcaaagaaatctataaattataactatttaccacaaaggtaaaaaggacatttccattttcacagaattttttttttttttttgagatggagtctcactctgttgcccaggctggagggcagtggtgccatctcggctcactgcaacctctgcctcctgggctcaagtgatcctcccacctcagcctcctgagtagctgggaccacaggcgagcaccaccacgtccagctaatttttgtatttttagtagagacgggatttcgccatgttggccaggctggtctcaaactcctggcctcaagtgatccacacaccttggcctcccaaaatgctggggttatagccataagccaccactcccggccacagaatcttaaaagcagaggtgccactgcaaatttctggcagataagcagaactagtcatttacacttccttataacttagggcaagtttacagcactgtcctggtcttagaatgctaggtctatcatttagttatgtcatctaatatgttaaattaataaaactatcaactggccaggtgcagtggctcatgcctgtaatcctagcactttgggaggccgaggtgggtggaccacccgagatcacgagtttgggaccagcctggccaatatggcgaaaccctattgctactaaaaatacaaaaattagctgggcatggtggcaggcacctgtaatccagctacttgggaggctgatgcaggagaatcgcttgaacccggggggcggaggttgcagtgagccgagatcgcgccagtgcactccagcctgggcaacagatggagactccatctcaaaaaaaataataataataaagaaataaaactaataaccttgttgtaacagattttcaagttcttcaattcgttcttcatagtcacttaattcttctcgatgtcgtcgacttatttctgtcaatttctgttggtgtgcattctgcagtactgacatttcatgttgatggtcatcaatttcctgacttcggttctgttttagttccttaaaaaataaaaacaaagttattcacatttataatcaataaatttatgtaagctatatatttaactgttgtccaaaagtgtgcattattaaaaagaattctcagaacatgttaaggctgaaaagaatttaaacacagacccaaaattaggactattctgaacaacttcaccctttcctttcttaggtctcaaaaacagtttttctacttctaatgagggaacatcagcaagaaaaggctaaaacaaacgataagtaaaaatgtcttttccttaatatctgtgaccatgaacttctccttttcctaatgacactttctgccaataccagtgtcacccctctgaccaatctgtacctgctgttccactacttccatcctctcactcagcctttcctttcaccagtcttattgggactcccaaactgtcaacctggcgccttcctacccaagttgagcccactgtgtctctcgcaggaacctggatcttgagctgagtccatcgactagggaaactggtttgacgggaagcaccaggacaggtgccctctcaagagtctgtccactgggtcccgccacccagattcctaacactcttcccactcctatccaacctgaggccaaaacattcaactcctccttcaatcctgcggatggactaccctgggttcttccagtaaatcctcttttgctttacttggccagagatggtttttgttgcttgtaaccaagaatcctaatctacagaaaaattgatgctcttatggaaaaaagaaaaaaaaagatcctaatctataaattaacttcttacttatgtgccaccactgggctaagagctttacatttaaacctcaaaacaatcctacaagataggtattatcatggtctccattgataataaaacagaagtaacttgcccgagattagcatagcatgtaaataatacagccaggattcaaacacaggtctgatccggattctatccactctagtattgtaataataatgaacccaaaactaaaaattctatatctgacaataattttaacactaaaaataattcactgccacaataatatatgcaactaagacttttctttaaagaaataataattgacacaaactagcgaaattctaccgctaaggtaaaataagtatttccaatgcatgatattagtattttattttgtccatatcctttaactctaaaccttgaaacttcagcaaccctgcaattaggttttaataaagacggttttacaagatacaatagagtatagagacttacgaaagataagctccgtaataaatgttcaaaaccaaatgattctggaaagacagagatttttatatactttacataaataataaagaatattaaaaaaaaatatttttaaatggaccaggcgcgttggctcatgcctggaatcccagcgttgtgggaggctgaagcaggaggatggcttgaggctagaagttccagaccagcctgggcaccattagcaaaccccatctatacaaaaaaaatcagaaaaaattagccaggcatggtggcatgtgtgcctgtagtcccagttacatgggaagctgaggcaggaggatcacctgaacccaggagtatgaggctgcagtgacctgatcatgccactgcactccagccagggcaacacagtgagatcctatctctaaaagaaaaagaagtaccataatctatataatgataatgacttttataactgagacttttactaattcaggcctatgcttttaataagcagatttagatgtataactcccatcatcaatcaacaatttgacttaccttaatgatattttgtagtttacatatttcactttgatcagagttatctgttccttgtgctttggaagtctagatcagaaaaagagaattagtaaataattatactgattttcttgtcaacagaaagtcacaaactaacttcattacaagaatacttttgtaaaaagggggattttcacagattccgactaaagaatgccatggaccttttaaagaacctagtctaatagtgaataatacacaataaataaaagatatcatatttaagaatgtattaactaatgggggggacaacagttttacaaaataactaaagttaaggtagaaaaatttatagaatattttacttagcttgacaaaatgtaagggtaaagataattgagcagctttctaaaaggaaatttctttttcctttctttttttttttttttgagacagggtctttctctgtcactcaggctggaatgcagtggtgtgatcatggctcactgcagcctccacctcctgggttcaggcaatcctcccacctcagccttccaagtagctgggactacaagcacatgccagcatgcttagctaattttttttttgtagagatgggatctcactatgttgcccaggctggtctcgagctcctggctgcaagtaatcctcctgccttggcctcccaaagtgctgggattagacatgaaccaccatgcctggcaaaatcaaatgattttacccagaagatctctacccaatagagaataatctttggtttaataaataaataaaacaacttttggattcttctcattcaaagctgtatgttgttcatttatctttattaatattactatgtagcattttaatgaaccaaaagctactctaggactgaaagaaagaataaagtataatagaaaaaatacaggatttagtcaaaacacgtgtgtttgaatcataacttaaccactgtggcaatggattatatgacttaaacttttagtttcctagggctgggcacagtggctcatgcctataatcccaacactttgggaggcaaggccgctggatcacaagggcaagagatcaagaccatcctggccaacaggtgaaaccccgtcactattaaaaatacaaaaaaaaaattagctgggagtggtggcgggtgcccgtagtcccagctacttgggtggctgaggcaggagaattgcttgaacctgggaggcagaggttgcagtgagccgagatcccaccactgcactccagcctggtagacagagcaagactccatctcaaaaaaaaaaaaaaaaaacaaaaaaaaaactttcagtttccttatttataaaatagaggtaatacatctatctcataattattaacataataatatattgggataatacatatggaaacataaaatgtaatgcaaatattaatttttattacgtcttgctagaaaattaagtcctctgaacggtcccaattatgcctttttcaactttatagtctagtacaggtctgtcatggagtaggcattcaagatatgctgaaatgaacacaccaaaaaccattctcttccctatgaaatcttactctaacaatgtttcttaaaatgtgttccttaggttatcagaatcaccagggctatttgtttaaatgcagtttaaggccctaaaactggctaacaaattgatatccctgaaggtaccacagaagatctacaatactgccaagttctccaggtcatttcttatacatagaaagtttactgctttttggagataagatggacaaacagatcatcctctctaaagcttattttgggtactgagaatgtctagcaacttgtgaaagaaggagataattttaagtgggaagatttctcctttacataactagattacattcataaaaacacaaaaaataatctctttactcatgtaatttttttttacattgatgaaattaaatccaaataaacagtgttccagtttactccaggtctcatgtctacaatttccatagtatacaggttgagaatccctaattcaaaaatccaaaatctgaaatgctccaaaatctgaaacatttgagtgccaacatgatgccacaagtggaaaattccacacataaatatttaacgcaaattttggttcacacacaagttatataatattacttaaaatagtgtataaaattaccttcacaagtacctatgggtataaagtttatatgtaacataaatgaattccatgtttagacctgggtcccatcctcaagatatctcattatgtttatgaaaatattccaaaatctggccggatgaagtggctcatgtctgtaatcccaacactttgggcggcctgaggtcaagagtttgagaccagcctgggtaacatggtgaaaccccatctctactaaaagtacaaaaaaacattagcccggtgtggtggcgggcgcctgtaatcccagctactcagaaggctgaggcaggagaattgcttgaacccgggtggcagaggttgcagtgagctgagatggtgccactgcactccagtttgggcaacagactgagactctctctcaaaaaaaaaaagaaaagaaagaacaagaaaagattccaaaatccaaaatctgaaacacttctagtctcaagcatttcggataagagatattcatcctgtataaaatctgatatataagacaaaaaagggctccttggaagaaagtttacagccccaaatagcaaaatattaatttctagtgcatgagaaacaacacaaaatggtttatcatattttataatatcaattaccagattttcattttacatgtaactagagctagcagaaacctcagacaacatctaagcaagcggtttcaaacatggtgcctcggagtcctggtgtttacaccagaggagtctcagggactccagaagagaaggttcttggttcaaccacagcaactcaatttttttcctctcatgttttattaaaaaaaaaaaaaaggatctgttgcttttttttgaaaattttttccaaatagtgtacagaaagggaaactcagactaggagagaaagatgacaggaccaaaatcacttagaaagtcattggcagagaggccaggcgcagtggctcatgcctgtaatcccagcactttgggaggccaaggcgggcagatcacgaggttaggagtttgagaccagcctggccaacatagtgaaaccccatctctactaaaaatacaaaaattagccaggcatggtggcacgcacctataatcccagctacttgggaggttgagacgggagaatcatttgaacccgggaggcggaggttgcagtgagccaatactgtgccactgcattccagcctcggtgacagagtaagactctgtctcaaaaaaaaaaaaaaaaagaaagaaagaaagtcactggcagaggccaggcgcagtggctcacacttgttatcccaacactttgggaggccgaggtgggcagatcacctaaggtcaggagttcgagactagcctggccaaaatggtgaaaccccatctctactaaagatacaaaaactaggcatagtggcgtgtgcctataatcccagctactcaggaggctgaggcaggagaatcactggaacccaggaggccgaggctgcagtgagccaagatcacgctactacactctagcatgggagacagagcaagattctgtctcaaaaaaaaaaaaaaaaagaaagaaagtcactgacggaattagaatacaccttttctatttcctagtccagggttctttctgatatcaaaagctctacatacagttttttatattacaccagtaattttactcaaagttttcaaaaactctaaaaaatttttatctacctgagcaatatgcctccaatggccaacttcagactcaagtcttgaaacttcatttgagagtcggtttatttcttgttgggatgaaattatatcaccaaagtccatgtcatcgtcatggaaagctgaaggatgatgactaatcccataagcgaatgaagatgatgcagtggttgctggtacaccagctcctgaaggtactgactgagcagctgactgcagtttcagcaactgatcctggagtgcaatctgtctggctttaagatggctgatttctacctatatatttataatccaagttttagagaaggtactttaaaacaatcatattgactttttatagatttgtattaaaagacacaatacaataatttgtctaagattatccaatgatggtcctctatcaactgaatctaagtcttatataacattctaaccataacatttttatttaaaacacactcacaattaaagcataaataatgttacaaatagtagaaatatcagaattttgtatgttaactaaagcaatgaatttctcagttaaacatgggtttgctatcttctctgcatggagtagtataggcaatttcttagggttctgtttgtgattaccaaatcttaaatgatgagaaaatgaaagctgtgtccgtctatgcactggaaattttcttagaatatctcctgttacaagggtgttgtgtaactgattatggctggatgtaggcttaaaatgcaccatgaatctgaggtaactttgtattgacctgcacaacacagctggaagaatgctttgatttataaatccaatctttttagataagataacagtgaaacagtgagcccatggttattagcccatgaatcttaaaaagaaataatatactgaaagtggtcttagctttagatttggcaaagaggagccagcgaaaatctgacctatttaggaagagaacagttctgaagttctgaaattaccagcagttttgactaaaggcgggtaagtcatagcgcaaaagaaattataaacacaggacctaccaaaatgccacatccattcttgtaaaagattattcaaaacacaaaatcaaacaatatagacagaactgaaaaaagttttctataaagtagagtagtccagaagacactgccacaactgaggaaaatttgatattaggaagacagccaacaagtaacagtatttctatatgcataaagttaagcaagtagacaaaaaccaaacacatttatgttgtatgtcataacaaacaagtttttcatattggagccccttctcaaatggaaatttatagtactgtacaaatttcattcattttcccacaaatgacatgagataaattccatcttggagaatatgaacatcacaatgagggccgcacatagattcaggaaataacagatctatataatcatatatttcatcctcgtaaaaagtactaaaatccacatctttttcaaatgtagctatatttaaaaagctatcattatatgatatttatatcaacttgtagttatacaagtgcaagctgtaataacagatatttccaaacctgaatgcttaatgtgccctctaatatcgatagttaagtagaacataaaataccaaaattttccccaccagtgttttcaactgtgaggtaggcatcagaataacctgtggagcttttgaaaatgaccaatacaggttgagtatccttatccgaatgcttgggactagaagggtttcacatttcaggtattttccaatttgagaacattctcataaatgtaatgagatatcttggggatgggacccatgtctaaacacaaaattcatttatgtttcatatacaccttatacccacaggtacgtgtgaaagtaattttataaaatgcttttaacaattttgtgcataaaacaaagcttgtgttcagtacttatttgtggaattttctacttgtggcatcaaactggcactcaaagttttggattttggagcatttcgaattttggtaggaatgctcaacctgcaccagggcctctttccagtacactaagttagaatctcctaggtggtgtaaacatgtatatgcttttaaagtgtcataatgacacagctgtaaacccctgggtaggaggaactactgttctatcataatgtttataactcaatgctactcaaaatgtggtccacagacgaatgcagttgaatgctcactaccagtccagagcaagtatagcaatgtgaaaagtaaggtttaagacttttaaagcaatttagtagtaattttatatctgctgaacttttttttttttttttgagacggagtctcgttctgtgacccaggctagaatgcagtggcgtgatctcagctcactacaaccaccgcctcccaggttcaagcaattctcctgtctcagcctcccaagtagctgagactataggcatacgccaccacgtccggctaatttttgtattattagtagagatggggaatcaagaaaaaaaaaaagtagccttgtaactttaagttgaacttgaggacaggcacggtggctcacgcctgtaatcccaacactttgggaggccaaggcgggcagatcacctgaggtcaggagttcaagaccagcctggccaacgtggtgaaaccccatctctaataaaaattcaaaaattagccaggcgtggtagtgcatgcctgtaatcccagctactcaggcggcacgagaattgcttgaaccgggatgcagaggttgcagtgagccgagattgcaccactgcacttcagcctgggcgacagagcaagactctgtctcaaaaaaaaaaaaaaaaattatttgaacttgcaactttgccttttttagtattcattttatttttatagtaattcattttgtattgtattttatgaaattatcacttcccaacaaattggaaatttaagcactactttcaaaacctatgtatatctttaacgtgctatacttttatctttcaccttagcatgtcactaaaggaactagaaagcataggaattagaaagcatgacacctaaattttaaaaacccaaatataaagttatggtagaaatgaacacttagtcaacaaactgaaaaacatccaaatgatctggacaatataacaggaaatggttccattcaatgtaagtatttattgggggccacttaggtactaaacactaaagagaattcagtaacagcatgacacatgaggacacagactgtattttaaggattcagagtaacattaaattatataatatctactaccagcactgtaaagcaaagataaatcaattccaaagcagccatttcaaactaaaaaacccaaaaacatttataaagcaattatatgtaaattatcatatatttaatagtttttccatggaaaatcaagcacatgccaatacaacaaatattaggcttcataaaatcagaaattataagcaacagatccctaaagatattttatacaaaaactttttcttcttctttggaaagaaaaaaattatacttcacacaggttggtttatatatgtaaacttaataaagtttacattaccttacaaagttcttattaaataagggatatcaaactgagtcgaaaatcattaaattcatcaccttttcatatttttacagatctgaatatacctcgatttatattctaactctaaaaacatacctaaatacattacagtgaagtacatatgaagtaactgtgataacatttacctctttttgttgaagttgatttcggtaacttgtagattgctgctttatttgaatctctgatgcttcatgtttctcttctagatcagtacaaagtttcttaagcctttcattctagaaaaaaaaagtattttcaacaaaaagactgcaagtaaaacatgtaattagttatgtgcacagcattatgaaaaacgtactgctttccccccccaaaaatgtcaaatataaaaggtctcggacagaattctggactttaaaatatgcttttaaattaaagttaaaaatgcactgaccagccgggcactgtggctcacgcctgtaatcccagcactttgggaggccaaggcagatcatgaggtcaggagatcgagaccatcctggccaacatagggaaaccccatctctactaaaatacaaaaaaaaattagacgggcgtggtggcgtgtgcccgtaatcccagctactcgcgaggctgaggcaggggaattgcttgaacccgggaggcggaggttgcagtgagccgagatcatgccattgcattccagcctggtgacagagcgagactccgtctcaaaaaaaaaaaaaaaaagcactgaccatgtttatacagacagaatatgcataattctaaaccaaacagtgaaatattaacattttgctcagattgattttctgctaagaaaaggccacgaatcaatgtttccccatctttgtatacccagttctagcacacagcagtcaatacatgtctagtaaataaatggattacatgtttgaacttttgttttcttccccaaacagaactttttttaaaaagaaatctttctggttgaagtacagggaggaggctaaaatctcacataatttgcttgtctttcagggtccctgaaggacctcggaaaaaatccaatttgaaaaccactactagaactgtttgaaaaaagttaaaagtacacaaaatagcctaattcaatgaacctagacattacacactgtcttttaagatgttgaaaaacatgaaaaaaattactcaaattgtatgtacctaaatattaaattatcttaacctattatcattccttatttgaatgaaataataagaacataatggggcgccccactggctgctctgaaaagccatctttgcattgttcctcgtccgcctccttgctcgccgcagccggcagctttatcgccagagtccctgaactctcgctttctttttaatcccctgcatcggatcactggcgtgccctaccatgtcagacgcagccgtggacaccagctccgaaatcaccaccaaggacttaaaggagaagaaggaagttgtggaagaggcggaaaatggaagagacgcccctgctgacgaggaaaatggggagcaagaggctgacaatgaagtagatgaagaacaggaagaaggtggggaggaagaggaggaggaagaagaaggtgagggtgaggaagaaggatggagatgaagatgaggaagctgagtcagctaccggcaagtgggcagctgaagatgatgaggatgacgatgttgataccaagaagcagaagaccgacgaggatgactagacagcaaaaaaggaaaagttaaactaaaaaaaaggccgccgcgacctattcaccctccacttcccctctcagaatctaaacgtggtcaccttcaagtagagaggcccgcccgcccaccgtgggcagtgccaccagcagatgacacgcgctctccaccacgcaacccaaaccatgagaatttgcaacaggggaggaaaaagaaccaaaacttccaaggccctgctttttttcttaaaagtattttaaaaaggaaatttgtattttttattttcattttatatttttgtacatattgttagggtcagccatttttaatgatctcggatgaccaaaccagccttcggagtgttctttgtcctacttctgactttacttgtggtgtgaccatattcattataatctcaaagcagaaaaaaaaccttgtaaaaaaagcaaaaacgacaacagaaaaacaatcttattccgagcattccaataacttttttgtgtatgtacttagctgtactataagtagttggtttgtatgagatggttaaaaaggccaaaaataaaaggtttcttttttttccttttttgtctatgaagttgctgtttattttttttggcctgtctgatgtatgtgtgagacaatgttgtccaacaataaacaggaattttgttttgctgagttgttctaacaacaacaacaaaaagaacataatggggcaaaagaaatggacactaaaactctctacaaaaaagaatttacaaataattgcagataacaatttactaagcattctactaatatacccacaaacacggtttaacaacaatgaatgagaaaaagaagactgatagtgagaaagaaagctcttgctaaaaggtgaagactttttcactttggggatgtcatttgttttcttcttagattctaggaacttctgatgtcaacagatgtgaaaataatgatccaggaagattacataaattcccagagaaaaccaatggaataatcaaaggaataattacagcatccacaaatcctagtttgggactctatccccagaaatctaacacagaccttaattatcctgaagaactagtagtaagaaacaggaccaatggtcccaacagctgattaccttctattctactggctgcttttgcatgactttctgtaagctgtttatatgaaaaacaccatacataactcagcgatataatatactgaagtcaaaccctggttataaaagttcacttcaggttttttttcacacaaaaatacctaaggttatttatttaactctgattaataaatagaactgtgaaactttgaatatggtcaatatctacttggttgtctgccctcatctccatagccatatgagagtcagaaagattgagaaagggctaggcgtggtggctcatgcctgtaatctcagcactttgggaggctgaggcaggaggatcacttgagcccaggagttcaagaccagcctgggcaacataaggaacaaaaaatacaaatacaaaattagctgggcatgttggcttgcacccatagtcccagctactcaggaggctgaggagggaagactgcttgaacctgagaggtcaaggctgcaggggagccatgatcacaccactgcactccaacttgggtgacagagcaagaccctgtctcaaaacaaaaagaaaggctgagagagcaaatgaaggacagtttctcttcatgtggccgaacccataaaatatgaaaagagttgccagagataatattttctattatatggaatattgaacagagggggctggtctgaaaggagaaaagaataaatgcatagaaagaagaaaagagagtacaaatgaaaagagagacagactcctgatggcctccagttctagctgcagtccttctaaagtcagactacatttctgctattgaaatccataggacactcacatcttaaaatattccgtcctgcttaatctttggttataccattagggtccactgaaatcaacttaatttcttttttaggcagtcctaactattcgtaaaacttgatatttatgatttttattctttctgaggggtctaccaacaaagagaaaatttacctattttcaaaaatagaataaaacattctatcttacaattaccatagggtaccgtggatctttttataaatctaagaaaaatcatgggagcaaaatcaacttgtattttctgtatcttaaaacatttggctcttttactatcatgggaattttaaaaaatcatttaaaaaattattcccaactattttaaaaatgacaataacaagaaaacggaaaacttatgaaatcacctaggagaatgatgcaatggtaaaataaccagttttctgactgcattgcccaaagtattatttttttttttttttttttttttttttttttttgagatggagtctcactctgtcacccaggctggagtttactggcacaatctcggctcactgcaacctctgcctcccaggttcaagcaattctcctgcctcagcctcctgaatagctgggattacaggcacgtgctaccacacccggctaatttttgtattttttgtagagatggggtttcaccatgtcggtcaggctggtctcgaactcctgacctcatgatccgcccacttcagcctcccaaagtttacaggcatgagcctgtaatcatggattacaggcgtgagccaccatgcctggcctatatcatctttttaaaagaaaacagctgtctacagacaccactttttgtagttttgttttttctctttcatcgaacacagttaaaaactcagaatttttaattatttgatgaagagaagaaaactgacaaaggaaaacattcacaattattagacaacttagaagattaatgcagagacagaaagcagcatcctagagtctaatggttatggtgaaactgactgtagaagtgaaatcttacacaaatcttcagatggcaatatcctggaagaattttctaaaagtcaagaattgatgagtgggccgggcgcggtggctcacgcctgtaatcccagcactttgggaggccgaggcgggcggatcacgaggtcaggagatcgagaccatcccggctaaaacggtgaaaccccgtctctactaaaaatacaaaatattagccgggcgtagtggcgggcgcctgtagtcccagctacttgggaggctgaggcaggagaatggcgtgaacccgggaggcggagcttgcagtgagcctagatcccgccactgcactctgcactccagcctgggcgacagagcgagactccgtctcaaaaaaaaaaaaaaaaaaaaaagaattgatgagtgaataatatatttttaagaacaaaaaagaaatatggctttcagatcaattagtcattcaacaggaaaatacttcactctgcattattttgtgacaaggacttaaaccatttcattttgctaagcagatacatgacagtattctttttttatttttattttttattttttttgagagtctcgctcttgttgcccaggctggagtgcaatggtgggatcttggctcaccgcaacctctacctcccaggttcaagtgattctcctgcctcagcctcccaagtagctgggattacaggcatgtgccaccacgcccagcgaattttgtatttttagtagagacagggtttctccatgttggtcaggctggtctcgaactcaggtgatccacccacctcggcctcccaaagtgctgggattacaggcgtgagccaccatgcctggccatgtgacagtattctttcatcatgtatatttgtacaccaacatttacttgatatgttcatatgtagaaggctgaaagcaggtgtgtacacaaaggcaactgggaggaaacagatgacacagaaatgaaaaaaactcagtggactgatcattctaattggcatttataaatctaagaataaacatgcttttgaaattatagagcaaagatgacagccatcatctcttcaataaaatcatgagccattaaaattttcaaaagtattgcttttaatgacacaatcaagaaccaggctgggcatgtggctcatgcctgtaatcccagcactttcagaggccaaggtggaaagactgcttgaagccaggagtttgagaccagcctgggcaacagagcaagacatcgtctctacaaaaaattttatttatttatttatttttttatttacttacttacttacttatttattggagatggagtcttgcttaggctggagtgcaatggtacgatcttggctcactgcaacctccacatcccgggttcaagtgattctcctgcctcagcctcccaagtagctgggattacaggcgcccaccaccatatccagctaatttttgtatttttagtagagacagggtttcaccatgttgaccaagctgacctcaagtgatctgcccacctcagcctcccaaagtgctgggattacaggcatgagccaccgtgcctggcctattacaaaaaaatctttaaaaattagctgggtgcggtgttgcatgcctgtggtaccagctactcaagaggctgaagcagaaggatcacttgagcccagaagttcaaggttgcagtgagctatgactgtgccactgtattccagcctgggcaaaaaagcaagaccatgtctcaaagcaacaaccacaacgaaaagaactagaagtaataataacctgaaatctattagagaggtaactgaactttggaatcaatattttacaagataaagatattccaggttatacaattaagggttaaaaagcagttcactgaattcaaagaacattgcttattttgagtctttatgctttcaaaaccagaaaaaaattaaataaaaatttggatttgctgtatttaaattattaaaatgtctttttctttttttgatacaaggtctcactctgttgcccgggctggaatacagtggcaggatcacagctcaccgcagccttgacttcctgggccctaagatcaggtgatcctcccacctcagcctcacaagtagctgggactacagacacccaccaccacaccttgactaatttttttatctttattttttgtaaccggtctcaaactcctggcctcaagccatcctcccacctccacctcccaaagcgctgagattacaggcatgagccactgcgcccaatctagaccctaataatgaataaaacattaaaattaatttgctattcctgtatcctttttttctttttttggatggagtttttctctgtcactcaggctggaatgcaatggcgtgatctcggctcagtgcaacctccgcctcccagtttccagcaagtctcctgcctcagcctcctgagtagctgggattacaggtgtgcaccaccacatccagctaatttttttgtatttttagttagagatggggtttcaccatgttgtccaggcttgtctcaaactcctgatctcaagtgatccacccacctcggcttcccaaagtgctcagattacagacatgagccactgtgcctggctgctattcctatattcttaacttttttgtatccaaatattattatcattttagtgtttaaaaagctccaggttaaacagaattgcattcttaatattatacttagctgggcgtggtggctcacgcctgtaatcccagcactttgggaggctaaggcgggtgaatcacgaggtcaggagtttgagaccagcctggccaatgtggtgaaaccctgtctctactaaaaatacaaaaattagctgggtgtggtagcgtgcacctgtagtcccagctactcggggggctgaggcagaagaattgcttgaacccaggaggtggaggttgtagtgagccaagatagtgccactgcactccagcctgggtgacagagtgagaccccgtttcaaaaaaaaaaaaaaaaaattattcttaaataaatgtgccactgcaatttagtatgctgttagaacacagtaaactctggattatgataaattattgatactattatttctacatttggcagttttcctacttatacagaaatagagatgggaatattaaagaatagcaaactgcagtaacaggtaaatatatttttcatctacagaaggttgataaaagctcaaaaaacaatcaaaattaaacaagaagagaaaaaaagtgctaagcagtacatttaaaaagaaaggatcaaagtaatgtttgagtaaccttcatgacttcaaaaaagaaaaatctaagtagtctttgatttttcttacctctgatctcaagattgcatgaatggcttcaatttcctttgtcctagaatcaggtaattctgctacaagagaaataacaaatattgaatatttaatcaataccatatgaagtaataaataggtattttcaagaaaatatatttcactgagtttacacagaatagtaggctgatatgaaagcattcagaagaaacaaatcgctttatttccataacaacttttcactgacactaatgttcttcattgtcataaaagtcattctttttgcctatgccctgtatcttaggatgtctacctttaccccttagaaatgttcattagaattttgttgtgggaaattaagctttagaaattaaaactatttctctgtgggctaatgctgctataattttagatgaagcttactcaactggggctttaggccttatttctaactgtaagaattaaagaaagaggagagaaacacaaagggtggcttgccagttaagacaggtttattttagagaaaacaaacctgagaggggtgttcggctgagttaggttagaggcacactcttttccagactaagagtttttaaggatttagggtgggagaatttattagaggcttagactgcttctgtgtttttttgtagtgcttatctgggagggagagttgtgtatttgttccatttattctagagctgcaggcataccccccgagtctgctttagcttccctattttagtgcacctgaagggaaaggaatgtgctttctaaggcccactgctttactggggcccactgtatgagagtgaagtttggcagttacccaagagactttacccccacctccctttgtgcccgagcactccctctgtatgtgttttactgtctgctttttctggctgcttgtagttagaagagaagtgacttccttgaaatgcatgaggctagaaagggagctggaggtcaggtacggtggctcaccgcctgtaatcccagcactttgggaggccaaggtgggcggatcacgtgagatcgggagtttgagaccagcctggccaacaggtaaaacctcgtctctactaaaaatacaaaaattagccgggtgtggtggcacacgcctgtaatcccagctactcaggaggctgaggcaggagaattgcttgaacctgggaggtggaggttgcagtgagccgacactgtgctactgcactccagcctgggttacagagtgagactcttgtctccaaaaaaaaaaaaggaaagggagctggaacttaaagtggcactgtttgtctgagataacaacagtgctcctgctctgtcactaacttctgctctcaatactatcaaataataagtgacctataaacgaagaaaaatacactgagaacacttatttaaagtaacatagacacaatttattaaaaatgggaatgagctcagtctggttttctacattttcatctttattttttaattttcttggaaagggtctcacttcactctgccacctaggctggagtatagtggtgtgatcatggctcactgtagcctcaaactctctcgcttcagccttccaagtagttggaactacaggcacatgcgaccacacctacctaatttttttacttttttggagagatgaggtttcactgtgttgcccaggcaggtctcgaactcctagccttagggaatcctccacactcagcctcccaaagtgctgggattacaagtgtaagtcaccatgcatggcccttggttttgtacattttcatttaaaagtagagtgagagcccagcagtgtcaacatggcaccactaatgctgttagaaaatcatcatctggctggtctcggtggctcatgcctgtaatcccagcactttgggaggccaaggcaggtggatcacttgaggtcaggagttcaagacaaccctggccaatatggcaaaactccatctctactaaaaatacaaaaaaaaaaaaactggccagtcatggtggtaggtgcctataatctgtaatcccacctacttaggaggctgaggcaggagaaattgcttgaactggggaggcagaagctgcagtgagccaagatcgtgccactgcactccagcctgggcgacagagcaagactcggtctcaaaaaaaagaaaagaaaagaaaatcatcatccagagttagattttttttctaagtactagtatttttttcattactcacagctctttaatataaaaataacttatctggactacagtttattaggagtgtccaatcttttggcttccctgggccatactggaagaactgtcttgggccatacataaaatacactaacaatcgctaatgagctttaaaaaaaaaaaaatcgcaaaaaacctcattttttatttatttatttatttattttttttttgagacagagtctcgctctgtcgcccaggctggagtgtagtggcacaatctcagctcgctgcaacctctgcctcctgggttcaagtgattctcccacctcagcctccccagtagctgggactataggcctgcgccaccatgcccggctaatttttgtattttttagtaaagagacgaggtttcaccatgttggccaggctggccttaaactcttgacctcaggtgatcctgaggccctcctcaaagtgctcccaaagggctgggattacaggtgtgagccaccgcgcccagccagaaaaactcataacattttaagcacgtttatgaatttgtgttgggtctcattcaaaacccatcctgggccacatgtggcctgcagaccacaggttggacaagcttggtttaaatcaaaagaagcatgcagtaattacagtgacaaacactcttgtttagaaaatcaccaggtagggttacatctgtggttggttgtacatcttgcttgaaactatgaaaggactgtttaattgctactctgaagaggacaagttataatctaatttgtttaggaaggtaattgttaaaagcagcaactattttaaagagggattttacaagtccatgcaaactccacacctcccccaacaagaaaaacttggcctttttaagtacaaaggggagatattatgcagacaaaaatattctgactttgtcaataagggcaaatatgacatttaccattcattaatgtttacgattcggtagacacaattccaggcattttacactcatgatttcatttaatcctctcaacctcacaataggtatgattatccctattcaacatataaggaaactgtgcttttggaggttaatttctaataatttgccaaaaatcccacaacttgtaatgcacaaaagcagaatttcaacccatgtctctctgatttaaaagcccaagctcctaaccttgaataaatcagtagtgttaggtaaaactgcaaccttctgatattgtaaatatggatggctttcaagttgtccacatagtgctattttggaactgttttatttttcattactgacacagggtaaacactaataaatacttgttcaatgaataaaagaactgtactctgaccctccattccctttatttttttagacagggtcgtctctgtcacccaggctggagttcagtggtgcaatcgcagctcactggagcctttaactactgggctcaagcaaacctcccatttcagcctcccaagtaggtgagactacaggcacatgcagccatgcccagctaaaaactttttgtagagatgagatctccctatgttgcccaggctagtcctcaactcctggctttaagctatcctcccactttagcctcccaaaatgctgagattacaggtatgaaccacacctggccagacccctatttttaaaaatttacaaaatcaataaattaggtgttaagcaagtccgattgaaatacaaaggggaaagaataaaggcattaagcaactttgcagatttctaatcacgcacttgtgccatttttattgagcatctactatgtgccaaaaggaaggtgtcacatatttggtaatataaggagcaaaaaaattcagtcctcacgctgggcatcaggaaaacagataaattataactcaacatgttaaatgctgtcagggagagatccacaaagttctgttagaacacagatcaccaacattcaactcaacaactcaacctgtgtgggagtcagaatggttcaccaagtacttaagtacctgacatatgagcagggttgtacaggagaattgttttctgggtgaaggaggaaatagagaagaaagggctttccatgtagaggcttgaagttgtgtaagtgcctgacaaaatcccacacgacagaagctgtgcgtacaagcaagcatatatatgtgcacatgtacagcaactggtatggcaactagaaaaggtacattgaaggtcgggtgcggtggctcacgcctgtaatcccagcactctgggaggccaaggcaggaggatcacctgcggtctcaggagttcgagatcagcctggccaacatggcgaaaccccatctctactaaaaatacaaaaattagccaggtgtggtggcacacgcctgtaatcccagctacttgggaggctgaggcaggagaattgcttgaacccgggaggcgaaggttgcagcgagccgagatcgcgccactgcatccagcctacgcaacagagtgagactcagtccaaaactaagaggtttggattttattctgtaacagggtcaagaaatttttacgcaggtttgtttttagaaagtaactgacaatacaatagaaaatggactggggtagggagaaatgggtgacaggacatgaaagaggaatagtccctgggaaagattatagggatctaaagaataaggagtaataaagcaaaggacaattctggcataggataaacaagatatcatgaccaactggaagtaggagatgaaaaaagacataaaacaaggacacgaagatttacagtttaggaaactgagagtgaagctattaagaatgagaaaacagcacatttggcaggagaacaaaatgaacaccaccttaaacctggaagacatccaggttgagggatgcatattctctggcttagggtctaaggaacagccaaccgttttcccctatctaggatacaaggagcgaccagtcatttcccatagttatccagcccttctgtgcttctgactgccctcaaggtcccatgctttcccccacacataaagaagccctttcatttctatccccaaagctgtctcactgatgcacctttatggcatggggaacgtaaagcggtaaaatggatttcggtagctccccagtctattcttccttccatctaaatagaccccacagaaattcaaaacataagcattatctttctatcaaacaatctttcccgatttctaccaaataaatatgaaggatctgttaaattagcaattaaaaaaaaaaactaagccagaatactaatttattaaatttatttataagaaatacaattgtcaaagcagcagctctcacccaaaagaacagcccattatctccctggagcagacttagattgaaacttaaaaactgttttgatccaaacattgcttactaaaatgccaagaaatcaaaatagtaattaatggatagtaactaatgtagccattgattaccatgtaactctgggtcactattcattagtaaaacgagattgaggacttcaaaaatgagtgaagattgctaagggtaccttaagaatagggttgtcttccctattctactgtcgaaatatgggcgaaatgggcgattatacacaaaaatacattctcagctggaacgctataatgtatcatcacaataaggaaaagtaaaaaataattaaatagaaaaacatggccgtgtttcataacatactcaagacagaaaagagcaaaactcaccaagtgtttaaattatgagttatttcaactgttacaaaaatagaaaacagatatacaattctttaaactgggtcagaatacaggaagatgttaagaatgagatcagcccccaaactgagggcaaagtggtgggcgtggatcaaccaaacgaaaataaactcgacttaacgtaggagcagtttcactctactgtactttgagatatccagaatatttaaagagaggagaaccaggactcttcccctggcccccagtggtctttcatcatagaaaatctgttgagaagaggcaagaggaggtgtgtgaagaaaaaagggaggagcagcattcctttgcgacctgtccgcgtctcctgactgatggaagtagggaccaaacggacgttcccagggtcttagaaaagccctcccttccctcgctccagctgttaccttccacttcctccgtgccctccatcagcatatcctttgtaaagtttgatatctggccagtgagggaagccaggctgcccccgacttgacccagagactggcccaatccggagccgaggcccccaagccaggacgacatcgcggcgagtttagagaacgacccggtccgctcggaaaaaagaaaacgtttagcgccgccgggcgatccgaccaaatatccttgaacgcctgccttcgcgagacaggatacgataacacaaagctgggttctcaggcaaggccgactccaggttctgcctagaaacgcagaggcctggcctggaattttaccaggggcccgcctctagtgacacagtcacctacggagggccttctgctcattcccacgaattcccaccgtccagattgggccacttctttctcagctctaatgactttcctcagttccgtgggttactcctgccaactcgacgccggccgccatgacactcgctcggaaagcggcagcggatcatagaaaagcgccgcggtggcgtagacaggccccgcgaagccgccggacgtgtccttggcgcaagggaggctgggatcgcggaggaccgagcgcgggctggattaaccgcagccagtgcctagcgcaaggttaggtgcatgcaggcggccagcttcggccggggaaggaatggcctggataactggggcatcgcggcgctcctcggcctcctgcagctgcgtttcaaagcagagccgacccttggtgggtagtccggggaccctgcggaccctccttgtgttgttgaaacctagtgttttaattgggactacacccagcagtgccgggagacttggcggggacgttccactgcgcaggaagtggcttcaaataacttacacgcgtcactgtgtcgattagctgctccgtgacaggcactatggtaggagctgaggctacaaagatagaacggatgggttgcaaaaaaaaaaaaggaaaaaggaaaaaagaaaggatgggttgcaaattcaggtgtccaagcaggaaacacaccttccttctataggagaaatctcctctggtggctttatagctcacaattgaaaccctaccttctttaacatacgatgagcttttttcatgaagctgccctcacccaagtagttgaaaaacggacaaccgtttttcaaaatgactcgttagaagacagcagggcaacttaatagagaagtgccgtttagtgtcaacgctcctatggtattggcggcactagctatgcaagtgcccacacctccctcagtccttagttacccacactggctgtaacacacagagtcctaccttgcttgcttccttccctaaaggaagaaaggttgtcatgtgactttcaagcaattggtgcaggatacgtggacacacagcatctagccagggagacttccacattttttggtttcaaaaggatatgatagatctgcagttcttttaagcatagcaataagtatactggcatctttcactttgattatattcacaagaggggctatcacagattgcacagtttgtgaacagaacattgggaatgcctccagtatttgggatctgatggcaccaggcagtagtaattctccgtgaaagctgaattttttttttttaaattttattttttgagatggagcctcgctctgtggcccaggctggagtgcaatggcgggacctaggctcactgcaacctcgtctcccgggttaaagcgattctcctgcctcaggctcccaagtagctgggactacaggcgcccattcttcattttactaatgagaaaccagtgcccagaaatgttaagtaacccatccaaggtcatacagctagtaagtgacagacccaggcagtcaggcgttggagtctgcacatctaaccgctgggctgtgatgttcacatgaatgcagggacagcatttaataaacacttccagaatgagatgtgaattttattttaagcacattcagatatccagtgtgactccgggatgtaaaaaaaaaaaaaaaaaaaaaaaacagggccgggtgcaggggcttacgcctgtaatctcagcactttggaaggccgaggcaggtggatcacctgaggtcaggcgttcaagaccagcctggccaacatggtgaaaccccatctctactaaaaatacaaaaattagtgggatgtggtggcaggcacttgtcacgggcatccgtgtgaagagacctccaaacaggctttgtgtgagcaataaagctgtttatttcacctgggtgcaggtgggctgagtcccaaaagagagtcagcaaagggtgttaggggtggggcagttttataggatttgggtgggtagtggaaaactacagtcaaagggggttgttctctggcaggcaggggcgggggggtcacaaggtgcttggtgggggagcttctgagccaggagaaggaatttcacagggtaatgtcatcagttaaggcaggaatcagccattttcacttcttttgtgattcttcagttccttcaggccatctggatgtatacatgcaggccttggctcagaggccagacattcctgtcttcttatattaataagaaaaataaaacaaaatagtgttgaagtgttggagtggtgaaaattttggggggtagtatggagagataatgggcgatgttcctcagggctgcttcgagcggtattaggggtggtgtgggaacctagagtgggagagattaagctgaaggaagattttgtggtaaggagtgatactgtggggttgttagaaggagcatttgtcatatagaatgattggtgatggcctggatatggttttggatgaactgagaaaccaaacggaagacacaaggtccaaataagagaaggagaaaaacaggtattaaaggactaagaattgggaggacccaggacatccgattagagagtgcccaagggggttcagcataattacttgcttggttggcaagtttttggactctgtccttgagtttttttatattgtcatacaccaggccagattgatttaggtaaaaagaacactcttcatttaaaaatatacagagcccggccgggcgcagtggcccacgcctataaccccagcactttgggaggccgaggcaggcggatcatgaggtcaggagatcgagaccatcctggctaacatggtgaaaccctgtctgtactaaaaaaatacaaaaaattagccgggcgtggtggcaggcgcctatagtcccagctacttgggaggctgaggcaggagaatggcatgaacccaggaggtggagcttgcagtgagcagtgagccgagatgcgccactgcctgggtgacagagcaagactccgtctcaaaaaaaaaaaaaaaaaaaaaaaaaaaaaatatatatatatatatatatatatatatatacacacacacatacacacagcgccttcctttttcagcagtgagtaagtcaaggccttggcagttttggaggacaactgcagccagagagtcaacttgggcctgaagtactgataaagtttaagatatgtctgtgatgctagtggagaagtcattagagaggctatggaaggttgtgacagaggttgaaatgccttctattccagtaccgagagcaatagaggaggcagaaagtcctaaaccgacaagcaagggaattagtggaataacccttttttgtcatgtcggtgtcatgagaggaacaggaagctctttggtcccatttgcaaattgaattttgggattaaggaaaatgagtgtgcatgtgcctgtccagttagcaggtagacacatgtaggtagaggatccacagaggaagaagagagcttgtgccaggcaaaactggaaatgcaaagtaaaaagatgagaaggagtgctgaaaggggtgtcttgtacccagactcctagggatccagctagggcggcagccgtcagaggttgtaatggggactgatggggtaactgtgtagagggagaggttcaattttcatggtgtatgagaaaacgtcgagtgtctatgagcaacctttcactgttatttacggggctgggtataacaagaaggcctgggaggagggtctgacgagcaaggggaaggtagccaaggatggagtgaaatacagggtgtcttcctaagcaataattacttctaatgtttttaagtttgcctgtattgataaaaggcttatctgtaatacggagctggaaggctccagttgtttcagtgatgtgtgtagttgggctttggagatgaagagtgaatgaacatcaagaaggtgaaaggttacccaggggaattccagtgggtctttgctgagagatacataaaggagcagccacaggaaaagtagtttgtgttgtgagggatccaaatgtggggggagtagagttgatataaggagaaaggttttttaagtaagtgtggaggagggcggcagcttgctgatgtgaaatgtctggggaggccttgctggacctgtctagaaagtgaagaagttcttcaggagggtaaagatgagggctgttaaaggaaatttggaggtgtagggagacaggagatgttgcccagtctgtatataaggcgggggcagctgtgtaggtgcaggaagaaagggaaatgcaaagccagcaattattcgctaaggagggattagaaacggctaggagagagtaagattgatagtgtggtggagatagctggggagaggtagagggtggcataagaatgggaatgagaataagagtgagtataaaagtaaagaatagaacttcatcagagtgaaaatattggaggttgccctgccagcaaatatcatctatccactctaagagggagttaagagtggcggtttggggatagcaccaggagataccagctgtgatggcttagagaaacagtgtaaacaggcaatgtaaacaagattagggcatttatgagtagttgagaatagtgaatgggagtatgagtaaacagaagatagtagggatgacaagtttttggggttcagtccaagtagggggggtgactgtgtaaagccctgttgcaaaaagtagggtaaggatgaatagagctaatagaatgaagggatgtattaggctcataagggttattactgttcttcagaaatgagagtgactttaagggaagtagtggggagtacttgtgacttccaggaggaagaagagagattaggctggttgtccgatgggcacagctttattctggaacggtgaacccagtggggaggatcctgcaggcggacggcagttggggtactatagatgactaagtagggtccagtccatcgaggttgtagagtttgaggggtcaggttcttaataagaactgatcgtccagctagggtgtcttcatatagttgggaatctggagtagacaagagaagattagcagcctggtggatttcctgtctagcctgccagaggactggaagatagtcgcctagagggctggtgtctggaacgaggttggggctgagcaagaaagtgcgtccatataaaagttcaaatggactgtaccctgtagcttctcgaggacgggctctaattctgtgaagggcaagaggtaaaaatactgtccagtcctttttaagttggaggctgagcttggtgagatgtctttaaaagaccattagtccgttctacctttcctgaagattgaggacggtaaggggtatgaaggttccactgaataccaagagcctgagaaactgcttgggtgatttgactagtaaaggccagtccgttatcggactgtataaaggtgggaaggccaaaccgagaaattatttctgacagaagggaagaaatgactgtggtggccttctcagaccctgtgggaaaggcctctacccatccagtgaaagtgtcttcccagaccaagaggtattttagtttcctaactcagggcatgtgaatagagtcaatttgctagtcctgggtgggggcaaatccctgaacttgatgtatagggtagggagggggcctgaataatccctgaggggtagtagaatagcagatggaacactgagaagtgatttccttgaggatagatttccatgatggaaaggaaatgagaggttctaagaggtgggctagtggcttgtaacctacatggaagaggttatgaaatgacaacagaatagaatgggcctgtgaggctggaaggagatattttccttggtctaagaaccatttgccttgtgtgagaagagattgataggtggaagtttcagtcggtgaataggtgggagtgactgatgagaagaagaaaaactggccgtgagggacagaagttagaaagctagcagcttctttagctaccttatcagcataagcattgccctgagcgatgggatctgatgccttttgatggcccttgcagtgaatgactccagcttcctttggaagtaaagcggccttgagaagagtttttattaaggaggcaataatgatggaggacctttgcgtactgaggaaacctctttctgcccatataacagcattgtggtgcaggatatggaaggcatatttagagtcagtataaatattgacatgtagtccttttgcaagagcgagggctcgagttaaggcaatgagttcagcttgctgagaggtagtggaggggggcagagcggtagcttcaaggatagatgtggaagatactactatagcatagcccacctttgctggtgaatggcgattaggccaggtggaactgccatcaataaaccaagtgtgatcagggtgaggaataggaaagaaggaagtatggggaaatggagtgaatgccaggtggattagagagatacagtcatgggggtcaggtgtggtatcaggaataatgtgggggctagcctaaaacagtaaggtcaagttgtttggacagaaaggctacagggcatggtcctggctcttgtgtaagaattccaactgcacagccctgcatttcagctgtgtgtaatgaaaaaagggttgggatgagttagggagagctagtgtgggagcagcttttagggctgttttttaaggaatggaaaggggagtggggaaaggatttaggatttatgaggtcagctaggtttgcttttgtgagtttatataatggttttgttaggatggcaaaaccaggtatccaaaggcaaaggtatccaaccatgcccaggaaggaaaggagttgttgttttgtagaaggtgttggggtttgagagatcagtcagacatgatcagcagggagagcacatgtgtttttatgaagaattatactgaggtaggtaacggatggagaagaaatttgagctttggagggggacatccgatatcccttggagaataaatgttgaaaagtatcttgttgagaagattcaaaggaggggctacaaagtagaaggtcatcaatatattgaataaggtgagaagcgaagggatggaaagaaagtatatcatgagaaagagcttggctgaagtaatgagggctgtccctgaagccttgcggcagtacagcccaggtaagctgctgggactgatgggtgtcagggtcagtccaggtaaaagcaaaagaggctgggatgagtggtgtagggaatagtgaaaaaagcatctgtgagatcaagaacggaatagtgagttgtggaggaaggtattgaggacaaacaagtgtatgggttgggcaccacagggtggataggcaaaacaatttggttgataagatccagatcctgaggtaacctgtaagacttgtccggtttttgaacaggtaaaatgggagaattgtaagaagagtttataggttttagaagcccatgctgtagcaggcgagtgataacaggcttcagtcctcttaaagccagttgtgggatggaatagtggcattgagccaggtaagggtgattaggttttaatgggatagtaatgggtgtttgatcggttgccagggagggagtggaggtgtcccatacttgtgggttaaggttgggggatacgagaggaagaggcgaaggaggctttgggttgggaagaagggtggcaatgagatgtggctgtagtccaggaataatcagggaagcagataatttggttaaaatgtcttggcctaataagggaactgggcaggtggggataactaaaaaagagtacataaaagaatgttgtccaagttggtgccagagtgggggagttttaaggggtttagaatcctggccatcaatacccacaacagttataggggcaaaggaaacaggcccttgaaaagaaggtaatgtggagtgggtagctcccatatcgattaaacaggggatggacctaccctctactgtaagagttatccaaagctcagcatccgtaatggtccagggggcttccaaggcgatcaggcagcatcagtcttcagctgctaagctgagaagatctgggaaggagtcagtcagagagcctttggccagagttctaggggccctgggagtggctgccgggttggacagtccgatttccagtggggtcctgcacagatgggacatggcttaggaggaatcctgggctgggggcattccttggcccagtggccagatttccggcacttgaagcaagatcctggggtaggcagtcctggaggaatgcctggccgctgcagttcaggcatttggaaggtcttgtgtgctggagatgtggctggggtttgtctcacagtggaggcaaggaattgcaactcagaaatacgttactacttggctgcctctactctattattgtacaccttgaaggtgatgttaattaagtcctgttgtggggtttgagggccggaatctaatttttggagctttttctaatgtcgggagtgggttgggtaataaaatgcatgttgagaataagacggccttctggccattctgggtctagggcggtaaagtgtccaagggttgttgccaaacaggccatgaactgggttgagtttttatatttgatgaaaaagagcctaaacgctaactgatttgggagaggtcagataaagaaaaaggagcattacccttggctatgccttcagctccagccacctctttaagaagaaattgttgggcaggtaggggagggctagtcacagaaagaaactgtaagccagacacggtgtgaggagggggtgataaaaggattatagggtgggggaccggaggctgaggaagaattgggacctggctcagcctggtgaggagcagcctggggaagaggggagaggtcagatgagtccatagaaaaggaggattcaaaggactcggagcttggggtggagactgaaggaacagacaggagagaaagaagaaagatttgggatgagtcgcactgggagcagagactagggagggaccagtgtgtaaaagaatgcctggatctgaggcacctcagaccatttgcccatttttcaacaaaaattatctagatcctgtaggacagacaaatccaaagtgctattctctggccacttggaactactgttgagtttgtattggggccaagcggtattgcagaagaaaataaggcttttaggttttaggtcaggtgtgagttgaagaggttttaagttcttgagaacacaggctaagggagtagaagggggaatggaggacggaatgttgcccatagtgaaggaagtaagtttaaagagaaaggtagagacacggagaagggggtgggtgagcagccaaagcaggcgtccccgcaattgacttgccaccaagggaatgtgggtgaatgaccaagacaggcacccccacggtgatcagacaccaatggagtgtgggtgaataatcaggcagtcgtccctgcagtgattaaacaccaagagaagactgtcttcttgagtccgtgaccagcgccggaattttgggtccacggataaaatgtgtctcctttgtctctactagagaggaaaaagaactggaattggaaggacagggagattgaagggtagcgagagagggagattgaagggtagcaagagaggatggaaaagaccgcttacccgatttgaaattcatgagatgttccttgggctggttggtctgaggacccgaggtcgtaggtggatctcctcacggagtgagggcaaggacaggggacccgtctcctgaaggagtcctcctgtcccgggtcttcagcaccaaatgtcacacgcgtccatgtgaagagactaccaaacaggctttgtgtgagcaacaacgctgtttatttcacctgggtgaaaaagaatgagacatgtaagtatctgcgaaagagcaatccaggcagaaagaaacaaataccttgaggcagcagaatccttggcaggttagaaaattagaaggaaggtaaggatagctagtgcagaaaattagaaggcaggcaaggatggctagtgcagaaattaagtaattaacataaaagctatgtcctaaaagtttctcatgggggatttctttctgt

SEQ ID NO: 1334 - DNA, 606566 bp, Homo sapiens
ccagcttctggagggctcctgtattccttggcttgtggccacatcctccatctttacattgtattacttcaatctctgcttctcttgtcacatagtctactttctgaatctgattcctcctgcctcacttttacaagtctcttgtgattacactggacccatctggagaatccaggatcatctacccatctccagattcttaatcacattggcacaatcccttttgccatataaggtaacattcacagatttttgaggattaggacatggacatctttgggggccattattcagcctactaaagagaaaatttattttaaagatactgatatggctttagacatcaaaggtgagatgatagccatgttccaggaagagcctagaaacttcgttttatgtatctgccccgtctctgtgtctttattaatttctgtattttttggcagactgacttcttctgcaagtcagccagtatgtagaaacatgattgctgacaattcctgagactataagttatggtttcaatacccggaattgctcagctctctcaactctattccagatcctcaaagaaaaaactctgattggtgttcttgggtcaatgcctccttctctaagggtgtagccaaaggtatagagctcttccatattgcacaaaatgactgccagcaaggaggcatttcaagtcatgctcatacactgaaaaatagtcctctatgaaatatgactaattgttcaccaggaaattgagtaagaggctgacatttcacacagaaggtactagcacttagtcaagtgtttttcaaattgtggatatccaagaaatatttcctgaattgagttgtgaaatttctccaaagtgtcttttaatctataaggttttatcacctggagcctggaatcctgcaattagtctcactgtacctaccctctcccttgccatgccataatgttacagcccacattttggaccagaatttttcagtcgctttcttttcatcacagaataacgttcaaaccattgatgtataaaatgatggggctgggtgcggtggctcaggtctgtaatccagcactttgggaggccgaggcgggcagatcacttgaggtcaggagttcaagactagcctggccaacatggtgaaatctcaactctactaaaaatacaaaaattagccaggccttgtggtgtgtgcctgtagtctcagctactagggaggctgaggcaggagaattgcttgaacctgggaggcagaggttgcagtgagccgagattatgccactgcactccagcctgggcaaaaaagtgagaccctgtctcaaaataataaaataaaacaaaataaaataatgaaccccattttttcccatctgggacatgggaatattaatggcaatctcataaatgtgttgagattaaatgaatataagggattgccatactttccggcaaatctccaatgtgaatcctccgctctggttaggttggtttccaactggagcccaggcatttgtctcaattattctttcttttctttttttttttgacgtggagttttgctcttgttgcccaggcaggagtgtgatggtgcgatcttggctcaccgtaacctccacctcctgggttcaagcaattctcctgcatcagcctcccgagtagctgggattataggcatgcaccaccatgcctggctaattttgtacttttagtagagactaaaatactctctactggtcaggctggtctcgaactcccgacctcaggtgatccacctgccttggccttccaaagtgctgggattacaggtgtgagccaccgcgcctggcctgcctcaattattcttgcggctacacctttgtttttgcctgggactccaggcttggaaatgccagactctacctcctggcttctttagtcttgcccgattccttcaggtccttctaggctacaaatgttcattctttccttttattctaagaagattttgagtctgttctacacagagtctcagagcagattttttagtccaatttccaacccaaatgtgggaaaccatccatacgctgcctttctggtggctattttgcttctacttgaatagttttagtgttgatgagctaaacttaggctgcttgtccccattttttcaacagctctaattaaataactaaaacatgtaattatctttttagtcatgactgtcttgcttttttaataaaattttcagttcttctagaggaacaaagtagctgctcaaaaggcattgattatatttatgcctaaaattataatttcccaacattaatagttaaaccattgctaccatttttattttcttttattccagctttaccataccttggagaagatgacctgccattataaggcttatgattattgtcacaatacctacaacaggtttctgaggagaaagaaagcaaagaaaatcctcctggttcatgtctagtgatacttgcattaattttacttaggtcactttaggttgcccttacacagcatttgaatttttgtgaaaaaaaagttctgttgcaaaaattttattctcttctgtgatattcttttggacttttactattcatatgcaaatacatccataatctatatgcctggtttaatttttacaaaaattgatattagaacatgctatggtctgaatgttggtgtcaccttaaaattcacgttcgaaactaatagtgtgatagtattagggatctttgggaagtgattaagttatgaaggcttcaccatcacgactgggattagtgtccttttaaaagaggctcaaggaagctcccttgcaccttcccccatgtgaggctgcaggaaggtgccatctgtgaagcagagagcaagcccttaccagacaccgagtctgctggtgccttgatcttggccttcccagcctccagaactgtaagcaataagtttctctttttataaattaatcacccagcctaaggtattttgttatagcagcccaaatggactgagacagaccatatatgcttctctgtacttctttttaaatagacttaagaatatagcaatgacatctatgtcaatacacaaaatttaattatttttaatcatgtatcataatcagttattttctcctgttgaccaacacatatgttgtttccagttgattcttgtattctgattcctttaccttaaaagaaattaaaattgtaaaagaccactacatttccactcacaaattcacccactgttatgggctgaatttcatcctcccagtacatgtaggggccatccaggtaatgctctgagtaaagggaacttgagaatggtggggactgtggtatattagagagtacaggctccttctaaaagagcacccaagatgccatgattcagctgattattgtcatatgaaaacatgggtcttatattaccagatcttcaggttttttaaaagaagctagaaatctggaattagatgtgaaatctgtcaattatttatttatttatttatttacttttgagtcagagtctcgacctgttgcctaggcaggctggagtgcagtggtgccatcttggctcattgcagcctcgacctcctgggtccaagcaatcctcccatctcagcctccagagtagctgggactacaggcatgtgccaccatacccggctaatttttgtatttttaatagagatggggtttcaccgtgttggccaggctggtctcgaactccttatctcaagggattttcccaccctggactcccaaagtgcagggattacaggagtaagccactgtgcccaggctcaatttttaaatgttccaaattaaaaaaaaaaattgctggccaataatacccttttcctactggttagatatgacccacaggctaccagtttgcaacttctgctcaccggaacaagtaatttgtggagccctaggcaattatctctactccaaaagttcttaggatgaggatggtgaagattagatggcagcaaataagtgcacaaagaagtccaagtcatgttttaaactactgagtttttttttttattgcaaaacatttgttacagaaatttcagaaagtttttcccgtggtatctgccaacttctgctctgaattgtatatctaaacaatcaaactcaaagtgcattgtgaatccaataatagacctttaaaaaagaacaattcttctaaggatttatatatatttatagtgtcgatagatatgcataccgtggtccatccatacacaaagaaggaaaagatgtatatatattcagcaaacccaattttaaaaccattgtatttgtaggaattcatttaaaaatgatatctgaataatttcccccattataaactagggttagaacgtttacaaatgagagtctaggtcctatattatgaaatggctatgagtacagtatactgcacgtactgtttttacacagcggtagcagcaatataaactcaggtcagacgcagtagtgacaggaagcaggtaagtcttcataccatgctatggtactcttcttctgaatctctctcacaaagactctgtgttcaagtttagaattatgtggctaacaaatatacatgcatatatcattcagaacaagagtaactctgaataaggcgagtttcttttcccccctctcggttctcagtgtattttgtgtgtacactcaccaagtcactatcaagaatctgatcctgttggctctaaatcagaggtcccaaactattgcctttgggactgaatgctgctggcagacatgtttgtttggctaggacagtgtttggaaagctgaatttgaaggtgtttgtggtgggatgtgtattctgtcatgccttacttacaaaccctacttctgttgactttcaccagtccagttcacacatttgtgttttctggatccggcccctccatgtgtttgaatttgcagcctctcagtctatgtgcagatggctggttttaatgatgtgtgggaagctgcggtgaagatgtgtaggactcttgagatttagagaggcaaaaattggacgaggtcaatgtgaacaccagccggggtagaggcaggaggaggctaagttggtgggaagatcaggcctgggacaaagtctaaatgtttgcctttttccaagcggccgctgtttcagcttactgtgcgagggtcaacaaggtataaaggtaatgtgggcaagggtctgttggtctggtgaaaaagcagctagtcttagactaagagaagagaagcaagaagaggggagaaagaaagccgcacatccaggcacaaggctgaatttccccctttgccccataggcctcagccacctgtctcctccagaggaaggcatgggtcctgattggcactgacactctttacaaagcctatggacttctagccatacacatgtcttttcagtttccagcacacaaacattgtgcaaacgcacaagggcctgcaggtttaaggaggctggtagactaggtaaggtaaggaagggaaaattcacctcattcttattgccatctggattacctggtcaccaaaatcctctcttagatgacctgtagaaacagtcacgttgctttcattagcagtgatgagtgcaaggaaatcatcagagaaaaggtaacacaactaccttctgagaggaattaaaagaaaaaaattgcttttccttaattggaaccagcctttcttttggttgactccaatctgagagacagaatatccaacttgtaaaaagaagagaaagcttaggtcaatgcaggctgagaggaaagttttgtctactcattttaggagcagtcattttcaaaactgtgcaaattggctcctctctttaacagatgttgaatggcttctagtaatgatgattttctaaaagagtaaactctttagaaccacccagtgcttcatcagacacccaaacacacgcctcccacccccaaggtgaagaagccacaagacaaggagggaggtctcttgtcatatcattggatcacacattcacagcgatctgcgcacttctgcactatcacaaatggacttttcgctctcatctccggcttagcaatttgcacccagtagctctgaagaatcagaaatgtgtcttgcatatatcacagatgcacaacacctagaccttggcagacccaagaggtgttggcttgccacctctgggtcccatggctatacaacctgcagttaatactttatttcatattatttgttcagtgcttaaaaaaaagatttaaaaatcccttggttactttttttttgtttttaatttttcaaaactgaacataatccccatagtaagaagcccaactgtttgagtgaattcttaactggcttaagcgtcacagcaggcaatagtaaaatgttaagtgccttagaaaagtcaaaagaaatgcataaagcagtgcatgcattttgttgacacaaaattaagaccaggtttggagagagattacttcatttcagtcacattgttattgttcaaggatagtgagttataatgcaatatctaggccaaatatataaccacctacacactagtatcactttatctagaaacaacatagtgttactaaatgaacatatttataaaatactgtacactgcttctgcatggggttggcagatgtaaacagctaattcaactggagtttaaaatatcattttaagttcatttgtcatatagtcttttgcataacatgccagttcatctttcacaaaatcacaacttgcctaccacagctcgcaggactcattagaggatatacatcagcttacacacatattttacagtggtccaaaggaacatgaaaagcatcaagcagatcaggaacaaaaatgcccggttcacaaagatgctaaataacatggaattgggaacataattaatcattgcaacatgtgtttctttattgaatgttacagatttataaatgattataaagctctcctgtaacgttcattaatacaaccacatgctacaactacgctgggttaaacatgggttacatacatgtttacatgtgttttataatacagcattgcccaacatatgaatggtatagcctatagatagagcatgatggatgaccgggtaatatttatcatctttaaagaaattaaacagcccaaacattcaggaagattagactgtacagactcagaaagtaaaaaagtactatccagttatctaccataatattatctatagaaaccatattttagaatacatttgaaacattcagaagaaacacattttgtgtttttatgagtacatttttctcgtttgattattcttatatatatattttaaaaggggaactttcaaagtgctaaataatatcctagacctggaaacttatacatttaaaaaatccagttctgtaaagtgctgtattctgactgctaatacaccttttggcttgcagagataatacaaactagtcatgaaaattgtacccaagctttccagctcctcattcaaatctatcaaggaggggccctctaactataaatataaagtatattggttaagcaggagacctccatggtcattttcataaaacatccttaaatttttttcaaaaggaacaagcaatttagaacaaatcattacatatagtagtatgtaaaaattggcacctttgaagcagatgattaaaccgaagctattacttccttgagctctctatgactttatttacggtcctcagtaacttgctgctcataaactgcttaattcacaaagacaggtaattaacgtcccctcgatcagggatgtggtggaatcaatgggctgagcataagctgactgcacaaggccacagaatcaatgccacattgctgcacagagaacccagaaatggaaggaaatggactgaaaaataacacacatacatgtgcacaggaaggaaatggctcatggaagttacacagtttgtgtctacagtcatttaagtttggcttatatatttcacacgtttcacagacgttagaacttaattttcatgcacaacaaaagaatcaggtaattgcaagatcaggactgttgagtatttcgtttcccagttcctatccttttctctctgaaatcacgatgaatggaaacacttgagctgaaaatttctttccctcacttccaatctggcccagaatgaggccttggaggtgtttgatgtcaatgaataatgttttcacctccttcttggattcctctatagacccttcagggagacttcagcattgtgattgtgcttgatacttaaaatcatcaacatgttaggatgtaagtgcattaaattggcaacatctaatttaaagaacaaaaataacaaaatctttgttcaaactctggtgctgagatttggccttcctgagaatcacagagagatggtctcaaatgtaaagtgcctattacaactgcattaactacgagcaaacatggttcctttccctcataatcaatatagaaccaggggctcatgaaccctttcaagttatattgcaactttgcattatgtacattttttttttctttctggagagagagcctagagttatcgtagagcctcgtagggattcatgactcaaggaagtttaagaacgactgatttattctcagacccagtgcatgtttgctgagagggaaatagccagcgtggggcccaataaaatgttaagtgtttctagaacagctgtaaataagggagtctgggtgtttgttagcaattcacctaaatgccaaggagtgaaaaaggaattgtttaattctttacatatgtgacctcatcacaatttttatacctgaaatgcttattcagaagagtttttattttgttttttatcttatatttaaaggccatgtatttacttgatttcacaaaataaagtaaaacttggtgttttcaattataattaaacaaaagaaccaggtagtatctcaggccaggaacaatagattgttttccttaaaggctttattcttttttaaacgttaatgagccaaataggaatccaaagatttggggtcaagatttctttatcccacttccaatccagattctgatctagaagattatgcctctactttagagtctgtaacactagctggtttaaagttgcgtgtctattcagattgtacgtggtgtaaaaactttgtttaggaaaagcgagactaaatgagatgtcctgatagtgagtgatttcagacaaaaaagggcagaaggcgagcagtgagtcattttgacaactctagtttgatatgaggaaaagtcataggaatttaaaaaattcataatttcaacatttggtctaatagtataatgaactctttcaatggaacttcttgtatattaaaaaaaatcttgattatacttcaaggtgatagaaaagtccaagcctcttaagaaagctctttatgtccatttattttatatataaatatgtgtctctgcataaatgcatatacatgtgtataagtggcatatactatagaactctttatatggtttatttgctttctattttggtctactgtatctttttttatagctctgtctataagaaaaatattcatggtatgcttgcaactgatggctttgggttgataccaaactcccagtcaaatctaaggttatttatagttttgaaacttccttaaaaagtactttggaacatttccatagaaaagataccagcccttgaaaaactccaattaaatttatgctgagctcagattagatggcaaaactctaggtatgaaaatatccacatataaccatatattcatatacaaaatggtcatgtgatgagtggtgtgaaaaattggcagttacgtcttggaggtgttcaggaggacgtggtggagccatgcaaatgatgacggtcacacagcagcacaacacacgacatgaacggtgagaacagaacatcccacatggcaatttcaggctagttctgtccactgtttttttttttttttttttaagttcaatattacatattcagtgaatgaattcatccatgacaggtgagatacaaaataaattaaaaaatataaaattatttaattacattctcctgagcttgctcgactagacttgaacgcccactgtatataataaatcacttgacttttgtttttttaacatcaactcttctttcatttcgattgcaatacaaaaaggcatttctgttcccttattttcttcaaaaaaggataaacagttgtggcaccagaagtgaatagataagagacaggtgaactatgactgttaccttgttttttctttataatgatcaattacagaagtgttggcatgagaaggatgtgggacgttaggtagaactgcttgctgccggcttatactgaataaagaggatgctcttcatcagtcaccagtgatggagccaatgtgaaaagaaaacagaatggaagtttagaatatctcattgtgtacgctggctattttattttattttgcaatttagccctgcatcctacaactcttgataatggtcagaaatcaacagatgcctcctggcatggagcgtgctcgaagccccttgtttcccctgctctcatggctttctgctgtgactgcggatacacattcatctctaacccttccttctccctctcttccccctccctgcccagcaagtgtgaacatgccttaaatcccctgtgtctggcactgggtcagatcaaatgctttcttgatctgtggcccagaagtcacctttgagttaacacctcccaaagcattgcttgttttgctcagctaagaataaagcaggtatgattcaaggaaaggggaaaaactggagttggagagaattttagggctggattcttgagccttctgtggcggatattaagaaggtttagttgtgcttgctttcaaagctttggaaagccgatgttctggacagtctcctcatggacaggctgtcccctcggccctccggcttggaggacttgcttctctggaagggatttcgcaggcttgctgtgttccgctgcctgtcgagtttgtcactgatggagaagctcttcctggtgtgtgcatatggcgcacttggctcctctgccgagtagctgttggcgcgctctatcttgggaacagtgatgttgttggacagggttctctctgagttatcaccctcctgggaggatattgcaatggtggctctgcggcctttggcctcattctcctcactgtcagagctggggtgactcagttctgcttctcgctctggatggcagcaagttaagtcctccactttgtctccaagacctccagggaaggcagctctgtccgcaattgcttgaggggcattgacacaccttgtgtcaatacagtctgtaatacttgtgtattctgctgtttttacaggcaccccaaagttggcataatagctccttgagggggaaaacataaagctatgagatttcacaatgggagcctcttctagaagaaagggtgtggtggctaggtagcggctacttttggaacgctcaatggtgtggtacatcggaggctctgagtcccaggggttttggcattctgggaggtgggtgtagtctgaagaaaaagatctagtgtccatggaggtgatgtcctcaaaatcaatgctccggcttggaggtctgtctgtgggtgcaagtgttgcataggcactacttgaaggggctgtggaaggtactggagttgaaaagcttggctcgcccagcccaaggatgttcacggaattgtccagagggtctatatcacagtggagctcatccatagcagagacatagatgtctatacacgatgatggtcttctggaatcaggaacaatggccaaggtgttggcaggggctgcaggagctttgggttcttttgctacagagtgggaactagtagcccggtgtaggctcagggacctttctttaaaaatactttccaacttttctataccacctttgtctttcatattgaccgaatagaaagaatggcttcgcatacggggcattaaggttggagaagttggggacatggtctcctcacctgcagggtctatactctcttggagcttgaaggtgttcccttcctggctgttgaagctgctctgacggacaatgtaggcggcgtccgtgcagtctgacgaggtcctcgagcggattttgttggactcggcccgctccagacctgtcaggcgctccagggccgtggccatgcgcccgataaggtcttccagctgcgccagccggatgtccacggtctggagtgaagccttcatggagtgctctctctcgttgacttcctccagccgcatagacatgttctccaccctgcgcgaggaagagagaatgagagtcactcggcctggttcctctgctggggctttagagagcaaggataaagggatcacagctgtgcctgaccttggtaccttcaatggaagacaggttacaggtgttgagaggggttggggaggagagaatgacattgatgctgtgaaagaatcacagaattcaaatctttttgagctagaagaggctttagagattatctaatccaatgattttttattgttttagctatcaatccccttttccctcaatgaaatggaatgcacagtcctgataaaaaggcactaaaatggaacagttcttattgaagtagagtggggccaagtccaccatggcctagctgtggcttggggcagggtgcaatgacctgactaagcatccagttgttggcttctcagggtcccccacaaaatgagaatgttgcattttgaggattttacccagaattttgcaatgaaattttagaatctagctatttttattgcaatacacatgtaaaatgagtattccatggatgggggttatttttattttgcatttatacaataatttttgttattcatgataatctttttagaatgttgtgtctccaaaggaattaatatggcccagttactgaggcatccaggattgatctaatctaatccaatcccttcattcataaaggaaaagcaaaaattaagaatttaaccaagattgcataaagcaatttgttgtaaacattggagtatctgtcaataagtcaattcttctactcctctctctgtctctccctctctggttagctgatcacagatgccttatattacagttattgctagaactctctatcctcccattggaaattcttttctttttaaaattaaattaaattaacttttttagagatggggggggtctcactttgttgcccaggctggtctcaaactcctgggctcaagtgatcctcctgccttggcctcccaaagtgctgggattacaggcgtaagccaccatgccctgccttttgttagtttgtttgagacaaggtctcactctgttacttaggctgaagtgcaatggtgtgatcatggctcactgcagcctcaacctcccagactcaagcgatcctcctggctcagcctctctagtagctgggactataggtggatgctaccatgctagctgttttttaaattttttgtagagacaggggcttgctgtgttgcccaggcttgtcttgaactcctgggctcaagtgcttctcgtgcctcagcctcccaaagtgctgggatcacaggtgtgaaccctggaaattcttaggggcatggtttgtctcatattcctgttttcatttctatgtggccaacctaatacctgccaggtgtcaacaaatgggtcaatgacatttacgaacttgatttcaattgtcactcagtctgcctggccatttaagacagaggccacatattaaaaataaaatcataccttatttttcacttgctcaaattaacttggaaaggacaaaccaaagccaagttacaatttgagctcaaactttcacttttaaatgtccaaagacaaaccttttggtgaatttaaatgagacccatgcacaactttgctgaagaggattaaagttactttttccaatccttccaatatgcaaagtaaatcatttgactgctgattcttaaggcacttgctgcaggaagaccatggctacagaatatgcttcacagtgaatgtgggaattaggctgggcccctgcagtctgtgggggtggtggtgaggttttaatgacagcaacacttctattagggaagcacatacacttcaatgccagaagcaggttatataatacaagaggcatgtggatctctgggagacctatagacttcttaaaaacctcctctcctgctggccaggagcatgggggtgtgactcccctgccttggggcacatttctgcctctctcaggaccccccaccccgactctgcttttatctttcagcttcccttcacccagccaaaggtcccagcctgccctcaagagccctgcttgtaattttttttttttttttgctccctcctgctgccccataaccaacccaatgcatctcaggggccaggcacactctgccaccatccccaggtgtattcccagaagacttgtacattgagctattctgtatctggcaaactcaacgccatgcactcagctgacacagctaattcagaaggaaaatacagcttttccctctttcacttcattctgtcctataaacatagcccaagaaacaaaattacttacaataacaagtttgtgtgtctcatagacttggaattactttttcactatctagcctatggagtttgattttgcaagtactgtagttaaattttttacaatgcaatctgttatatttatttctttatttatgtttgagacaagatttcactctgtcacccaggctggaaggcagtggtgcaaacatggctcactgcaaccttaacctcctgggcacaagtgatcctcctgcttcagactcccaagtagctgggactataggtgagcaccaccatgcccagctaattttttgaaacattttttatagagctggggtccactatatcgctcaggctggtcttgaactcttgggctcaaacaatcctcccgcctcggcctcccaaagtgctggtattacaggcatgagccactgcacttggccaataaactttgttaagtgtataaagtacttgttcattgaagtccagaggaggatagatcatgcatttctgtagcacgagatgttttgcttaacatactttaggtattgggtctcactagctctctagtgctaggagagtaataagaggcaggggaggtttatttctccttctccctttctctctggagcccagtgtgtacaatgttggtactgacagagatgaagttgttgttttgacctaaccgtagtcactggtctgagtgctgtgaagtatctccttgccatggcctgtgctgtggggtcttctctgtccacatcccacccctgaccttcagccccaggatccaacactatagagaaaatttgtaggtgagaggcagagctgatgcaccaaaaacacgtaacagaagagtcaggacctaaaaagccatgtgtccctatagccccagctactcaagaggctgaggtggaaggatggcttgagccctggagtttgagagtgcagtgagctatgactgtgccccagcactacagacagcctggacaacatagggagatcctgcctcctgttatttagtatttatttttattttattttttcctgagacagggtctcactctgtcacccaggctggcgtgcagtggcacgatcatggttcactgtagtcttgacctcccggggctcaggcaatcctccactgtagcctcctgagtagctggaaccacaggcatgcaccacaacacccagctaatttttgtacttttggagagacagggtttcaccatgttgcctaggctggtctcaaattcctgatctcaagtgatcgatcacccgcctcagcctcccaaagtgctgggattttcacaggcaggagtcactgcactcagcattggtccagaatcagaacctggttgcctggacgtaggcagtaaactggacacataaagtgagtagtagcccaaggagatgagaggaaagcagagaaggtacaggaggaagagtctcttcagggaaagagagaaggtacatggtgagagccccaagagtgaagaaggatggctgcagggcatggaaccaggggagggaggcctgttggaacagggccaagcaactattcttgtcaaaccttaactgtcctatgggctctgagatgggctgaaatgtaagacttgactaaaacaataatggactgttttctccattttctcccagaatgctgggtgtgttcaacaaacttaccatgaaatgtgtgatcacttaggtcatggacctagctgataggggtttaatataggggctataaaagaaataaaaagtcctagagtcaaggttacctgtgtttgtttcataactagactggttcctttaatctttttttttttttttttttgagatggagtttcactcttgttgcccaggctggagtggagtggtgcgatctcggttcaccccaacctctgcctcctgggttcaagcaattctcctgcctcagtctcctgaatagctgggattaaaggcatgcatcaccatgcaaggctaattttgtatttttagtagagatggggtttctccatgttggtcaggcttgtcttgaactcccgacctcaggtgatccgcctgcctcagcctcccaaagtgctgggattacaggcatgagccactgcacctggccttcctttaatctttaaaaaaatttttttgaggctgggtacagtggctcacacctgtaatcccaggactttgggaggccaaggcagatggatcactcgagcccaggagtttcagaccagcctgggcaacatgaggagacatggtttctacgaaaataaaaaattagctgggtgtgctggtacatgtctgtggtcccagctactcgggaggctgaggtaggaggatcacttgagcccaggagactgaggctgtggtgagcccagatggcgccattgtactccagcctgggtgatatagtgagaccctatctcaaacaaaacaaagttcaatgtaaatgggcaggtgtcacagatataaacaggcctgaggtatataccaagagttttgagtcatgattgtagtcactgagaactgattctgatcaaagaatttgtgggataaaaatggagatatatatggatgataaaaaatttatggataatttaaggagacagactcctacagtgactaagaaaaaaagaggcactgcagagaggaagagatgctatgagaggaactctttattgaaatttccctctttcatatctccagacctcgaatggctcatttctgaataactcaagtagtgatcagagcagggacacaatggagtgttggaaagctgttgggtgacccatgagagaaggcccagtgggtgggtgcaaaaccccagtaagatgatgactagcttcttcagccagtgagataaggaaaacagcattcaaaagaagattatggtggcacagaacattttggcttccacatgcaatttcttaagaattgttatgctattttatggaactttatctgcttttctgataacctcgaaatgtggtgaaaggaaatgtggtaaaataacagagtattggcaggccatgcctattctaaatttcagacattccctgagtgctggcagtggggtgcatgtaggatgagggcaaaagcaatcccgtattgcatgaactctatcctgttggaaaagggtaaacaggtttcaaatcaaaggcaatgatgcagaatagctaaagcaaactcttgcttatccacagactgatatctaatctatgaattattaagtcctttggggtcacctacccttccctttgggttaattatccttctcattaactctggggagaaaaagagaaacaagtttaaacttaactcagttaatggagagaccaaagatcagctttggaaaaagatacggtgggaggtggatgaagctcagctttttggcttacactgatttaaaaaaatattacttatgaattttatatatcctaagtcatttctctctgccattgttatgaaaaattataagttgaacatactattttttctgacttttattttaattaattttgtgggtacatagtaggtgtatatatttatggagtacatgagatgttttgacacaggcaagcaatgtgaaataagcacatcatggagaatgaggtaactatcctctcaatcatttatcctttgagttacaaacaatccatttacattctttatttaaaaatatacaatgaagttattactgactatagtcaccctattgtgctatcaaacagcagatcttattcattctttctatttttttttgtacccattaaccattctcatcccctctccaatccccgactacccttcccagcctctggtaaccatccttctactctttatgtccatgaacttaattgatttgatttttagatcccacaaataagtgagaacatgtgatgtttgtctttctgtgcctggctttgaatatactagtaatagctatgtttctgtcactttttggatctaggtaaaatgaaaaagggcaaaaaacttactgccttgggaaagaatactagattaaaagatgacactaggaatactgctaaatccttgcatttgcttaaatgttgccatcaaggagaaaattcaaacctcaaacttctgacaagtgaagcctggtaggtggggtgatggtggatgatctggatgctttcatcaagagtctgggaattaaatgcctataggcaggcagatcaagtatgtaggtacagcaggcaggatgtcagacgattgacgcagggactcactctgtggcagtggagagcatgccaagtccaaagacttattcaggatgaattttaacaatcactgcaagtccagcaaaacagccctgtgtgggcagatgctgcccacaagccaccgttttttgaagtatgctttcaatgggttaaaggaacccgaaaagaactccctactgtgatcaccagaaaatgtaggtaacccttaagaaccaatgggaaataaaaagaaatgccagaaaattggagatagataaaagcttttcctgatatttaaaatttctagattctagaaattatgtaaatttgacacaaattctgggcagcattataaaatggctcagtagtaggtaattaaacagacggtattttttgattgcttacaaaagataaggttagttaacaggagactgcatgagatcattattaatcttgccccttttctgataatcaagaccaatatattgatatagatgatcaatatctgtgatgtacattgtggttttagccaggagattgacatgcggggccacctggagaaatgtgaatacttagctggctaattaaccaaaggagagatggtagagcaatgagctgatgtcacgaaagacattttttggagtcatgcagtggtcctctgacttagttcacctgatctgtgcttgtgagcattttggggaaccatgtctaagatatagtaagtgtggttatcaaacaaacgatggcctaaaatgcataggatgaaaaattaatatactagatgaaaaaatcaggatccaaaattacttgaggtgctgaaataatgatctaaaggggggaaaaaaagaaaaattttatagtaatgaatactaagtcttgattctaggttagaacaaacatttcacaagaagaagtttgaggatattgagtcagttcatgtaaaaaagccctggttgaattcattgaaagtgtactctgaaccaaagatgttatttggttgctaagactagtaatataatcttatagcatacctaatgtgtaggtcaaaaataataatcatcaccatttattgaaagcataatacctcatatatgcccctcaataacttttaatactctatagttaggtcttaatactccattttatgaatggggacataggttaagaggagttaagtaaattgctcaagaggagttaagtaaattgctcaaggtcacatagctagttattgcagaattagtattaaaattttgttatactatattatgcacattatactgtgttctttccgttataccatggagagaactccttgtcctactctatatgtactagtcaagtacatagtaggtgctcaaaaaaagtaaatgaatggataaaggaattaaatctaggctctaacaacacagggaattgagtttaacttaggcaccacgtttaaaagatgttgacaatttaaagtgcatactgagaaagtgagcagggtagtagatgatctgctggaaagcaggataagcaatgaaatgatcttgggatatttactttggaaaagacacagcacagtggggagatgacaatgatcttcacatatgcaaaatattatttcagagagaaaagaattttaattttctttcttttttttttttttttgaagtggagtctcgctctgtcgtccaggctagagcgcagtggtacgatctctgctcactgcagcctccacctcccgggttcaagcgattttcctgccttagctcccacaagtagctggcattacaggtgcctgccaccatgcctgactaatttttgtgttttcagtagagatggggtttcaccatggtggccaggctggtctcgaacacctgaactcaggtaatctgcctacctcagcctcccaaagtgctggggttacaggtgtgaaccactgcacccggccttaatattcagagagaaaagtcttttcctgtattcattcctaagactggtagcataggcagtttcttctcttttccaggaggtgttcaaatcaaggttgggtgtaaccagagaatgcattctttcaaagtagagttcctatatcacctcctcctatgcaggccttgctcatgccagttgctcagaacatgtttgttaagtcgacattgatcaggtgtgtggaggaaacaactgctttgggtacaagcaatctgtactcagtgacttccagaacattttccaaatgtaagatgccaggattttatatgctccacagtgaataattcagcaccatcctctgccaagtttggacttaaagctgtccattggttttcatcagtggttattaaagtatggttcccagacaagcagcatcaacattaacatcagtatcatctggaaacattttagaagtgcaattttcaggccttactgcagatctagtgacagaaactctaggggtaggaagggggctacccagcaacctgtgttgtaacaagccctccagatgattttgagacctgttaaagactgagaaccactgggttggatgtttctggtcatccctgctgggatgcacacaaaagctcaatgaggctgcatgtttcctgaggactgaggcctgccttgtggatccttagtgcgtggcttactgcctggcaatggtgaaagcctggtattcacatgttgaaacagaactgaactcataaaaagatagtgagcacaacatttgatagaacaggcttcaagaattggttatcttcagccaagagtccacaactcctcatcggaaaaaaaaaaaaaaaaaagccagtcaccaatgttgcataacagatgaaaagcttggttatttgagtataattatcattagttagatattgtcccaaataaagcagagggcattggttactctactggtgcattatattctagaattgtattgctctagatgcatcagggtcattgctatataaaagggaaagacaaggatttttcagaatcaggttcctatgaggtgttaatgatctcctgaatattgtatttagctctttacataccactgtgatgcaaaagtgtgattgaataatgatccatttaaatggataattatgggggcatctttgtatttctaagaagactcacgcaaatacaacgtgtataaataacttgtgttttagggcagtggcaggaggaggagtatgaatctcactctgtaaagaaactccttttcctaagtcttttagtaggacaaaaaggcatctcttaatgttgttgatttcaaatctctgttattggggttatctaatatgaatgtaaaattatataatctacacactgtatagaatatacacagctaatttaggtaaatttaaccatatatacctttccaaatgtgtgtatatacatacatatacatatgtgtatatgtctctacccctttctcttgctcaatcaaatgtaaataagacaggtgatttcacctgccactccactcagaaaggacatgttctagaagatgtttgagattggtaatatggatctactcttcccttggttaatctctgttcccttgtgcatcccatggtgtttctgttttgcgagtgcaatttcagtgttgagagacattatctttggttcacttacaaatgcaaaaaaaaaaaaaaaaaacccaacaacaatgacaacaacagcatttaaattctaaaacccacacaaacagaagcagcagaatgaagcctggcttaggtttgtttctctggcacctgggattggtcttgaggtcatcttggtctttcaggcccctgttactccagaaggtcagtctaaagcctaggacacagggaaggtgggtctacattctgtcctggacttctgagagttgctcaccttggccatcctctttgaggatggagctctgtaatcacccagaaaggaacagggccttggggaaggagtattcttaaagggtttgcaggcatggggccagaggctcaagtggatgtactatagtttctttttgtttcttttcagaaagaattagtgaaatggtcacaatttattcacgtgtgctggtgcctgcacctcttcgttctagttcctcagggaggcaaagccttccttgcatcttaacactcttttttccctacctctctttccctccaggtctatggcttttctgaatttaaaaagcatttcaaaggcctgtagacaaatgctttgtaaacatgtctgagcaatgggtaatgtgtccacatagaacaatttccggggaaccacatggttatatgtccattaataaatagctttctcaaggtctcagaatgagaaatatcttcagacttttagtttcttcttctgtttgccagaaaattgctttacgttatatcatcataaaatggtctattttgcagcaacagatgtgtataaaatctgtgcatggctttaaactttattagtattggctgagtaccgatggatactatcacttaatggcatatgtgtatatacctacttacatagactgaattcttcaaagaaataaagggccagggacaaaatataccatttaggtaattcctacagagccactggagaagtctgaagtggatgagcagacaaaatgtcatttcataaaaactggaggtgactgccttgaatcttaaaagcctgagccattctgactaaagtcgtcaatatgttaggcctttctacactatttctaatttgcttctgccatctttctattgcaaatgcttaaaatttaaagttacacctatgtttcgtaatattctgggtgttcttcggaacagtggttcccaaatgctaggttctgaatgtgccagcctggaatgaagtttctattagtctacagcaaaataagaaaaataagaaaatgtcagtgtattttcataaagctagacttactaggtttaaataattctctttatttgaagatcttgtgctctctctctctctctctctctttttaatacgctgaggtgtatccttcagactgaagatttttcttatagctctgctggctatactatttggcccatgagatctaaatgtatataaccattcagtagaaaaatctgcttttattatttttttttgctttcatcttgttctataaaaaggaaaaacaaaacaattctggggaaaaatcctaattattattttagctaatttacaattctgttactgtcatttattcagaaggtgttgggcacccatataaggcaggcactagggctgttcaactcctctggaaaagacgtgcaatagtctacacaaaacataaactaatggagagcctagagtcaggttgagtctcatttggtttttgcctggaacagaacttcccaatttctgatctgagccagcaacctcaggcctgtcctgcactcaaaattctcttctgtctgggaggacagctgctactgcctgctagagaagtctaggatctgtaagtctgggattttgatctatagatactttgggcaatgttctgttctctcataagctccatgatttctcagacaataaaaacaaacacaaaagatctctgttttgtgaccgtgtgaataaattcgatggataaagcatgccttggcacaacacatctgcaggaggcaggtgtccacagaacacacctttctgaagtcacccgtatcctctcatcattagatgagttgaaccgatcatccttttctctgaagtattcttctatgcattgctcttcaaagtcatgtactttcttgagctcatcatcggttatgaagagttctgtggaaaaaaaaaaaaaggaagtcttgagggagagaagtaaaagcgatggcatctgatttgtgggcctagtgacattctcagtataaatctaggtgggaaaaggggcctagattccttgttaagtctcaaatgaaatccaaatccaattaggcaacttgcatcactgtcttctttctgaacatgaaatttattatgggtctctgaagttcacctgagcatatctggtttactgcaggagctgagtagaattaggcaagttgtgaggccagggaaaaagctaaatcaaggaaagggaagctattcagagcctagagtatcttaaaagctcaaaaacttctgggctgggggtgtggcagagagacattgttgattggccttactaaaagcccttttgcaacctcattctcctttttccctttcctgctactgagcttagaaacccaacacaaacatttccagtttcccttgaagctagcagcaaccacgaggatccagtttgggccaagaaacaaaagaagtctgctgcagggaggagtggtgtcttgggaagagattttactttcctgataaaatatagacatgtggttgcttctttctacagtttttcaccttctcctctttttcctgcctggaacatgaatgtgatgactggaggtgaggcatctattttgtgaccatgaaacaagaaagcacaaaaggaatagctgagcctaaaaaatagaaggaatctggatctttgacttcaatgagccattgttgagctctgggctcttcattttttgttaagtgagaaaaataaagccttatttatttgcattattgttagcctggtttctgttaatagaaggtaaatggattcataactgatatagcagtagaaagagcccagtggaaaattgaacctttaagtagtttatgaatcagggttatggggagagaactgctttgccagttcttaaatgggacaagtcattcttctaatcccatgccctcgagatgtgatagggattgtcccaaatatttggagccctggattttggaccctcagggatttagtttgctgaggtggctcttgcttgctttgggacattagcctgaatttgcctggggcatggaaagtatgaatgtaaaagcaggtgagagaaaagaaaataccagaaattagactgctcttgtcaaatatgggaggcttcctgaggtgaggaagacctgtatcacagggaacacttgagattcactcatgaaattacacagagcattagtctcgagggaggggaaagaaaagaggcagtttagagaggccctcaaagcacagatgattgctattgctgctatgctattgctatatttgagactcaaaggagtatatttaacacttattctgctggcacttcatttaacttctttggctatatgtaacgcctttttaacaaaaataaaatactattttttaaaactccattaacacgtcaaattttaacaataaaaattaaattgtacatttcagtgttttgtctgagcctctgccagaacttggcagtgccctgggttcttttaattaaggctacagatggatagtgaaaagttcagtttccccgactgattcatacaatgcagggcccttgtctctgaccttcacccttttccacccagccacagcactaaaatctttcttctctgagaaagcagacatggctgttcctcccttctgagcatccagtaacctggcaatgctttcgttgctaccattggtgataacgacaagaaaaccctgaacagcaactgcatggagctggctcccatctagcccaatgtctggcttattcaggttctctggccttctttgagggggtgggcactggaaaggaaatggatctctggaccatcctacttcctgcattgtatttacaaacaccaccttcctaagctctctggataagtgaggttcctcttctaccacaaatgactcatgctgtattgtaaattattttgggactctgagctagccctcagcatgttatccactgcaggctatcattcattagagcatcccgctgcccctgattttgtatcccatgctcctccacattggctagagttcctgagtcgagaagcttagggtttatttcataggtcatccaccccgacccctccaacttttctctttgcttaaatttgtgtttcagatggaagcagtgaattctggaattcccaggtctctctaatgtaaatgtctagaaagaagttgggcattgcaaggtcagggagggtgttaagagcttcagatttagagaagctgttgaccaaatcgttttggtttcaaaccttagatatactggtgaccacacagagggaagtagactcctgggctataatcccagaggctcttgttcagtagatttgatgtaggtggcctgtttgacacactttgagaaaccataggagcttgctggtatgggattggattcccagtggttcttaatggagcgtggtacccaaagggtatttaggaatctgtgggagtcaccagtatttaatgtgtggaggctggatatgccaaacctcctgcagtgtgtggcacaatcctacacaacaaggaattgttctgcctcaatgctaatagaacctccttttagaaacactgggctggaaggtggatggtgaagggtcttctgttttgtcctccgagtaacagaaagctgggctggtcttctcatgaggcaatctaggcacaacccctaaggtttaggaaaatgtttaagatcagaaaaaattataggtccagaagttattgcttaaattatatataatgtagccttgggtggcatattaatatcattgatgtattttgggttgagatctctggaaagcaagaaacttagaacttatgaaggttctaaaatagccctgctggagactgattgtatctctctaagaaagacatgaggctaagagtgctcaatttcagcctctaccatcttctttctgacattatttctcattcaagtcaactccctcatcccccaatgctctccaagccttcagagctgtctgcagcctgcaagaggtaggaggaactaggtgggcatgcgattctgcgtgattgcctataggaagtggtagggatttctgatttgtggcagctcggctgtcgcttgaagcttactcaggccgtagtccctttcatccgggtcgctctcgtgtttcctccatcggcagcacaggtgctggaatatcatggtcatgtggctgaagatgatcagtggtgggggcagaactggcctttcatggaaagtcatgatgagctgatacctctgaaacttccagacttggttggatatcgattttacttcaaaaaatgtattgctaaaatagagaccaaagagaatcaagtgagaaaaacccactgttttctgaagcatcgactccccttcacccctgctgtcctcatccatcccacgtgctccaaaggacccacttacttaaagacagcaatgaggaggttgaccagcaagatgtttgccactaagaggtagcaggccatgatggccggcacgatccaagctcctgtcttgcagggaggcagctggattattttaccatcctctcgggtctcattctgtccacagggagctggagggagcaacacacacaagaaatgagaaactggctatttgagttagaaaaaaaataaaaagatggatttgtaggagggttttagatggaagaaatatatagccatctcaaacagaaaaaagttccaaacaagccaaaattgaaaaatgagagcttcatgaatatctcaaggggctgctactgtggtggtggggggcctcggttccacagtctccccaagttatcacctgaccagaagaggggggtggagccaccttcttgctcacactgccgctaggcccctacaccgggtgaggggcacttggtgctcttctgaagcctgattgagaacttttcttgggtgtgcccagggagaagaaagtcccaccactggcaagttactttcaaaatgtgctgtagaggctgtcagcctgacagctgtaagagcagcagcatctcgggactattgatcgggaattaacaacagggcagctgttaattgctgcaagaaacaacctgggagctccagctaacgatttgctgtctcagtacagaaggaacaacacagggcagtgccttgggaagtatttagagggcttgttgctctctgctcctgatggatgggatttcattaggagggcaatgaggggtgatcggccgtgatcatggagctcatagccacacctgttcttccagcagcatttccattccaaaagtgtgcttttcagggcacaggaaacaaaacctaactgcagtggataaatgggcaaatggggggaaaaaaaaagcctggaggtgggggtgaggaggaaggtgatatgtgggattggctgtgtgtgagtaatgtgctaatgaggcctgcttggaatttccgggtaaatgcaagaaagaaaaaaatccctgacaaagcttcttagtgctgcacagacaatgtggctcaggaagccagatgatgccgtgaggtgccaggcatgggtgaggtagccctcctctccagccccctataatggctttagaacaaggctctttacatctacctgtaaaaggtggttggggggagtgggaggagcaccaagaggtctcagcagttgccacaggctgctttgatgatcggccaggaagatttgaaaagttgacccagaatctactcggctggagtacttggcaagaggcgtccattcctttctcaagagtttccgttgctaggctgcacattctacagtgattctcaaccctggctgccctggggatcacctggcgagctctaaaaaataccaatgcccagcttggctccagacaattgaatcagaatccctgagggtgccccaggcatcagcatttcttttaaaactttctaggtaattctcaattgccatgaaagttgagcccactgagctagaattaggctggaaaaattatgtaatttttgacatgctctgaggcccaaaatgcatcttctcagcctatgaggattttaataacattaggacaccaagacctggtttttatggctaagaaaagaggaccaaagtgcttcctttagttctgcctgccaagatgactggatgcagaatcaggcatttttgaggagcaagaatcttttttttattattgcagttgtggcactaaacacccaagacagccctgtaagaggtcctgatcatttccacccttagaaggaaaactcagcaatgaaggccccctggcttcagcatgaagtcaaactctgagagtgcctggccctgggccgtgtcttgccacctcccacctctccctctgagcacaaactggactgagtttcctgcagttcctagaaatgccatgcgctctcttacttcctgattttgagccatgctgctgcttggcttctaaaagacccctctgctaccttgctcccattcccatgcttcacctgggtgcatcctgctcactctttagtgctcacctggctttccaaagcccacccagctcccttgctgccccatccagtaaggacttgggtaggtatcttccttacaatcccagagcaccctctgcctgcccttttgggggtctctcacactgtgtcaccattgccagtttattcgtctgtattccacacaagattcctggtggaaggttgctcctcaagatttcccatcatctggctcagtgcatacacatagcacatccacatgcacctgtacaggacgaatgttgcataaatacaggagatcatggggacacaatcttgttggacactaatagacatttcccacacctccgcaggcctacttgtgatgcatagtcctagctctgaggggtcattagctcctttcttaggttctttccagaaatcctgccctcagcttggcaaggaatcttcttacactcaaccagacttcagtgtctctgctacccacttggccacaggcctcatggaaccattgctttgtttttctctcctctgcgaagcttctcgcacctactctactcactccctcccagcctaacagtctagtaggctggtcactcctctattctgccctttcctctggctcctgctcagatctctgtgtagacgccaacaaagagcagaaataactgcttggggttaagttagagaacttacatgatttttacaaatgtgttccctgatctccatttcttgactattctgagagaatacaaaataaacttgtgagaggcagagctcatttatcttgctctttttgaccctatattgagggaaggccatgaagacacttcctccacttgggcccttgtgcccagctgagagaggaaacaaggaacagtaggtgcttgcttgtttcaagtggtccatgtgcatttccatggactttcagaaagtgccatcaacatatttccaggtctctgctgagttcctctgcttggttcctcaaaggccctcactaattaaaatattggaccagcttaatatcttttttttttttttaacattatgtaccttcctgagaaacttaatatctttattgaagatttgatttgtttggcgccgggaacctcctgccaatcttttgggtattaatttattccagcctcccccaccttttactcatcctgctttaacagaggtagtattaatttagtggttaggaacatgtattatgttcaaaccccgactctggctgagtgcagtggctcatgcctgtaatcccagcattttgagaggccgaggtgggtggatcacctgaggtcaggagttcgagaccagcctggtcaacatggcaaaaccctgtctctattaaaaatacaaaaattagtcaggcatggtggcacacacctgtagtcacagctacttgggaggctgaggcaggagaattgcttgaacctggaatgtggaggttgcagtgagctgagatcgtgtcactggactctagccttggtgacacagcaagaccctgtctcaaaaacaaaaacccccctcaaaaccctgactctgccattttcaaatgatctgactttagctttgtccataaactttagcttcttcatctgtaaaatgggagtaataatggtatattactgtcaagtaatgtactgtcaagatcattacacaagataatgcatgcaaagtatgtagttcagtatctagcacatagcactcaatgaacattagctgagtcatgattggtatttttatttctgtaattgatagactttgagcttctcaggaactatgttttattcccctttgttttgcaatcactaagaatagcgcttactctacaaacatgtattcagtggttataatatgctgaatacagggtatattgggaattagagagatgcttcctgttcttaaagaacttgtaatttggtagagacatagaaagggtacaaagctttgcattattgtgtgatatgagcttggatggggtttctgaggaagcactcacatttgaactgtgatagtccctctagcctggccatacagagcagtctggtagtcaggaccagcctgaggaacattatctagtttctacagcagtaacggcaatatccgtgaattagatgatccttgttaccatgatgatgatggtaaaaatgaatagttaagaaatagccttcatttggtaatatcagcaaagaaagagcattatatgcagcagttaatgcaaaatgttgttctataatggtttctaatgatgtccttgttctgggtagttaccaacctaaaaagtgctatgactcaagcttacagatgtctaccactgatgaagatgaactggtgccttaaaaccctgataagcagcagattccaggatggggaataaattatctggaatgtcatatagcaccaaccagtatctggagatttatgttcccagagaaatgcccccgggacatgcacccaagatggcacatgggtggatgtttaggaaacgtaggctggtgacttcccctgggcctcctccttccttgcttttgggacctgacatttgggtggcttttctctcagtccttttgcaagaggcaaatgcatggtcagtaccacctccataccaagtggcatgttgtcacctccctctttcatggtgacagtcagtacagagtccttctagtggatattgactggttccaactgcccagtgtatatttccccatcctagtttccttttgtggaaccaccccttgtccagtctcagtccatgaagtacgggtgaaatgaacttcaatgccaaatctaggagaaggttaatcagtgtattttattccctgattgcagtgatcggttcagggatggacatgtgacccacacctgatcaatcagctcaataagcatcagccttggaacttttgttgaaactagtataaaagagaagttctcttttcacaatacaacgtaaggctaccaagtagagaaggcctgcccaagagtgactctatcacagagaacagaaactgattcctggctcagccatgcctaaaaccagccttctatagtcataaaaaccatgcgattctttttcttaagtcgatttcaattgggtttctgttacttgtaattagtcttgactgatacaattacccccacctctagcccttgtccacaagccagtaataagagatgttcatattttgggcacctcattgctgagagactgcatttggagtcttggaatggcatggaaagattggaaggagcaatgcgggatgtaaaacctgatctgataccaaggttgaattattgccaggagccagaggccatgctgctccccttcttccccaaagtataaagtaaagggcctatactgataaagctcgaattttgtccaagtgggatctttgactcagaaactaatgacacagattagacctattatcaaacctgtaggattaatgcagctgggaaactttggccaagcacctggccaaagttaaagtgaagaaaacttattctagaagctggtcatagcttaagattaagtcgtagggcctcaaagtcacgtgcaggtacagaatgggaaggctacatctatgcagcagtggcaaattagaagggatcaaacatttggagattcagattctctatggtttacttatgggggtcacattgacacatcacatggcagaagcctggaaatgctatttgtgttaactatgcattaataagtagaaatagatgattgggctctggaacaaattaacaggttgttcaggtagaattctgccaaagtacatggatgatagtaagaaagccctccctatagatgttgtggggggttttggagcacagccttccaatggttgaaatgtttttcatacataaacttttataataacaagtcaatgacatcccttgctggaatataagcctcacagggcaagatttttgtctctcttgttcactaaacagcctctagaacactacctggcacatagtaggtgctcaataaacaatggctgaatgcctgcagacatggatgtcacacactgcacatgtgacctgcaatgtcaggccacattctgtgagttacagctcctctatttcactgggtgtctattttcctgtttatgtcaagacctcaacaagtatcatcatgacctgtcaatatagggtggctcctgtgagagcaaaaaactgacagagggaaaaaatagattttttggtttttggtttttggtaattgccaaggttaaagcaataggtctggtctttgacaaaagctatagaaaatctccctctagatgctgttgtgtaaatctccatggcaaaccaacaataccccatcttgcatccatgacagacgttgccaattaatcttgatgttttttccctctgagccaagatgtgaccttggaaaccttctcaagacaaaactcctgaaagcacaccaaccaactgaaattgacgcaagagaagggacctttctctcagtcccagtagaaatgggaatgtgaggtctggggtgaaagatcagtgacattcttcttttcaggagcctcctcaagcccacatggcctggccagtacctgccctataccacctcacagttgcccaggaaccaaaaagggtcagaataggacatcctacttatttcagacactgatacttgtgacgagggaccatcctgagagggctgtggaattcccccacatacatcctggacctgaggaccctgccccctgtgtattttaaaagatagctttaaaaatggtgctttcccagaaaatcctggtcctagttttttccttatgtgggatcgtcaaaagtgaaggagagtggagatttgggaataaacatctgtggaaagcatattatgtggcaatctccatgctgggcacattacattggccattgtgtttcatcttcttaccagttctgtaagaaacgcattgtccttgttttacagctgaggaaacatgtgccgaggggtgaaatgccttaccaaagaccacacagctaataaggggataatgccagaaccattccatatatccaaaaaatactgagttcctgctatgtgccagtggcaactggcagtgaagatacaattacaaataaagcagaaatgggcactaccctctgtctgaccctgaagtctatatgtattctgctctacctcacatggccttgccaatgtaatattagtggccacctaccgcaggcttaaatggaaggccctgtgctatgagctttacgtatatcacctcattttaatctttaccatattttgacatgataggtctaatgtttcccattttacatttgaagtagggaggctcagaacactttagggtccctgtcaggtagctcagagccaggaagaacaaaatcaggatgtctataaaagcctggtgagctacaaattccctttccttggtgcctctgaagaaggagccaacgtgggattgagaggaatctctcaattatgaacaaatctagaaacagttcattagacattgattattcttgtccctatcaacatgaataacttggcctgagccgttcagatgaagtacgagtacacagaacagtttaaaagttcagagggtggagagagaaattaggttcaagtaagaggtatcaggggcaggcacctccaccccaaagattaagacacttgccctgttgatttcatcctataatatgcagggaaaagaagtatttatttatttaatatgcacaccatcttgtccctaaaaagtcagagaaatttaaaatggaacaccaatgtttgatataatcagagtcatccttaaaaatatggcaaaaaaggatatttcttgaagaatgccccttcctctcctgtctgaagaaatgtttcaaaagctcagtccaaatcacaagcaatggaataaagagcttagttgagtatctgactacatttatcctattttttttatagaaaggattttcatctaaaaatccatcttgaaaagataacgagacaaagaggatttctccacctccttttgaaaatctatacagttcgccatggaggatttagaatgccattagcacagctgctgtggctttactgggaggacaaatttgatttagataacgctgccctttggccttttcctgacacaacgttttccttggcaagacaactggagatgcctccctttgcatggctacatctttctagaagtttccttatctgaggctctttgattgtggtgggtccaggtggaggttttctctgtggaaacatgaggctctttctattgctttcagtaggtgactgccaatatcctcttataatggacaagaagagcaaaggtcgctgaaaaccaggcaagcccaactttctagagtcaaaagcaccatctactagcatccccttttacttcttttgtggcttaagttttttctcttcacctaacccaaacactaggtaagatgctaactgataatgatatggcgcaaaggcagccactggaaattggtgggaggccttggtttctccatccatgaacaaagggagttgggttattgatattctctacagtgcaacagacacacagcttgggaagtccaagatggctttaggacacacaagcagggcattaaatggcactgaactagatagtaagggatgacactgtcaagcttctttccatcttcctgacgccatcagagagaaagtgttagtttaagcatactattcttttaacacttccttaatgtttgctaaattcccttttttaggaaagactgagctcaagcatctggtagaatttcacaacaatgtagcgtttttcattctgtttattttgtggttatcctctatttatgtcaaatgatactgattttcaacttgtgaccctaaatctttaaaaataaattaagtttctaaaaaatgagccaatttaacaaaaaatatttaagagtagaacaaaggttataaactagtgaatgggggtatgtggttgactgaagtttgggaaatgctggattagattatctctaaactccatctattcctgatattttgtcactccacgattccaggaaaaggagcaaaagacttgaatttgccccaaactgaatcatctatcccaggagccaactgtaggccacttgtagaaccttaatctttttattcctggtagaaaagcaaactagctcccactgcattaaatggaattcagcccctacctggggaaaaaaagggaccaatgatatagcctccaactcttcagggccatcttggcttctggtctatctgctatgtgcacacagtttcagctttgagctattcagaacccactattaagctcaatgtctcattttttaatccagtaaattagcaggatgtcgcaaatctaggtatgttgtgtgtgtgttgggcaggggggaggtatggggggaagagcgtcctgggggagaagtggggagaattcaattccctgttacttggttccatgttcttcctatcctatatatctagctttacctggaaacaaaaattatttatttgaagagggcttcaaaattctaaccttagtatttcattattttgcatcaggaattaatatcagaaatattttatgcaaatcttgccttggaagaatatatatctaaactagcctattgtacacgccagtgggtttgctgtcatgattaggagatcgattgcattaacagccccaatttctctcccctccctggatccacactgctttgtcatgtgatgttagagtttctatcactaaacaggtgggatctctttcttcacctcttgattctgagtttggccatgtggtttgctttggtgaatggaatgttagcaaatgtgacccacacagaaccttggaaaagcccttaatgtttctgtttccactttttggcttccgccattaccataagagacatgcatgagctagcctgttggagaatgaaacacagggaacctttgcttctaggtgcttgttttctgagctgaggctgttctggaggaggtgatagcccgctgacctcctggcaggtgattgagcccagcccagaccagaagaaccatgcagccaactctcagtcttctgagctcaatacgtgcttatggcgttaagttctgaattctagggtggtttttcctgtatcatttttgtgttgatagatacctgataaacaagctaaatttcccttgccctgctcacagctggaagaggtagccctacgtccttcaggctgacaaagtcctttcctcatttcttcacttctcctttcacccaattcaggctacagatgattggagcagattccaccattgaccaagaaggagtgagttcattgaatggccagtgactaatcagactctttgtgtttagaaataaaacagaagtgcagagacttaagttagatgatggcatgtacttaaagaacatatagagcctgacctcactgggtcatgtaaagcaagccatatgagagagggatggtggaggaagggagaaaggaaatgggagagagagcaagagagaaagagagaaatgattgattgattattgattgaggcaggagagaagtatagagaaaagcagatgagtgtggtcatgtcttctgattctgactttacaaaaccacttctggttttgttcccagtcagctcacgcatgtcgtgctctgcttcctgtctttgaatgcctctgtggttttctcttaggcacttacagtcagtctttattgaacctactctgtgtagttttgttttcttacaatcaacatttttctctggttgagaacatagtcgctaagacttcagaaggaatcagtttccttgcctagtagtttcatcagagaagggaggggctgtgagaagggagagggaagctctgggaagggttagaagaatggaaataattgtgtttaactcagttttactcagggcttgcctcatcatcatcattacaccttccttttgatatttgcatatacgaaataggattagataagttctttccttcttcaaaccaaaacaacagaaaaatttcagagaaaacataaaataagttactctttcagatttttgtgttgctgtccacctacctataattcatcacaactccctgacacgcaacaatacacctttctgagcaatgagggcaggaggaggcaccccttcccctgtaggtgaagggagctggagtccattctcattgcctttactgtggaaggttttccctgtgagtccacactacctcagcctacaggccacacactaaggaatatgcttgttgtttctgtttaaaatggaattgtattacttttcagaagcccatgcatatttagggtattagagtattcaaagagggaagagccagggccctcttcaagaggggccttcttaggaaaagaaccagcaacctcatatcagggctctctgtgcctggaaggatcagtccagtgagccagactgcatgtctatgtgtaaatgcacatcaggggacatgaggctacaccacctccaaagaaataatctatggctcttgtcgactcccattgcattgtgcctgaggggttatatgatatctacagaaatgatcaatgtggctcctaatattcaggaatgcgtatataagcaaataagttcctgctgacattatttacaaatcccctggtaagagacaatgcaagaaacacatctgtacttacagctcacggttcaggctcgaatctctctgatctgcaggcactaattcctctctgtgccctctggatcccaagctctgtttactgttaaaacttgagcttttcacgcttcaagtgatgctcctcaaacaaccaagaatccagacaataggcagtccacattccgcttagaatctaagcagctgttggctcttgtgttgggactatgtgtccaaatgtatgctgcatatgaactgctaggaatatgataaaatagttgggtgacagcacacccttgtatagtgggctaacaacgttattctttcccagagcaacattgacacgtcagttaaaatacaacaaataaacattttcatcttggcagatttatctgtttttatttttattttttttttgagacagagttttgctcttgttgctcaggctggagtgcaatggtgtgatctcagctcactgcaacctccaactcctgggttcaagtgattctcctgcctcagcctcccaagtagctgggattacaggcacaagctaccatgcccaactgattttgtatttttagtagagacaaggttttgccatgttggtcaggctggtctcgaaccgctgacctcatgtgatccacccaccttggcctcccaaagtgctgggattacaggcatgagccactgtgcccagcctagatttatctgttaaaaaataataaactgagataccaatcaagtgaattgcggtgggggcgggggcgggccaagagggaaagaataggcaaggcactttgctgttcatcattttttaaattatattttaaataatcacattatcccacattactaaatcattttgtgaagtcactagacacaaggcactaaccttgggtaggttcagattgagacttagatctggcattttgccatctatgtcctatgggtaagtcctttgatgtgtctgagcctcagtgtcctcatttctaagcctgacctaatgatgataatagaaatagtgttaataacagtgatgatgacacatttccagcttccctcatcattcattcaacaggtatttatggagcccctattgtgtaccaggcactattctaagtgctcgggatgcatcagtgagcgaaacatcaaagatccctgcccctagactatctatactgggaaagggatggtggtggtgatagtggatggacagaaaagaaacaatagcataatagataaataagctaagcaggctgtcagtaggtgataaatgctgtgggagaaagtacagaatacagggtaggaaggatcaggtgtgatgcgggaagcccacgggtggtggtggtaagccacactaagaaggcaagatttgaacaaagactccaacctcagatgagggagttggctaagtggctctctggggaaaggatgctctaagcaccaggcactgcttagagctacatcctgtgagcacaagaaggtccctggtctggagtaatgccagggagtagctggagaagaggaaagagcaccgagaggtgggagcagggaaagcagcatgtggaggctttggaaggacctcagaggatcaaatcaagctccaaggcaaggagataaacttataacagtaaggcgttattatttattgtaatcgtttattggatttattaaagaaactgagtaattgctcctcatccattccacctctggcctgatggtttcttatctactaagtaaaccctctcttcatgatttctattttccccaccagatcctcaatgcccttacatgaaatagggaatggccctgctgtacctagttgggggagatctgaaggcagctgaatgttggtcctgtgcagtctgcaacagtgactctcagactcctttctatgtccacctactgtaagaaatggagggcgaaggaaaatgcgtgccagggagggctcaggtttcctctcaatcccacccacatacacagctgccctgcctttattggccaaacagcagtctgccaagagaaagctgatttctaatctggtttgagcaaaaccaacctttataggtagatgaaaacctcacagtatgaggtttgggagagggaacaaggttcttactgacgacatcagggcagaaacccagcttttctcactgcagttaaactccttagtggttgctgcttagctcacactgtttactgcacctgctgtgtcaaagaacaataagcttggatgcgggaaaaatccttctgttccttaagcaccttaaactttttccaggcaagaaacccaaactgaagctatagccagaggttaacctgaacaattttctagacagtttcactcaacaatgacacccatcataaagtatgtaaagagaaagggtagatttaaattctcattttcagtattcatgaagacaggagggttgctactttcaaggtggcttacagataatctgtatttttcttttatgcctggaattgtgcacatgcacatacacagcaaagatcaactaagttgataatattcattagagtatttgaaaattagatggcttcacttcgccaacacatacactctccagagtacaaactggtgacatgtcaaatctaacctacatttttttttaaatatggccatcacatttttaataagcgaatgcttcatgcagtgccactctaaacaatgctatgtgaacggcatttcctttggccaagttggtctgaatagacctgtgggaaaatcctaaaactaaaccacaagtcgtataaaaattggctagtttctggatcctacatagaaagaaaacaagttgggctttttccacttatatcccttgtcgaattgtgaaacaaaaactgtttgctgggctctgataggccagtattcgtgggggtatttacggacttagggagtttataaaagaatgttctgtcttcctttctctacatcttgtgcaactatttagtaaaaaggggacagttaatattcacgctttgtgctgcattctcaatgatcatacaaatatacgcatacacacacaggagagagagaagagagagatgagagagaaaaaaagacaggagagtggagagctaaaagaaagcaattggggtcaagtccagcttgaatactaagttaagctaacaagatataagggagtagcctcatgcctgaattggatatgtgaactggctacaataaaatatatgtgtaagatgcaattctacttaaggtgtctagtggaataaaagtgataattgttcactggggccacaataggacattccaacatgcacagacacaaggcaaatggctgagatttttttatatgatcttcaaatagggttgacatggatctgatataacaaatttcaagcccaagtacagcaagcatttataattatctagaaacaaatctggttacaaccatcctagagatgcacacatcaaattctatgccaagcgctttcatatacaatatctgattgttacaacaaacattttaaaaaaggtattaaggttatagaggctgatcattaagacaaaatggcataaaccctacagaaaacactttagaatttctgacccattcatttgtttttcaaaatttttgtttcacagacacttattaaacaattgctataccccaggcattattctatatgctttgtaaatttcaactcataaagaatacaaagtagatactattattatggccattttacagatgagtaaattgaaacacaaataggcaagtaacttgcacaatgacacacagctagcaagaggcaaagcctggattcaaactaggattccatcatcttaaccactaccttgtgctatttctcaaggtgtgaaagctattttaaaggcaggaggatttgcatgcccagatatctgcatttagactttccttgtgttccatccttttgtctgggtcagtggctgtcaactggtgacatccataagtattaatctttccatgttataaagacttttgaggacaagtatggctataaagtgagtttggctaacatgcttgctttggaaccacatctatgtagataatacacttaatgtaaatggaaaacttatccccataaatataatgaaagaaactaagaagcccagtcttcatttaactattgtccaataattcctttgtaaatgagtaaactgataccctttggaagggacataaccaatttcaggctaggaaatatcatttatattgtgttggatgaggtgattcattccacagcctcaaagactcaatgtaagccatcttcatgtcttgtttatcctgcatctgtttttaatccatggaaacagagacttctccatttcactagacagcatagatggacccaagaataagcagtctgtttaggcatagctatgtgcacctaccttgactgatagctttatttagcatagtagggttgggtttgcagtagaatgtctgttgagaagaggttaaagacaagcataaaatgaggcttatacaagcaaagaacaaagcaaaatcttgttttgctgtatgtcatgaagaatagcctattatttcacgtgactaggtgattgaaggaactagttatattgacggttgccatggatatgcactgctctaactggtcccagattataataggaaccagagacgatgagtttaggaatagcaggcaaagggatctggctttatcaactggtagaagtctgtgtgttagcatctgagatcaatcaggatgttcacatctgtctagtttgtacttagtaaaacaaaaaaagatgttcacaatcacgtttatggctttcaaaatccaagagatgaatttgctctcatagaatactaataacaatggcaggtttacagggccagctgggtagagcagggccaacaatatcttccttgcagtgttcttttcatttaattaattgatatatgtatatttatataaatacaaaaatgtaaaaaatatttaaaaatatatttttttcattgcttctgccttgcttaggtctgtctccagtctaagttatgtttccatggaatggactccaactgttgatccatgagcaatagttcatgggacttgacttcctctattttgatatttaaagcaattaatttaaggttacttccatttttgtgtgcacgtgtacataagtctgaaatatttagtgctcaagattggcgttgctttagattttgggactctgtatttgtgtagaatcttcttgctgggcaatccatcgctagcctaacttaagacattgtacacatgtaaaaataatggagctgcattaaaaaaatctataattcagatttggtttttttttttgctaattccagattcacttggtagttagcattattaaagttttgggtcatattactagagttttttttttttttttttttttttgagacggattctcgctttgtctcccagtctggagtgcagcggcacgatctcagcggactgcaacctccatctcctgggttcaagcgattctcctgcctcagcctcccaagtagctgggattacaggtatgcgccaccacgcccagctaatttgtgtatttttagtagagatggggtttcaccatgttggccaggctggtctcgaactcctgacctcaagtgatcagcctgccttggcctcccaaggattatgctgggattacaggcataagccacggcgtccggccttagatattttaaaagtaaatctgctggtgagcaatattcactatttttttctctctatctgaaaggaccttggtgtgtattaagtagattgaatatcgggttattatgacacgacctgtcaactactggagaaagtagattcaggtaccaagtgtccattgaatggccaccgaatcatttgagatcagggagaagctactcaattgcaaagaaaatatagggcttgattccacatatctccaggatgggaacacttgcaattatcttttatagtctatcttccaatctttcacattctttttctttccttttattccattgtctttcatttccttgcttattttggaagagataatgaggtacattttctattccatctgaataacagtatcagttattttgagctggccagaaaatgtctccctgatgtatcttaccaaatggaagcccgtagcatctgtttggaggcttgacaggaaaagtctctcctttctagactaatgacctgcagcaaaagcttatctcattccaaattctgccatacctacagacacacaggagacaacacaggacccaggctccggagccggccaacatgggttcaagtcttagctctgccgtttactagctgtgtaacctttggcaggtcacacaagctccctgggcctcagtttcttcaattatgaattaggtaataattacagctaccttaagagtgttgttgtaaagataaacgagttgttgctgatatgtgtaaaggttttgcacagcgcctgccactctgtaaatcctgaccatttctgctggaggccctgtaccttggaggctcagagtccaggtttctgagccgcctgccagggttctaagtccaaccccgcgtctcaaatagttgtacctcttaggcaacttaccaattaagttaaatgtgaaccatatgcactttttgagagtagaccatttttgacttacaaaaaaggtagtttcatagggttccacagaatacataggtatattctctgtgcctcattttccttgcccattaaacataggggcaacaatcctatcttgtaggattgttgtggggattaaattagttagtattattcacaacacatgtaggacagtgcttgatatgtagaaagcactatgtaagtatttgctattattatttttatgaccctcacatctctttactacttgaccacctaaatttttctcaataatagcctgtttattgatccttctctttgcttctgtcagagcagaaagaggcttctgctttttgtgttgccagcaatgtctctctgcccccttgaagcctgattgactttgtccccttctttttctccatgtccatcttgactgttggcatttgcatactcactaaggacacagtgctttacattagctggcagtggttcccggacgtctttgtcttctttacatattgaccctggagtgtgagggcccaggaaagatacaatatttcttcccagttacttgtgtgtgtgtgtgtgtgtgtgtgtttcccacatgatggtgattttaaatctttagaaaaattccttatgttcaaatgtggaattcgtaatgctttcctatgctttttgtcaaaaacagacttttaacaaacttaaataattttagatttgtagaaaggttgcagagttagtacacaaaattcctgttctgtatattctttacccagtctccgttaatgctaaagtcttaaataaccacctatatttgccaaacctaagaaatttacattcataagttactgtttgtacattactattagctaaactccaaacttgatacaaatttcattagttttccactaaaattctttttctcttccaggatcctacattgtgttttattatcattcttcttagtttcctccggttgttgacagttctacagtctctcattttttatgactttggcacttagtgttgaggagtaccggacagatatattttgtagcatgtcactcaatttgagtttgtctgattttttttcttctcatgattagactagggttatgggtttttggaaaaaaatcacaaagatgaaatgcccttctttttataacatatcagtgagtaaacaatactaagatgagttctcactggtaatgttaactttgataactctctccaccatttacaaaatacattttttaaacatagaattctcacatgttaaggttaccaagagaccatctaaagacagtaagtaactagatttctaaaattgcagcattttaaagccctgaacgggcttgttcaattgttctcaatcttctcagccctaacatttctttttaataataactatttcctattcttccttcattcttcagaagtgaaatttatagatggtataatttatctgtacatgtagtcatagaagaatcaatataatgtcctaattttaaataaacgagaaattaaaggaacataatttataataaaataattatttcaatatataagtgttcagacacaacaattccagaagccatagtgaagtggtcagatgcttacacctaaatgaagaacttccatgaataagacagacacaaatgcagacagatgtgaggctcaaatacaatgaggaacattgtctttggtgagttgattttccaaaatgttgaacaactcatgagaaagttccaaagcaaacaaaataccatctcccttgattttcatggtggtttcattcctggaaaaattcacagctcattaaaaacatgcaaaaatttgtgtatttaaatgtaaaatggagttaggctcagataattataaccaggtttttcacctatgtgaatgtctgctgggatagcagaaagctgtgtggacagagaacaatgcttcattgtgggagtgtcctgtgcactgcaggttacacacacagtctgggctctaacctctcaatgtcaatgatgcccctaatcagggagggcaagcaaaaacaatcagggagggcaaaaaacaaaaaacaaaaaaaccaaaacaaaaaccttgaatttccaaggtaaagtttcccaaaaaaaaggtaaagttttcaaaaaaaaacccttgaatttccaaggtaaagtttccaaaacatgggggccatgctgcccatcaagaccagcactgttagagttcaggtctaatcacttcatctcacagtgaagaactgggctcaggtcctaacagccagcactttagggcaaacagcctggaagccagcactttagggaaaacagctcctaacctgcaggatctggtgtttgttgagccctcaaaaagggttctggtaacccttggattgatgcagaaatgtagcttaaatcatgcaattcatttcacacacacacacacacacacacacacacacacacacacactaccaacaccaccatgcttggattgatttagaaatgtaggttaaatcagcaattcatgtcagacacacacacgcgcgcgcacacacacacacacacactactaacaccaccaccaccatcatcaacaacataatcatcaactcagtttctacacaaaatccttcacttcttagttttcccagtgaattaggagaacattcaaatccttacactggcctaaaaggccctgcacaacttggccctggtctgccttctccagctttattccctaccattctctccttgcacatcacacttccaccctgctggtcttctcagttactggcaggaggagtaccctcccctctgtctcaggactttgcactggctatttcccctgcctgggctcttttcctactctttccctcgcaaattcctccttattctgcatagcttggcttgaaagtcacttcctcagagagcctttctctgagtcccaaatatgtctccttgttagatgttttcatagcactctgtattccttcatcacatacttagcagagcttatgattaagtatttatttgtgtaactctgggtttgatatctgatgcctctactgggctgtgagctcccaaggaggcaggagcttcatcagtttttctcattactaatccccattacgcaggagagtgcctggaacagagttgtttccaaatatttgctgaatccatgaatgaatgaataattaggttagctgcccagaatgactttcaggctggctggcaggctgacacaatgggagaaacacaatcatggtttttcatgatgagcagcagcataataccttggttctgttttgctgtgaagagagagaggcatgctatttgagactgtttattttggcatagttgtttcagtgagcttgtttttttcttttctttcttttttttttttaaattttttttcccaacagggtctcactctgtcacccaggctggagtacagtggcacaatcacagctcactgcagcctcaaactctcaggctcaagctattcttccacctcaacctctcaagtagctgggaccacaggtgtgtgccaccacatcccgcataatttttttttttttttttgtagagacagggtcttcgtatatttccaggctggtcttgaactcctaggatcaaaccatcctccctcctcattttaaatgaacataaatggagcagagaagcctagaaggcacctgggtatttgaagtagtgaaggctcctgcatctacctggagctggcttccccgctggaagaaacaacggctttgcaaattttagctttatagggctcacccttacatgtaccctacttcattttttcctactgttactactaataacaccttatctctaagtagcctttgacactgtgctgtttgtttcattctttcccaaattttggtctttgggtatcactttcattaatttggcacatgacacatcaccagtgctattatttattaactttttttttccttgaatacatcccactctgacactgatgcacattttagcttcatcaaaaacaataatatgcatgaatgtctgattatattcatttgggcttatcatattcatttggaaaaaaaatgctctttttctgggctgtgttcttgtgtgagaggaacaccaaggacaacctcctttctgtcctcaaactgttaagaatataccaaagaacagacagtttgagtaacttgcccaaggtcgcagggttagtagagatgacagaactgagattcagtgtctggcttctgcctctgtcctggactgttcctgtcacactaactcaaaccattcttaactgagttctctacccacaccaggcactccataactataaactgtggttggactaatgatggcttccaaaagcaaactcttcttcatgctttttctctgagtacattatattctgtgcaatgctgctggcatcttgggacagtagctgcctctttccaacttgtaattttctgacccatctatgagccatgtctcatttgtattaccaggatgccccctgttttcatgatgaatgccattttgacatacttgtagagacaggtgaatctcctcatgggcggtacaatgtagttttcatggatatctaatttatccatgatgggtgattttgagactatccaaggtatcaccatatcagtgtcatagaaacccttctgggaagccttcaatggtggaggaagctcccttcctgatttcctaattctggaaaccactggtctttgggtgattctctatcttcctgaccatcaacctttggcagtgcactgtgtcttgaatagctgcagagttgccaatcctgttcttaaatccagttctcatttagaattaaaccacatacttgaacacagaaattccaccatgacatgctacgccaacttgagctgctgctatagatcttcttcttcttcttctcctcctcctcctcctcctccttcttcttttttttttttttttggttttcccagagggaggcttgctcggtcgcccagactagagtgcaatggtgcgatctcggctcactgcaacctctgcctcctggattcaagtggttttcctgcctcagtctccctagtagctgggattataggcacccgccaccgtgcccggctaatttttgtatttttagtagagatggggtttcaccatcttggccaggctggtctcaaactcctgacctcatgatccacccacctcagcctcccaaagtgctgggattacaggcgtgagccaccacacccggccgctgctatagatcttaaactccaatcacactggcattttttttgatcctagttgaaagcatccagaccattcctaccacatggctttttgcccttgctgttctctctgtctggaatgttccttccccagctcttttcatgcctatttccattattcacatttcagctcaacgttatctcttcaagccctttcgctgaccattctctataaaattgtgtgcccaagtccttgccgcagtgactcttgatcctgctagttggacttattttctccctggcagttatgaccaccccaaagtatgctgtttatttgttgacttactgtttccaccgaaccccacagtagatgtaactgctatgaagtacatgccaaggcctctcttgtttactgctttctctttgcaataagtggttgctaagtaaataaatgcatgatgtggtccaggcactgcagtgaggtataggggaaagtgcaaggctctggattccgatggaagcagccttctgttctaatgcagaagttaagagcgtgggtctagaagtcagatgggcctggattccaattcagcctctgccactttctggctgtgtgccttcaacaagttctttaacctctgttcttcatgtagatcactagtaaatcagcactaatgagtcagagtgtatcatgtgcctggcctggtgccagccactgtaatagcctctcaacaaatgttaattgacttccctttccctagaaatgtcagaagaaacccatgaaacccaagacatagcttttgtaacacacttggtagttaatagagaattcaggcatccctgtattcaatataatctgcttaagtacgactgccatacattttgcaaaaagcagtgacattttcagcagttggctatcttatgtagactcctgatagggttgataatcttaaatccacaggaaagaatccagtcttttagtgcatgacctgtttgatagtggtgtcccccgccctgtatattcaattacttgctgtagaatagaaccgcatgcaccatatatagttccttcggtgcttgaacattatgttcctcaggtggcacgagtgactttgaagtacttgtcagcaaccggctttcttgtaacagtactgtaaccattcagttcatagtgacattttacttctgaagctcttgttcagaatattaaaaagggcacatagcagacttcatccctttgcttcaaggcctgtgattctgtaaagctagcccatcaactcaggagagagtcactggccccagtgaatgtttaaaactgttttcaatttggttcagtggtgttaagttgatcagtaaatataactattgaatcttatcatggggggtttgattcccctttgcgctttatcacaaatggtgagctggattgattgaactgaactattttgccaggatgtctgagatcactcagaccactttctttgtgagtgcgtcatggtgcttttgtatccaaaaaaaaaaaaaaaaaaaaagactggtgtctctcttagatgcaaacttgagaagggaggtgttgaagtttgctagactccacctggattagcaaaatatttgtaaattctaaatcataggttaaggcctctgggttcttcttgttcttcatagcaatgatagcttattatgtccaaaactggtgcccaagggcatgggacaagatctactggtgtttgccaaaaggagtccttcacgttgactgttcagacaccctaagtgcccgatgtcctaacttggtctttggtctgaagacagagtgagcagagcagagggagatgtcgtgaaaccctgtaagggatgatcaatggggacctgcagcactctctgcctggctttagtttgtgaggacttggggccccttcagatctgtcctttaggacttcttacaagttgaggcaactacattgtgtcatctctttcagaagcaatcaggagttgaattttgggttctgataggccaggttttctcaatctcagcacattgacattttgggtgggataattctttgtctggagaagatgtcctgtgcatcaggggatgttaggcagcattcctggcctctactgctagatgttagtagcgccccctgggttgtgacaaccaaaatactttcagggagtgccaaatgtctctttgctgggtggtggttagggggtgcaactgcccctggttgagaaccagtgagatagaccttgactatgagagattatcttgtgatcataagtaagcatgtttgagagtactcagctcctctgggctgtccttgggcctttcagacctttgagtttcctggagaatagatttttatttttagttttttagagatggagtctcgctatgttgcccaggctggagtgcagttgctattcacaggcgtgatcccacgacccatcagcatgggagttttggtctgttccatttctaacctggaccacttcacccctccttaggcaacctgctggtccctccctcccaggaggtcactacattgatgctaaacttattgtggatgcctgatcgacacagcacactataacccagaactcctgggctcaagtggtcctcctgccttaacctcacgagtagctgtgactacaggtgtgcaccaccgtgcccagtgggaatagattttttgatttggatgaactaatgataagaaaaaagtgagaaagggtagtatataaatgcattcattcctctcctctcttcctttctctcctctgtctctgttagttttccagaaggggagagatggggtttggaggaggagaaacctagctgaactgaaaaagctgcagctaggaagcccgtgcccgcagactgaactgaggaacctgaggcttgtagaacttcaggtgatcctgatattcaagttcaggcatcagcaatttactgcaggcagcgtagaagacagtgtttggaggcaaactgggcatctgccaggacccttgacaaaactgccatgtaggcaaagccgttttgccaccatgtgtctttgtgaagcctccccacaccctgtctcacttttcttgccctccagacactcagttgcctcatgctggcttctggctgctcagggtccacctcacgcatgctgagccatcagcttccacgtcacctgcccccatttcaacgccccttccctgaatgctgatttcagctattttgggggttgagaggagcgattcacatacttcacattaaggcgagaagagtcagcaggtttaacctgttcagggaatgttttgactcttaaaagagaaggttgttgctcctgttttagaagatattttggaacaaagggcttttttatggcttatctaatttccctgaaatgagcattatggttgcatattttctagccatgatctccccactcttcagtgacacctatgcatcccataaactgaagctatacttaaaaaggggctccacacaaggcgacctgcgaatttccaacaagatccaaatcccttagcctgacatataaagccctttacagcaatctgccttactaacctcttctccattaattcactcaagtaatggtggaaaagatgaatacagaccctggccccaacccatccccaacccccacaatgcatagaatccaataagggatacacacaagaaatcagacaaaaacaatatggtgtccacatcaacccagtgtagatacagagggcttgggagtacctcggacacagaactaacctagaggctagttccaggctggcccagggaggacacctcatatctccgttctctctggcccccatatgcccacaccaggcatgctctgtcatgcctctggttttgtacataacagtccctctgtttagaatgccctgtcattatctgtctgaaaaactcttaaaatcctttgtgatccagcttaactgttacctccaggagactttctcagagtgcatctggcccgccctcccttttctcttccccttttcctactgctaaactgtgttctttcctttgagctaagtccttacacaacacctctatgaaaatatatatcacgctgatttgtaatgtgtgtttagctgtcagtcttcttcagcaacttccttcaaaactgaggcaacaaagtatgtctttttaactcccatctcgtggcacagagcctggcacttgaagtgcttagtaaatgtcattgaatgaatgaacccattcaaactagaatctggaaaatattatagcaggatgtctcctttattcctttgtgtattagattatgagatatatacacagaagagtccataaaacatatatgtccagtgtaaaatgaaagcccacgtaaccacagcctgggccaagaaatagcccctctatccttaactcaccagtgggtgtcatctccctgaattgagtgtgtcactaagttgaagactcaacatcctgcatttgacctgaagttattggggtctttttccaagcaagcactcatcttgaaccttaggcctgatgttctagatatcaaatatttggctgaaagccaagcaattcagtcaaacatcacttgacagacgtggtctgatatctagccgcaggaagcgactcgctccactggacagtatcttgcaaaagatcttgagcatcttcctttcccttacatattgaggttgcaggcttatttggactctgtcacatctgaggaaaggcaactaatgtgtgagccttgctgggatcatctgctaatagttagcctgtgtggagatcagtctatttgttggttgctgttaatacagatcaattaaaatcttgccacgttattcagaaggggtgtactctgctctgctttgagtggaaatcaaccatctgccttgctgtgtttggtcagaacactgagcctttggaaaggccatagttacaggatgcatggcaaccaccgccggcatggtgaggctcagagctggtggggctgtctgcatgggcctcaactggtcctgctgctgggctcacacagctctctcttccttcctctgctgccctcaacaatcaagggccagcaggtgggccagtctccctccctcccttcctccttccctcccttcttcattccttccctccttccctcccttttttccttgtcttctccttcctttcttccttccttctctccctctttttctccctcccttccttatagctgcctaatctctgcacatatactacaatcatgactttttcaatagatatttcttgaatgcagctggaattttcttcttgaaaacaaagttagctagctactttcaggaacttaactctagaatcccctttgagtccactttcctttctcactcctccccgcctccaccctgtgcgtgtgtgtgtgtgtgtgtgtgtgtgtgtgtcatgaatccatgatcactacatttaatttaatccacattttaaattcctttataacaaacatagcttcttttcatcatcttgactgacatttctgacacttcagcttttctagtttctttatatgtagtccctgaaatctttttgtttgcttgattgattgtttaaagcagataacaacatcactctctatcctctgcttcaaggagtttaattcatgcatcaactattttctgagcacctacattgtgtgagacatagtttgaggtattggagatactgcagtgaacaagaaagatgtgggtccctgctctcacagagctggcattctaaaggatttttatattctagaacagtgctatctaattcagtggccactagcaacatgcagctatttaaattaaaatctcagttaattaaaaagaaaaaaattaaaaatttagtttattatttatactagccacatttcaagcactcagtagccatatgtgacgagcagctatggtattggacaatatagatctagatgagtaccatcacccatcacagtagattctactgtacagggctattctgaagaatttccagacttaccaccattctgggagtctaagagatccctgtggccacactgtgagatgatttatgatgacaccaggttacaattacttcatatataatctttctttgaaacatgtgggttatgtctaggatgcgtggaacctatgtgtttatttttattttgggtatcctgtttttacttacaagatggttaaattagtgtggtggaatagtatgtagaagtactcacttctcttcctatatttcaagcaggtactggcttggtaccccccaccccagggaacggaaggttgcagcacagaatccagaaatagcccttgagtttctctggctgcttttgtggtccaaatgtacaagctctcagggaccttagagtgttttcagaaggggcaacagaagggaggatttggggaatagataaaaatgtcttggcagaagcagggctggaggagagaaaaaagaaatgtgagtctgcacatacacgtgagagtgtatgagagtgaacgctacacttcatagcttgcgcatgctttgcgggctcaggctacatggtgtttctggagttccactgggagtggccaggttacctatgacttatagtcatgatagagtagaaaaagcatggtctttgaagtcatgcaaacatagggtgaaacaaaagtgctctgttaaaggcagaattacaacagaggctgaaaatggtcaagatggaacaagcgctaaatttaattataggcaaggtattagcaagtctggaaaaggttaaagaaaagtggaatattccaaggttatatcaagagttcacctttgtggaaggtgatgaatgatgcttctctagcatcacaagccattgccaatttcaaaaggagagcctcctttgagatggagaatcctctagccatttggggaggttcctcttcaggatctagttactcttctctattacacaaagtctccagttctatccttttagggctaggtatcattagcttcatctgatctcttatactactagagttccagtctttagctgtcttaaaactctggctaagttactctcaccgtacttctttctatcatctcctattcctacaatgcaagctcctccagccacccaccttcccctgggctattgtcttcatatgatgctaggctttctgcccctgaactctcatcgctgttccctttttctccttttcccctgagtcttccagaacccaattatcactgaatacaaactcctctgctttcttgtaccttttttttgagacagggtcttgctctgttgcccaggctagagtgcagtggcgcaataatgtgtcactggagttttgaactcctgatctgaaatgatcctcctgcctcagcctcccgaaatgcatgagccactgtgcctggccttctttctcatatttttatgagtccacttccccattttcttgccttaattaaaatccatcttgcaggaagacaccacctctctgttaccttttcaagtagaagttgcacatttttctacattgtggttccgaggcaatgtctgcatttttattgatattctttgccttttccaaaccactgtttttcactcttgtgcaaaaaaccctttcttttttgagtttcaggtcatcctgatcaaagtcttcccattcacaccttctcctgtcattattgtgaacaacttcaatatctgtattgataaacacagaagaatctagcttcaagatacttgacctcaactccagcatgttctagaacccatcctcatagctacccctggaccttatcattattctaaactgcttcacctcttaattctgaacaccaatttactattgcctgaccacaacatcgtataatcacggccttcaggacctttagtcaatgtaattgcttctcaggctagaaacctagtcctttgattattcctttttcctctggggttttcaccaactttatacctttcttttcccttcatcttacacctcacaatgtataacttcaaaaacccttgcaaacatctttaataaccctagtccctgttccctctctgccatgtgggcacagcaaagcctcaatcttggattaatccagccatttgtctttcctgtactatatctggggtgcagagtcatgactggggaaacacacaacttatctatgcaaataggtggcccagagcaatcctgtgatatgtaccaagtcagtgacatctgccactttcctagtggtgattataagacatcactcttctcagagctctactgcattgtgctttctctgcccctcctgccccgctgatacatatacagcatttctctccctcttgcctagtaaatgctttgtcctgttgctgatttactcttacatcactgcaattggtttttgcgcttgcactgaaataaaaatgtcctggcaaaagtcaccagtgacttcctgaaggactaactgaatggacgtctataaatattcacccagttggacttttctcttgcatttgacaccgttgaccactcagtattcctctctggccttctcttctctttctacttgtgcccgctggtaagctcacccatcatggcattaaccatcacggtggttgatccctaaatctctatctcctgtccagcttctactaagctccagagttctatgtgcaaaatagccttcttcatggttttcctggaattcccatagaaacctcaaactcaattcaatcctgacagaaaaagtccccatacccccatagttccttgtcccagattctctatctcagtgaatgacatcaccctttagactaagccagaaaccttggcgtaatctccagctcctctgttttaaatccccatccacttttcccactatcaccctctgcaccatctgatttctttccaggttcttttgattgtaccttcctaaaatctcatcctgcctgtttcctccattccagctgctgctgcattagaaatttcctctcacctctcacttcccacctctacccctcttatggactttccacatttttgcttgggagctctgattaaaacatacatcttgatcatggtactattctgagcatggagtgtaagtcctccaggatctgtaccccgtctgtctcctcagacccttccgtcctacttcctatctcttgcctcttactctaccatcagccatactaaatatccactgctcctggaacttttcatactaattcgcagtttggaaggccattcttctctccttacacctcctgctctcatcttcctgaaacatcagctcatatcgagcggctcagctcaaccctccctttctctgcaaggtctcatctcccaccccaggtagaactggctaccttctttggctccatctctacacatgtatcgtcaatggcagcttgcctttcctggactgtaagctccttgaagacaaagcctccgtcacatgtatctctgtgctctggttcccagctcacagtacaaacaaaataaatattcattgactgaagaaagaattcaaagtggagtccaacctgtgagaaaatgctaattaaatgttatgacaatagaacaagtgttgatcaaaacagcgtccggaatcatcacaaagtcctgtctgcagatagctctgttatttgtaaatccattaagcctcagtttgtattagtaaacaagtcaggtgggtattctctataacgtgagctggctttcagggacagaaaatgaggatggtgcctcatattggcttgcttccttagcaatttgtgaaaacaaaacccaacaaaacaaaaccctttcccaaaagttggcactggctcaagttttccttttccaaaatacttttttggtcaagcaacactccccacgctatagctgttaggcattagtgtgctctgaatccattagagaaggtcagttcagaatactaaacagatgcacagccctgagtcttgagaactggagtttcatgattgcaatgcataacaatagtcatcttcgttcatgctgctctaaacttcaccataagcaggcgtattttagagactggctccttgagatgttctgatttccacatgggaagtgaggaacaattaatttgaggcagaaaaataattcaggaatgtgttttggctttacatgcacacacatgacaaaaacaacactttaaattcagtcaacatcacagagacaacatggacacaaaggagcaaggattttttttttttatagcaaacctttgtactaaatatatacatacataaataaagcaaaaacaaaacaaaaaccttcctaccccagactacctattaattttagatggaaaagccctaggcagtaagaaaaaaaagtaacccaggcattaagtagattggatagctaatttggagtgaatggaaagggctagataatattaagttgtcatggtagaaagtaagttttggacattctgctttcacattactatctaaacttgtaaaaatactcagagaagcagaaaggaggactaaatttagacccttacttaatgcattcaagagcatgattcattttcctcctgccctggtacagcctggggaatctgaatatacagccagcagcacatggatgccctgtaaataaatgaaagtcgcattcattcaggggctggagaaagccagagacaccccgttttccctgccaacaaaggtgcacttctaggcacctcacacaccagaatgcagaaccagatttctaagctggcaagagtccatctaattttagctttgctccggccttggcatgaaatgctgctggggtggaaatgaattctgctgctcctcttttctaagtggcttttctcctcaagctccagtgggatcctgaccagctctcagaggccatgccacatgggtcacactgatgagactacccaaaagggtgtcatcatttggtagccatgcatttaacaacccagggcctaagttgtttcatggtagcccttagattggttcttggagagctaggattctatatagcaaacacgtgaagacaattttgggctatttgaaagaaaccagacaaaccaaaaaggaaccaaccacacaacaacagcaagttgcattcccacgaattaaatcaaggtggtaggcaaagtttccgggtagagcggacagtcactgtcccttccccaggttccttatcttctgcttccaatcacattctctcactctcctctgcttccaaacaaaacaaacatttcagtctccacagagaacttagattaaggctgaactatcatttgtgtttagttcaacatggcttagaggtgaaaagcacctaaattatgttgtgactttacagcgactccattttctttcctttgggtttagttttaagcacatttggaaagtaaccttagaagtttcattccagtatcttaggctttattgatcttatcgatctttgatctctgtgtttagaacaaataacagaagaaaaggtggaaggcatatcaaagatctgtagcaaggtaacattgcctcccagaagtgagggcatcaaagccgccctctcttctgaggtgtatgattgatgttaaaaacccaccccaagggccctattgtacatccatatacgtccaacccaattaagaaagagtattttcccaaacatgaaatgggcttagcaattctgaagtaaaaaaaaaaaaagagttagctatggagcacacgcattccgttagaaatgagtcactctgcgaaggtgtgtttgaatgagcagcatttcagaaggcccgcacggggtacacccacaggatgggactggagaccctgggaagggctgtgggtccaggcggatatgagatccgatcagcctgaaaacatgcttcacaaaccaacctgggcacgacacagaaaagaggcaagacgtcgtagggcagcataaaagatttgtacctttctcaaatagcttggtacttgggactccagagcagttctgaatgaccagctagggcagtcacccaatccccactgggcccatccagggccataacatgaatattaaatcatttggaggacaggaatgttcaatgaccttggccaaatgtcatgacagattttgggggcagccttctatatccatttgagaaaggacaaatactcactagcactagacagaaaactggctgatttagcttagaacagtggctaccattgtagctctttcagaacatcgaaaaggaaggtaagtggttggggaagggcatcacgaaggctgcatctatccaaggctgggtcagttatacattgaggtttggagtcgaaatttattctcacacacgtagagctccacagatctaattaacagtgtgggaaatctattttcatgtttcactcacacagaacacatcttctctgtctccagggggttttcaagttctaaactacaatcagcccttcttttaaaataacaataataaatcctcttattcagccagatggtggtgtttgttgcactaggctgggttcatagtacaacatcaataaatggccacttgtagagggacagacagaatcccatttataaaacacacctacacctccctccttctcccatcccaaaatgtggcattgtcaaaacttccctgggggcttaatctcattttggagcagaaaggaaaactaaaaaaggcaaaataatgtaactaagtggaaaaacaatttcttggggggaaatagcacatttaatctctgaggaaaatggtcataggtgggtttttaaaaagtgttgttttgcctttagggactgtttgaaagcaggctctcaaaaggattttccccagtccctggcaagctgtcttggtgaaggctgcacattgtcagccaaagatattacaaccaggagatggagttaaaattcttcctcagtgagttggctaagtctcatgaaacaagtatttgttccaattaggtgttccaaaaagtcttgattgccttagataacgcattttgagaaggaaagtgtgtttgttcaaaatccatcgtggaagaataaatgacgtaccggtgtgttctgttgccaacgtacacatcctcttcacaggcctggaggactcacactctttgctgccttgtccctattttcctggtctcagtcctaccggggatgggcagtgggagtggggatgctaactagtctctgctcctgctcttaataagctatactacctggttatgcaaccctaatccatgtccacagtccagggctcagacggctggcctgtcagcaaaaaaatgtctgaaaaatgttaattcaacaatgttggagggatgttatttccagaactaaactcctcaggggaaatgagaaatcattgctcctgggattcaactcctccacactgaaagatgtttctttaatgatgctttcttcccaaaaaatttcccaatgcctggtgtgtcctgacatttggtcccagtaaaatcctggaacagactcctaggatacaactatcttcaaactccatacaaaaggagtgtttattacagagaatcggcatctattagggcatgaaaccttgggggcttgctggcattcactccccacactgaatcgtttcataatatagatactattttctttttggcatttatagcaagcaactcagtttatgacctaaggcattttccatacttccaggcaatgaataccagcttcctatgagtctcaatagcacataatttaagacagtgggaaagggagttggagaatagtttccagtgcaagaaaaataccatgcagatgtttgcccttactcttgaattctgatggtgaaatcgagcattgtttatttgttctgaagtccaactcaagaaatttattttctaaaggctggggtagaggtagggaggtagtgacataaaatattcctgatactgaaatattcaacacatggccctgggagtttgaatcataaagtaatttagatctttctaagtggttcattgtttgatcaaatttggtataccagatgtcgattcgtgtcacagaacatgacatacctaaagaaatacccaagaactactttgctaaaattgtgtattcaccttctgtaatttttgtttcctccaagatagcaagctaggaatcagtcctctatcttgagccatttattgagaacaaacaaatgaacttggaaaagacataaccgaattgaatttaaatacctgactttggtgtatgagaatcataaacttgcttacggtctatctggtccgcaaacacttccccataaatcatccaatagggcatgtagaagatgttcttggccagtttccatgatggctcctcattgggaaaaaggatggcttgcctggcgaccccaaagctcatcagaaccaccagcataatgatgacaaagtacatcatgtctatcatctggaagggtggggaagcagagggagaaacaagagaaaacccatatgattgagtgttcttataattgctgacaatgatgggaacctttggaggaggtccactttctagactgctgggaagggatgtttagacagggagttgtgtccagataagaagatgcttggtctgttgaagccagtgtccacagaattctatcagtgactcaaaaaacatttcaaaaagtgcacacacagatgaagcctcttcgtttttcattgctgtctgtgggaccgagcataggtcccacataggctaggcataggagtcatataaatggaagcttaggcctctgtgtgaatcaggtgctaactttttctctgctcctgggggaggcaagtgtcctctttgggtctctttcttcttagagaaactggaattgggagagttgaactattccaagagcgactgcaatgctgtaaacctcctttctaagttctgaaaggctaatgaaaaattggaaagctcaaaaacaaaacaaaacaacaacaacaaaaactgcctataaacgaagctaggataaaccaaatatccattatattcttattcttgtggccccaccccactgcatagtattctaccaccaaccagtctctcagagaaaatggctgtttgtatacttctcctgcagggtatcccattggctatggagggtgttttcttgggcattagaatcatgcaccctaatgactcagacctgtacctgctgtagaaatgatggattttcatcttgacaggtttataaaatcctccaggctgctctctaatataatgttatctcttgttcctcattcttccttctttccatgatgtatgttatttgggatctgtttcttatatgccaaattattttccttttatcactcaaaatattaaatagatgaggatgcaataactattgattttttttctggccagaacccattacctcctccttttataaacagtttctacccagtatggccacaaggtaggtgtgttttccaggctacgttaaatatgatactggccccggcaagagtgatagaagcagggatttgaccaagacaggccaaccagaatccttgtattggctttgctttgttttgtttttaactaaagctgggagaaagaagttccttgtgtctctgtaatggggtgagttcatagtatttgtatctgacgctgagttctccgccagtgaaactgatcagagtaaatgaagccgatttgcaagagaaagtgagcaaagcttgacagtgattgggtccctgtttgcagtagcccctaaggccagtttcattatgcccttcataagtcaatatatcccttctaggcttaagctagttggagattggtttctatcgcttgcatcaaaacatagaatacaaaagactttctcttagataccatacttcctgaagggatgcccatccacaaaaaaaagcctaatgctaattttatcaatgataatggaggcttcaaattagttttacaattttttaatttttattttattattatttttcagatggagtctcattctgtcacccaggctagagtgcagtggagcgatctcggctcactgcaacctcagcctcccgggtttaagcaattgtctgcctcagcctcctgagtagctgggatttcaggtgtgcaccaccatgccccgctaatttttttgtatttttaatagagatggggtttcaccatcttggccagactggtcttgaactcctgaacttgtgagccacccgcctcggcctcccaaagtgctgggattacaggtatgagccactgtgcccggccacgattttgttttaaaagagtgtctgttattggaattcaaacattatagccttccttgtatgccttaggacactggggtctaatcaattttcaaggcaacttcaaaatgcatctcacaagtgttgcatgacttaaaaaccaaacaggaatatcttaaaatctgacatccattcatatttttaaatagtctttaaagttgtatgctaattagttatttcttctatagtttagtggtctcagaactcttttaaagtgagcaagccagctgtgttgaaagttttatagaaaacatgggtctgtttttcatcctctctcttattttataaaattctttcatcatttatttacaaaaagttctatcaatgaaaaagcacacatgggtccttcatgttgtgtttatttacactgattaaaagatgggttgggagaggaaggtttgtgctcatgagatttagaagctagtttgacccaaggaaactcagccagtaaatacagaaactgttctaatttaatttctcaggattgtttttgttcagattgattgtgctatctatccaaagggtcaaaacaatcaaagagaagaaacatttttcccaaacacttagcttcatatatttcaaagaagtcttagctttcatacaaataccaaaatctgatagaatgcagtgcagaaatagagcattattagtgagaactggggctggcctccttttttaaagctaaattatccagtcggttcaatattaagagagctgatcctgtcctaatcttgtaaatatctttctgttgtgttctacagaggagagtatataatatatattatataatttattatatataatgtaatatataatacacatatatataatatgcattgtataatatacattataatgtataatgtatatataatatataatgtgtatataatatatattatatatacactgcagtggttaaacacatgtacttaggtgtcagaatacctgggttttcatcttgactttgctagtaaaaatagctacatggaaaaaaactcacacaaaacgagtaaaaataattacaaaaacaaaataaaggcttcctaaatgttaaaaagaaagaaagaaagaaaaagaaatgtagctaggtggcctcgggcaagctgcttaatcttgttttattttatttgtaaaataggaataataatacatttattttataaagattcaatgagatggcatgtgaaacaatgtggtaagttctccataaatgttaatgtattattattattagagttggaaggaggtcaggttgtggggtcagttagacagaaatttgaatcctgttattgtcccttgattagtctcttattcaattgtttaaattattaaacacagatatgaaaacctatttccgagggggtatgatgatgacatgtctgacatggtatctggcacacagcaaatgatagctatcattattgtttttattctgaattatgtaagtgagcttagtactaggcttagagaattccattgagaagtggaatatggaggaaaggagtcaggattttgttaagtgattctgggcctgcagcagatcaattggagtctttccggatatgcaggctttccatgctgtgaggcatttggtgtactggcttcttatattatgcaaagactcatagtaccaatttcaaaatagactcctaatgattgtgtgtccaggaatctcatcagctgtctgtccctagaccacagggcagggactcacttggctgttttgtgcttaatgggaactccctaatgttgagaggctttcagtataacacatctgggcacattttcttaagttccagcctggtggtccatctgactcactgataaattctataggcatattttatctgccttctggatcagtgcatcaattattgaactgattatcttaaaagccccttgaaagagaagcaaagtccccaagtgtactcattttgtacttattcttgactgataaatgaagtcattcataagttaaaaggtagagaaaatgcagtacattcctcttgcacactcctgagtaaggtttcattctagtcaaaactgggataattatgccattattaagatgatagacgtggattttaaaataatctcgctgcattagcatgacttcagttattccaagtatataaatgctacccaggctttaaagggtaatatatttggtttgtttgggtcttttcagattttatttgttaaaataaaataaggtagcaatcagaaaaaacatccaatctgattatgtaatcacagaatgcagtaattctcaacagaggccaatttcattccctgagggacacgtggagatgtttagagacttttttgtagtcataactgcgtgtgtgtgtgcacgtgtgcatgctactggcatccactgggtagacactgctaaatatcctatgatacacaggacagcttcctaaaataaggaattatacagcccacgatatcagcagtgtcaaggttgagaaaatgtggcctaattttatagctattatagttctttgctttcattgggtccacttgaaaatacatttgagaatctcatgaaagcttgtcccctctgtccagaaaattcacacacccacacatttttatatataaattgcagagagggtccacagatcctacctcctgagccctatcccttgactctaaatctagactctctgcttttagacaggaattttcaccacaatctcaaattcattgttaaagtgcaaagaagatgatataacaggcagtataatggagtaagatacacatttttttcctagtcaaaaaatccccaattgaactggggttccgttttgggtaagtaactcaagctcatgaattcaagtgttttttctctctagaatgagtttggtgatatttgtcctaaacaatgctggtgttataaataccatttgtacagtagggttaggaatacagcataataactatactcaccaatttttcctttctttcattgtatttaaaaaatgcaatttgaacataatgataacagatataatttgtcaaccaccaactatgagccagacacagctggtcatttagtatgtattatttctaataattacaacaataaccctataagatatgcatttattatacatcactactttagaaacaagtaaaccaagtctcaaaggggtttaaataaattgctcaatgtgttatacccaattcattttgaatttgaattcttcctctctttgcatgagtttgttagtgattttgtaagaaaagtcgtgattatttaagattcatttcagtagagatacacatacatacatacacagagctgttccataaatattgagttagcaatgatacatatagtaaatctcaagtaataataataaagaacatcagccaggcatggtggctcacacctgtaatcccagcactatgggaggctgaggcgggtggatcacttgagatcaggagtttgagaccagcctggccaacctagtgaaacctcgtctctaataaaaacaaaaaattagcctggcgtggtggcaggtgactgtagtcccagctgctcgggaggttgaggcaggagaattgctagaacccaggaggcagaggtggcaccactgcattccagcctgggtgacagagtaaaacactgtcaaaaaaaaaaaaaaaagaacatctattgactaatcattggtttcaatggctcatacaatggaagtgaagtgaaagatattagcaaagaggtttttctttttctgttttcgagaaaaaaatacctcaccgcagtcttgaactctgggctcaggtgaccctcccacctcaggctcccagatagctgggatcacaggctcatgtcaacacacaccctgttaatttttctttttcttttctttgagacagagtttagctcttcttgcccaggctggagtgcaatggtgtgatcttggctcaccgcaaccttgcctcctgggttcaagtgattctcctgcctcagcctcccgagtagctaggattacaggcatacaccaccatgcccagctaattttgtatttttagtagagatagggtttctccatgttggtcaggctggtctcgaactcccgacctcaggtgatctgcccaccctggcctcccaaagtgctaggattacaggtgtgagccaccatgcccggccctaatttttcattagtttttgtatcaccagtgtctcactgtgctgcccaagctggtctcagactcctgggctcaagtaatctgcctgcctcagcctcccaaagtgctggaattgcaggcatgacccactgtgtctgaccaggaaaaaggtttttcagtaagaggtgttcgtcatggtaggacagatgtacttagcttttccacatatatcttgtaaagatgaagtaggggacacacttagaaaactgggagaactgatgaaaagtacccagttctggcttcaggctctgattcttcctctagtgagttttgagagggagcttgtttactgatgcattcccagattcacactgatgctgttctcctagggttcagtctctacggaaaaagtctggaaactggtgtgtggtcaaggactattggaacaagtccttggccatttgtagggaagcatattagcttgttacttgggattttttcttcaagaattcgataagaaggagcatcattctggaagctagttcttaacagacatcattttccagtagtgtaacaaacacatgatgcatgatagaacttaatgttcagttcaaacccaactcaacccaactcaaatcagcacaaataaattatgtttttcttccctttgtgtagggaaaggcatttttctagaactttatttaaaaatacaggatcttcaaaaaatctgttaaaaatttgtagtggagacccattccttctccaacacccagctaaaatgtaacctctgtgtgctttttctgacctatattatcttttctgtggttctgttgtactttatacacatctctattacagcatttttcacatggtgtggtaattcctccctccctctctctcccatcaattttaatctcatggaaagaacatctttgtatacccaactcctagtccagtgtccagcataaaatagatgatcttatgtatttttcagtaaatgaatgagtgactgatggataaattctccagttttgtatatagatgtagtcaaacccccaaacattcaaaaggaattcataaaataaaacacctctagggccatctcatttagactttgatagcaggcccaaatgaattatttccctctatctattatcaccattcctcctctgaaaacttataacatggaatcagaagaccctgcttaccatttttccaatcatcattacatacgggcccaaatacttgttcacgccgaagatgtctaggagacggatataccagtaaatgatgttcacgcagtagatgaccctcccgtcactcctgaagggctggtcttggagacgaaggatcattccgacagaaaacagaaggatggcgatgaggtccgtgacattccagtactcctgcagccataccttcactttctgtagcaacttccctggctctgacatcagaatctataaggcaggaaggagagcagagttaggtctggtttctgtctgtattttcagcccagttgggaagtgcttggtctgttggctgatgttagtagcttgctttgtctacctatatctacttaaatacttgcatgctgtaaaagtccgactgagctaagcttaggtgattattcagctgcaatattccaaaggcacatataagcaataattttgattctttgggtggtggtaaaattctaagacacacataagagttttgctataaaatgattcaatcctagtatgctgcaaatctctgaagtcttccttcatctcagtaaacagtgccaccatattgagttcctcaggctgttcacttgggaagactcctccatttttctctttcacatcccacatcctctgcaccaagtcctatcacctctatttctaaatgcaacctagccaactacttctcaccacctccactgctgcctccctattctaagctccatcacatcttacagattgcagcagccttctaactggtatccccatcatcgtcattgcccacttaccctcaacccattctctgagcagcacaaataatgatctttaaaagcctggatctttaaagatctggctggcaattaccaggttatatgcataggtaaaaactcttcaagctgcacccttaggagttgttcaattatagataaattatacctcaattaaaaaaaagacttaggagacaaatgaacaacaacaacaacagaaactaaagcaaatgatcataattgtatgcttaagctttctgatgacttccattacaaatagtgaaaaatccaaactccttatggtcgcctcatttcacgtcccatcatattctcctttattctctaccctgcagccatactggtcatctcttaagcataacaagtttattcgatattcaggatgcttgtacttattccttctgttcagcactttcttctcccagatctgtatttggctcctcttcatcttcaaggtctctgatcaaatgtcccctttttaggaaggccttttttgattactttagctgcagctgacttcatgtccccaagtcactctccaatacattaccctatttatttttttgaagtttttatcactatatgaagttatctactgtagcttttatatgtatgtgtgtatgagtatgtgtgtctgcctatcaatcaattgatcaatcatctatttattcatctgtccatccattcttctctctttcctagactgaaactctgagggcagaccctttgtaccccaggcctgttacataatagaaactcaatacatatttgtcaacagactgactgttgtgtaggcactaacagcaattttccagttccttgcatatcctaactcctttgtgggactcttgccttaccttaaacttagaggggctaccacacatgggtctatgaaatgcacagctggacagcagaagttgcacccatcctgcatcacagaccaccccaggatgtgagaagccagggaatgccacttagtgaagctgtgcaccagggccaccttcctcaattgctggtgtttacctctgaggattccatctcttcaaaccatgaccaacccctttccccacctcagaacctctcaaaggagaggagagaaaagactggaggcaggtctatatccagctatttgtgtgaatcctcatgtccactataatgatttacctaattctgaaatactaaggaagacaggttttcgtaagtcagggctgggacttggaagctgagcagggtaccaggagctacccaagagccctatttttcacaggcagtgtcctgccctaagccctagcccagggtttctaaacttcagtgcacatcagaatcagctggaaggctgggtaaaatatagatgctgggccctcagtctggagtttctgcttcaggaggctgggggtggggtggaggatttacatgtgtaacaagttcccagctcctgctggtggccacagtttgagaaccactgccctagtcatcagcaatctctgcagctggtgttgtcctgatggcttctcactccctggctgcatcttaacagagcaaaaatccgtgtatgtagctgggagagggggttgatgggcaatgccttgagcttttccaaccctttgctcacactttcctaaaactgctaaacacagaggtttgtagtatcatttttaaatagtgaagcattttttggtaaagtcccaacattaaaaaagagatgagagcagaacagtccggggtgaggcagaagtggaaagtcaagaatcccccctgcctcctccacctctcgaaccagccctcaggcacctgtcttagaaccctgggagcctgaggagcatcgtgggggagtagaaagagcagtgagtctagggacggatctgtcaggttgcatactcagttgtcctttctagctgtgggatacggggaaattgctaaaaccctgagtctcagttcccagacctgtgcagtgggacgtcatcatagtcacgccatcgacctcacagagttgtcggcgggggtaggatccagatgagataacgtctacccacgcatgctgtaaacagtgccatgctattaagggattaccggggcttgctttggtgactccgggcagaagtatgtggggctgggaatgggggtatcatgggaaaccacaaagccttccttttgtgtatccctgggaaggcaccaaagcatgcaaacttttccacatttccaggatcttgcgtctgagccctggaggtcctgcgtgctgactgtgaagaggcaggaagggcatggcctgtggggtcctcaccctttggtcgtcaagcaactcttcagtgagttcagggcaggacacaggggttggggcgccgcctcactgagccgcagaggaaaaggtcagactcggaggtggtcaccgcctcactccccacgggaagcgggaatcttcagttgaccccttcctgactccagcctccaaagccctgccctccctgctattctatgcctcttcaggagaaatggatatccaggcctcgaggctcctggcagcctgcccgtttggcagcctctgccagaacagtccgtggagtacagactgctccctgtcttctcccagtctggtccctggagagactccaatctccctgctcgagtccttcccttttctgcttatcatggggaaggaatatgcgtctaggcgttaaatcgctcgagtgccagctggcacagcacagccacagggccccagcaggagcgggcctcagttctcagagagctgcacaaagaccaaagcaaatttattactgtttttcagtttacaaatgggaaatccacaacattggtcaagaagaaaaggcaccatgaatgggaagaccgaagtgcagacaaccagctggaacaaggcaaggcattccttttttttttttttttttaaatccaggctcttgtaaaatgagactagcagagccattcccaagttctcaggatggggagatggtagtcagagttaaaatatcacccaaatagtttaaaaactcaagagaagggcttaagagataagacattttttatgatcccaatacaactgcatctaacagatactgcatcttttctctggaagagaacattatagagctgaaacccttgccttttaacctgtctttgtaatgaaggcaagaatgaagttgtggatttgtaggagtccttttttcctatggtgcccagtatgttttcccacccactgcagtacagcaattagggttgttcttgagctcttaaagacccagtggacttgaacgggagcatttcttccagaaagggcctgtcctgcttactgtcatttcaggaaaaatgcagagaaatcagcactacctcctaagcctgccttcctaatggctttccctgatgaaataggagcttgtggtgaacattgagtggggctgcagagccctcttgtggattttcgcttaatcacattctttttagcagctctgaatctgatgggcccctgaggttagctctgatttcaaataaaccatttaggggtggcattttgaaggctccttttaggccatagaagtggggggagaaaagagggaccctgcactcacaacctgaaggatctgtgttcagttcaccttggtggtccctcctgctggcagagtggttggtgcccagcaggtacgagcagaatgttaagaaataaaccagagaataaatccaatcagtgagtgaaagcagagttcctcctaaagcagccgaaatacatccagagagtcacaggtattggcagactgtgtccgaagacacccagaataagggggagaaatgggagttaaaagtggcaaaatctagaaagtcatgtttatagggatgaggcatcaaaaacaactagaggccttcttgggacaaaggctacgttagcagagaatagaccaaatcctaagcactcagggagttacacccctataagcaccacactgtgaagcctccccaggtttgtcagaggagcaaagaagcagctgtggtagagttagagaaaacagtttccggcttaatttgcatcccaggcatcttcctgtcccctccatccacagatagaacttaaccactgtctttctcttacgttttcttttataaaagccgttacctctctcatcttttctattcccagggtgaaaatataggagattacgatccattcctgggtggacggccagcgttccatcttcactaacacgatatagttgaagagcatcaggtatccgatatacgccagctgtaaggagacacaatacagtgctctggctgttcaggcccaggagccccagcatcagccaaggccactgcacagcagcacagagcagggtcagcaagcaggacacagactttatgacaaaaggaacttgaaggtgctaaactaacaaaagaattagaaaagacagtaatacttgaaggattataatatgcaatcttccttttgacctgtacatgtatctctggggctctggtgcttcgtttaaatctatgtgtcatgatgcatcatttcgccttgcagttacccatttttgtgtgttttcttggctaaaaagggagccttggctgtcagtggcggctcttgctcaggcgtggaccttaggttcttaaactagggcagcacagtggatttttgcctcacgaatgccaggcagaataagtgtctgtgagaagcaaaggaagaggaagacacatgtaacacctgtaaattggtcaaaccaacataaaaatagcccaggcttaaagtgcttcgcttgtcagtgccctgggagggtcttacctgttttcatttcaccactttcctgtcctaatcaagttaagataagatattccttcctggtgtctgcttcattgaaacaacacaagaaaagacaacacagtttacagaaaggaaagggtccgtgtggccttttgtggacgggtgtggggtttaatccccaagaggctctggctcgtggggttgaatcctgatgtgactggctgaattgctggatgtctgggaagaactccctagggtttggtgactgctcctggaagattcagttgtgtcaaggtgagtgaagtgcagggaaactggtggctcttgcataaggggctgaggagccttgagagaagactcactcaccttaagggaaatggcagactagctgggccttccttacacaatgcctcaagtcaagtgaggtactcactggccttaggggcctcaggggctgtgagcaggaaccaagagggagtttattaactaaaatctgctgcactcttcagagtggtgtagcaaagaatagacacagtgtgggtgaaaggattgaggccttgaggggtctggaggtactgcatgactttgtagctgggaaggcagcttagaaggtggaggaagctgcagccttgctgggggatatgctgctttctctactaattctcttatgttttgggacagggtctcactctcgtcacccaggctggagtgcagtggcattgtgatctcggctcattgtagcattgacttcctgggctcaggtaattctcctacttcagcctcctgggtagctgggataacaggcacgtgccaccacacccagctaagtttttgtatttttagtggagacagcatctcactttgttggccaggctgatctcaaactcctgggctcaagagatcctcctatctatcttggcctcccaaaatgctgggattataggcatgagccaccatgctcagctgaatggattcttctttttttttggagactgagtctcactctattgcccaggctggagtgcagtggtgcgatctcggctttctgcaaacctcttcctgggttcaagcgattctcgtgcctcagcctccggagtagctgggattacaggcacccattaccacgtctggctaatttttgtatttttagtagagactgaggtttcatcatgttggccaggctggtcttgaattcctgacctcaagtgatctgcccgcctcggcctcctaaagtgctgggattacaggtgtgagccactgcgcctcgcctaaatagagtcttaatatgactccaaggtatctctgagaccccatcacactgacacatttgcagacacaactgttgcacaaaagtccctcatctcttaaagggtgaagtatgtcggagttaaataagatcacttatgagagctggatatctgggctcactctctacatgcatggtttgtgctggcacacccccacccccacccccaggggcctatcatttcaacctatgcctaagttcctacccctccccatcttcaggagcattggcaaatcatgaaaacttctcatgaaggagtttacttaaaattgtgtaggacgctgtttaaaaatcagttcaaaatggaacttggttcatatggtttccgtttaccattattatacactggcattaattctgtagtcctgtgagtacagactgcaaaaaacaaaaaaaggactttagtggttaaaactctaaaatatactctcagcctccttctgacttgaactctttccctctccttgttgcttccttctcttagttgggtcaaattccatcacttgtaggtgaaatgaatattgttaactgccctggttttatcattttgcccaaatgattgcaaaacattccaaagcattatcttctcttgtcatatgtaggcctagtgacatgcacattcttccagaacctctgcattttaatacttaagtaactccttaaacctattttaatgcttaagtaactccttgaacctacatctgtcctctgaatacaagtctaatgtgttcagtggaaggaaggtaggcatagatatcagtgaagcttggatttaaatctcagctcacatacttcctagctgtatcaccttttgtaatgttaacctgcctgggcctccattctgtaacatgggatcacttccactttccttatagggcctttataatgactggggatctatatatctatctatctgtctgtctgtatctcccaacacactgtagaggcccaataaatgctggctgatattattctgttattctttttgtctcctcttcccttagtccttacttccctttgatccccaattaactgttcacacctctcttctttttttttaaattgccctcattattggttatgtttcctccactttcatcatttttagcccctgcctgttttttacatcacagttattctataatgaacttttcccatagtcaagctataatataatattttgggacaactctcaaaatacagacttctgaaaataggggcttatgtttagatggcataacagaggactggctgctgtcctggaagcagcctatcatagaactcaccaacattcatgcagccttgctgtagattatcttgacatgacatgctttaattgtgtgtgtgtgtgtgtgtgtgtatatatatatatatatgtatactctgtaaggtttagcaacctgtatgtagaatttccaagcttttgaacctgtgagtcttatttaagtaagtcagtaggagaactctaagaatttgtattttattaacatatattctttctatgcattttccattaactaagattcatgcttcttaaactaactatcaaacacaagcactaaagcctgacacagtttgctatggatccctggtggggctttgctcttcctcacttcttcctgggcctttttctactacctctggagagcagaggggcacatggtcttgtagaggatagagttggtcactactagagaaactcagagcacacactgtgtcctctgacctgcagccacttcacaccttgaatttgaatcctctccagatggatacctgaaataggctctcaaaacaagcagggtctaggagccagttggacccctgcctcctttcttcttggaccagaagaggacccaatctgctcctagagaaacttgctacgatgcagaagtgaggttatatggaaatgaagtgtgtcctacctttcagaaacttgggagagtaggagagaccatttttgaaaatctggtgagaaatactcttacagagaaaaacacagcccaaagcacatgggaccttcaatctgaaattgaattgtactgttaagcatgtctggtgattcaaaagactggcataccttatttccagtcacttcctcgaggcctgggctttgtcaatatgtgaagatgaattttggagaatcatgtaaacacaattgaacagatctgggggatccagtctgatgggtttgctgaggccaatccagtcagccacgcagaagtgtgctggacacacaggccccaccaccccccgccaaagaggcagcctcccaacaagctgccaatgacataagcaaagcagcgtgtctcaagtgtctccaatcataagattcgcctgggaagctggttaaactaacacagcctcttaggctccttcctgaagactggattccatgggtctatgatggggctagaaatttgcatttctaacaaaactcccttgtcatcatggacgttttagagatattgatactattatttctactgatttctgctctcgggagtctgtaaactttttctgcaaatggccaactggttaacttttaaggctttgtagaaccgatagtctctctctgtctctcactactcatcaacttgatgtggtagcacaaaagcagtcagtcagcctattgctaatggtaaatgagatttagcctaaagctgcctccttaagttcggcctgaagttttctctgtacattgtgaactataacaaatgaaggtgtaacaagaccaatcaccgagtttcggtcaatcaaatgtagccaactgctcaaactgtgttcaaataaggcaaacgctgagctgtaaccaatccagctgtttctgtacctcacttccgttttctgtatgccacttccctttttctgtccataaatcttccaccacgtggccctgccagagtctctgagcctactctggcttggaagactgcccaattcacgaatcgttcatttgctcaattaaactcctttaaatttattcggctcaagtttttcttttaacagaaatcaagagtctgcctgtgttccaattatttatggacactaaaatttgaatatgtgtttcaagtattccttttcaaattttattaaaaatgtaaaaaccattctcagttcgcaggccacaatcacaggccatgggttgaatttggctcaaaagctgtagtttgccaagccctgttctaagctaacagttggggaatcataatataaaaggaaggacagacctgggtgtgaaatagctgcaaaaatattatctcgggctgggcgcagtggttattgcctgtaatcccagcactttggtaggctgaggcaggcccatagcttgaggccagcagttcaagaccagcctggccaacgtggcaaaaccccatctctactaaaaatacaaaaattaattagccaggtgtggtggtgaacacctgtaatcccagctactcgggaggctgagacatgagactcacttgaatccaggagatggaggttgcagtgagccaagattgtaccactgcactccagcctaggtgacagagtaagagtttgtctcctaaataaataaatattatcttgataaaatagttgttaggattacaaagagtacttaaataatagtacctagaacattgcctcaaacttagtaggtgctcaataaaagaaagatattatttttgttgagtggatgtatgaacacaacactgattatctattgctgggcaacgtgaatagcctagaagaaacaatagtcacagttacattgtacttatatgtcaaggaactgttctaagtgctttacatgttttaacacatttaatcttgattaaatcctataaaatcggaactactattattggcatcttaagaaaactgtggacagaaggggaaattaagttgtttgagggcacatggtaagaggtgcagatgggattcccacccaggctgtctgattccaaagtccatgcttgtcaccactaagctgttttctgcaaggttaaaaataatatagagctgtataaaatatatgaatagaaacgatttttgcatgcctcagttatttttggggggagagaatttttctcttttcctaacattgataaatttgaatttttacctcactgaaaacatctaatatttacatttcgataatatcctatcttttctcaagaccacactttaaagtggtagtttccgaatggtggcaattttatcccacaagggaacatttagcaatgtctggagacattttgattgtcatacttgggggatgaagagttgccactgagtagaggccagggatgctgtaaaacatgctacctgttggggacagccccccacaatgaagaattatcctgccctaaatgtcaatagcactgaagtagagaaacccagctttaaagtcaatgttaagtgttagcacacaggaccacgtgaaaagcacctcatctggtcatttgagtcattttggcctcagattcagattatcctgttgctgactcaaatgactgctacgcagctggttgtggaaagggctaaaaatacagatgcactatccttcatctggcacagttccaccgtggctggaaagaattggagatgacctgggccaaaagctcatcttaaaaaaaaaaaaaatcactgaacagtagaagtagagaaccaataattgaacaatttctaccatatcaggaggtcgtcatttcagggacaatccactcttttgtaggcagaaatatttacaggatgtgcaaactaaacaatatttgcctttgagtagtttttgctgctgtggtttgcatattgttaattgtgttggaacaagaagggttgtttgatgacactagcagactgtgagtagttacacatgcacacacacgcatgcatacacacactaccttctttagtggtgttacctccacactctcctcactccttacccaccaaaagtacccccaaatccgggactgacatctaaaatgggcaactgtgatctagcccttatccattcaaaacaaggaagtatttcggaaaagaacatctactttcctgttaggcaagactcatactcatctcacctctattactgttagttctcacctccaccatttcctttattttctgagaggaggcaaaatgtggcctgtgaaagctgcctaacaaacgccacaaatcttgcagagctattgaaaaagcaaggtcacagaactttcactcctgtgtgtggcacttacgacttgcagagaaaaccacacagatgcatgagaaatggacgttggctccttgtggccatccactaggaaggagaaaaggaaatgtgcttactgtgtagaaccagaacttcacgatgggtgcattgtagaattcatagatttttctgccgagggggattaaccggtgcttgctctgaacttcctcttcatccttcttcctggaggactccccgttgtttcgtcccaacattgcctatgttggaagagaatcgataccatcatgacagggctctggagagcatgttgttcaatgtgcttactttacagatgaggaaaggatgctcatagaacctaagaacccaaggccccagagatttagaggttgtaccttccctaagagtgcatttgcactacacgtataatctgtgaataccctttgcctgagatggaaggccttgggtgtatttcttgaccattctcttctcttccaccctgggaattctagaagatgtgggttatagatgatacccagagtccagagaggaagaaacagtgtagcctgggaaggccaggcttcaggaatctattcttcctccccacctgctctctttctatatatcatgaaacaggctagatctgggttcaaattctgtctcttcagatgataatgacccttaaaggtaaattggaccagcatacctaatttatccaaaggttgtgaatactcaagaggtaaattatctgctgtgcctgcaattagttaggttagtgatatggtttggctctgtgtccccacccaaatctcatcttgaattgtaatccccacatgtcaagggagggacctggtgagaggtgattgattggatcatgggggcagtttcccccatgctgttctcgtgatagtgagttctcatgagaactgatggttttaaagtgtggcacttcctcggtctgtcactctctctctcctgccaccatataagacatgccttgcttcccctttgccttccaccatgattgtgagtttcccaaggtctcttcagccatgcagaactgtgagtcaattaaacctctttggtttataaattacccagtctcaggtggtatctttatggccatgtgaaaacgggactaaaacagttagcgacttctccctgacccttaggcatgtgccttggttccctaattttaaacactgtaaatcctgaattactgctggtactagttttatggaagttcctgtgaacactgccttcctctgcaactacgtgggactaggagaaggattccattcaggcctgacctggagaggtcctcatctccaagctgctggaaatttccttgagaacagaatcatttccttttcattcatgacaacagtagcagtgacaactataatgacttaactgagaaagagttccaggccctgggtcactcagacgggagactgaatcctaactcagacacttcaaattggtggcaccatgggaaaggtttttaaccactctgagacttagtttctttaactgtaaaatgagggtaataaagtactcactatagggttggcctacaagtcaggtagcatctggcacttagtaagtgctcagtaaacactagctaggctttaaagtgaactgagaccttcttagacactcctgactaaaatgatctagttgagatcactcactcactagaacaaaaaagtgttattagaatctataacagcataatttcttgactttaattcttcagtactgttctaacacaaagctagtttcacaaagtttggagatttttattacatgtgaagacagggtaagactttataacttcaggactgacaaggatttggggcaagacagagtactgggaaacaagcttaaagttgagagagctcattatagaaacaatgcattagttttgaagttgagaatagagacaatcctagataattctggcttaaaaccactttacctaaagtatacaaatattagtttcaactacttggttcattacctcaaatatccactttactcaactatgtaataatcacaaatgattgacctgtaaccaataggatttctggagaaggtaacttccattcctttgtggactccggctggaaaagtcccttgggttaataaagttagattccatactaagacttattgaagtgtgtattttcatcattgagtggagtaaatctttctgatggacatggcacactagactgtgatagaattctataaatattgatcattgacctcaagaaactgaggttacatgacatttggctgtctataatttatgtaacataattatcatgcctctgttctgcttatttatatgcttgagaatctaatgctatttgcggacacaatgagatgagagtaaagacagccagaaggtttttaggcatcttggagagtggcattttggggtaacttctggggatggtgactttcccaacagagctatagacatgtcctgggtctgtggacttgtggggactttattaggcaaagtggagacatttaaccagcactgcattcaaaacaaaagcaaaaacctgttttgcctttattattcagatatattccagcatgaatgcatttgtaaaaggcttgtctttcacgggtttaagtaaagcatttttgacatttcattaattccagcctaagcagcttaacttgtgattttgtttatgtcttttctctgtattcagacatttcctttgacattccttaaagcagaatctaacagggtcaaatatagacaaaactgcacagcatgatttgagaatctatgctggctagacacagatgtcaaggctgagaaagttcttttgaggtgaactaaactactaaaagctacaaaaatggagtgaattgaggttgatattttcgtgtgtcgttttggaagggccaaaggaaaatgtcccattccaagagaggatatactggtttaacacagaagctcaaatatcaatcccataaaaggaggggaagtgccaatgagctgcactctgcagttctgtccaagttctgtccactgaccagtgcctgagcagtgacagaatttgccatcagagtcaagggaagggtccactttacagacaactgctgtccagccctgagtttgccaggccacatgtcctttccttctttccttctccctgctgtttctgcctgtggagaagaagcttgggcagcaaagctcttgcagaaccttctactgggctcttagtaaacaacgtcagggtctattctcttgttactaaactttgctcttagtctagagatgcatctcttatggtggcttcttgaaggatcaggttctcaaagctctaggctgagcaggggaagctacctccctttgctttcttccttgagacccaaccagagagaatgctgattcagtttctggatgtcttcctaggatgtgtgctgatgtcaggactgtgccacacttgactttggaggctcattcatcacttttggattctttctgctacatggtggaccaaatcggctgagtggccacacttgagactagagagacattctctctcacccttaacctattgtctaaaagtgtggctgatggagtctatatgcctgggttctaatcttagctttgccatgaacaggctgggtatccttgagcaatttaacctctatgactgtcagcttcctcatttgtaaaatggggattaggactgggtgtggtggctcacacctgtaatcccagcactatgggaggccaaggctagaggactgcttgaaaccaggagttcaagattagcctgggcaatctcttaaaaaaaaaaaaaaaaaaaggccaggtgttgtggtgtgcacctgcattcccagctacttgggaggctgaggtgtgaggatcccttgagcccagaggatcccttgaatcccattgaggttacaatgagctataatcacaccattttactccagcctgggtgacagagtgagaccctgtctctaaaaataaataaataaataaaatggggataataatagtgcctatcttgtgggacttttgtgaggattccattagtaagtatgtgtaaagcacttagcactgttaaaacagtattagttcacagtgtgccagtctccaatataagtagtttacaggcacactttttacacgagacaactacttgtgaggtagacaacattattgttcctgtgtttgaggttataaaattgtgcccaaggtcacacagcaagtaggtaatggggcaggattctggctacagagcacatgttcagctgaaatattccataaagattcagtattactattgccaattttcttctaatgatcaaactattatattctattcagaggacaaaactatggtgagattgttagggaagacagtcgtctgttacagagctgagccgactcctccacagatttttatacaaatcctcaaactgaaacaaaagttggcctttcattcagtaagtcagggattatgtctgcaaatagatctttaggagaagcctactggaagcaaatattgtttacctgcaggagaaacaattcacactgctgtcctactaggataataatgcaaaggccttttgtcacctgagcaaaattaatttgtgatttcaccccttatagcttctgggtcactacagcaatggtcattggtgggggtggtgagggagggtgaggcatattgagaaagtccttatggagctgttgcttgatgacttccaagctatgaagccttgtttgtccctttaacagaatgtgatatttttagcctctgcacatgagccagtggcagtcacgctgctcaggcgggggttgcaagaagctgtcccatgtccagctgcccccttccctctgcagaacaaagcctctatgctctataattatatgaggaagagctaataaaagctttgcatacaaacctcaaaattcaattagtgctgtaattgtgagcctgaccctgaagacagatacaggcttagcttctgatccgcagaacagtaccagttcagtgaagccggctgctctcaaatcatggattccctttccttctctgtgtgctgagacagacacatcatctggttgtttaaaaagctttgcttgtttggaaaatgtagagtgtcttgctttagaatttcattggtttgtcctgcaccactagctggctgcaagacttcacatatgggtggaccctatggtcatgctatttacacttttccaataccctggtctcaatactgaaatgaaagcactccatgattaaacctggtggaaggctgggaacagatgtctgacctaaggagttactgaatcttgagcatatcggtgggacaagtggattaggaattctgcccatagagaataactgtgcaatgttttcttactgtgagctccatgtcctcttcctctttttcctttgtgggcttctctggttcttctgcctccttctcttggaggtggatttcctgggcctgagacatatagggcatgtcgtctttgttcttgaactccaagctgagaattgaaggaggaagtagaattcccagaattacctaaagtaataataatgataataataataatcacatttaaaggattaagattagggtggttgtttagaatcagagagcctgaggtatggggtataagagtgtatgcgtgtgtgtgtgtacacatgcacacacagttgttatatgctctgtgggggacctggacatctgagtaactaacatattaacatattaatactaagaggatcattttgtcccatctaggaaatattttgcacagctcagtctcatttttggaggaaaaaagcattttgcccaaatttgtcttacccaattaacacccactttgcatgtgggtaacagaggaaagagagactctatttaaggcaaaagtgggaaagaattcagatttacatttagccattagacagcgcttgattttgactgtgaaatcaattcatacatctgtccactggcattttttttttttttgctaatgtgtcaagtggagtggattatgtgttatctgattatctctgcaaaaaaaaaaaaaaatgctgtcctaagttgaccttgagagaatacatgtaggaaagcatttaattcattttagggcatcttcctggtatttgctacgagaacagcagaaacacaaacacacatacacacacacacaccccccagtgggctccgtatgtgctgagagagtccccttacacacaagccccaggagaagccagcgctgtatttctctcatgtataaacatcacgcataaatctatgcaaggacactaaatacggaagcctttcttctgagagggcggtctcattcttcagaatgaacaagtgtgtttctgcatgataatactgatgtctgactgtattccccaagtcctctctcacctcttctctcaatcctaaaacaattctggggcacaagacttctgaagatgaacctccttaaagaaactgctccaagatgaggggctaagactcctctgaagggtcaggaaaaatgatcctgaagtaatgaggcaggaacagtccttgcttgaatgcccacagggacgccaaagtagttcagggaaaatggctgtgaattcatgatgctgaattctgggtgcctggccggcctacgaaggctcaggtggcatgctggcatcttcaggggacatgacaccctgtcctcggagctgagagccagcatgactcccttcctaaggccgggcttggcggtcaccagcagtgtggctatggagtgcccatgacccacatcacagaacctttctgtgactctaggccaagagcccacaggaagagtggtatggagaaggggtattggtcccataaaatggtgggtgtcaggggcaggggtgaggttggggaggggaggaaatgggaaatggggccatataggtcaaagggaacaaagttgcagatatgtaggatgagtatgtaccatacagatgtaatgtacaatacgaggactctagctgaaatattgtactgtatactggaaatatgctaagagagtggattttaggtgctcttacacacacagggaagggtaatgaggcaagatgatggatatgttaatttgcttgactagagtgaccatttcactatgtatatcaaaacatcatgttgtggctgggtgccagtggttcatgcctgtaatcccagcactttgggaggccaaagcgggtggatcacttgaggtcaggagttcaagaccaggctgaccaacatgatgaaaccccgtctgtactagaaatacaaaaattagccaggcatggtggcttgtgcctataatcccagctactcgggaggctgaggtaggagaatcgcttgaacctgggaggtggacgttgcagtgagccaagatcacaccactgcactccagcctgggtgacagagcaagaccttgtctcaaaaacaaaacaaaacaaaacaaaaaccaaaaaactctcaaaaaacccatcttgttgtataccttaaattaaaacaaacaaaaaactccccatattctttcagtcttccatctcccatttttttctgtctttcttttcctttttcagtttcacattttccttgaaaaacactgaaaagaacataaaaaaagcaaacgctatacaccatcctatttcccttaaaaacagtaacatctctttcacagtccattcaacctcaaaggtaaccactgcggacaatttactatgtgtccttcctgatttttataggataatttatacagacataactatacatagacacattaaaaatggcctcagattatatacagtggtctgtgacttgtttttcttcatttaagaatagattaggattatctagcaatggctttccaagtagatctatctcagttttatcttagtttaaaaagacctctcaagcacatctggtaagagccaatgtctctatgacatgatgccaaggagggccaggggttcaggcaccctctgcagcgacaaggtggcctaggtggggactcctggtgcagctggctttgcttgtgcaaatggcagcccctgcagtacctgtgcgtggccatcccctttgactcctccgaaaaatattaatgtccaggcatcctccatagagatgctaatgcagcaggacccagggggaggccccagcctctatatggaataaacaaaaccaagcaacactctacaggattctgaggcacagtcaggatttagaacctccctcctgagataagaggatgcccaattccatggcagattttggctgggaaaactctaacccacccgccggtcctcatagccaggagggccttattgggcgccctgaccttgaggcctgagttcttgcgcatgcggagccggcccatccacatgtcggtgagcagcatctggctgcacgtgtgcgcgatgaagtcgcggtgtttggcagccacggcaagctgcaggcacgtggcgttgctccagttcttcagctcatacgtcagcagtttcatggccagctgttcgtcctgcttgtaggactggtccaggagctccacagccagctggccaaagtctctgaaagacagaatgggtggaagagtccttcaggtcagcttggagacttataaggtaaaagtggacctgctggccaaccagaaaatggggtcactggatgatgtaggtgtttcatatggggtctagtctgtttgtaaattcatccagccaacatccactaagcatctactatgtgccggataccatgtatagaactgggggtataagtcaaacaatacatgatctctgtactcaggccctcagattcagtcatatgagtgtaggaggtggagcaagcaatcaatagagtacagtatgtcatcgtcgtcttctttttttttttttttttttttttttgagacagggtctctctctgtttcccaggctgtagtgcagtggaatgatcatggctcactgcagccttgaccccctgggctcaagagatcctcccaccttagcttcctgagcagctaggactacaggcgtgcaccatcacacccagctaatttttaattttttttttggagatggggtcttgctatgttgcccaggctggtcttaaacttctgggctcaaacgatccacacacctcagcctcccaaagtgctgggattacaggcacgagtcactgcaccaggcagtatgtcctgttaaatgtgtcaaacttcagttcaaattccagccttgccaccacaaatgtgtgatcttggacaggttacttaaattctctgagccccatttttcctagctgaaagaagtgcataactacggggcctacctcatggggaagttgacaggatgaaatgttccatgtttctgtaggtaccaccatctgtggcactgtgcacaataaaggggaattgtttgtgtccatcctgtgtgtgcatcactggggtgatactgatttcccttaaagttctgagtagctcagactctccagcactgggagcccacctttcctcctctccccctgaccagcccattttgctgggcggacccacctggaattgtgattcagctcctgggaaatgtcgtcaaccatgtcgttctcagaggcctcatgagccatggctttgcagagcttgcaggccaccagggccttggccatggcctcctcaccgtgctgccagaagaacagggccatcttctgccgcttcatgagaacagcccacaccatgagctcatggaaagggaaggggaagtggttgatctcaggatcatccaagtcaatgtccacctcttcttcacgtttcttggttgtctttcttcctcgcctcaagggaatatcatcctgtaattacagggaaaccacacagactgagttagaaatgaattggttcatttcagcaagtagcagttgtatatcttctcccagctagctctgggatcaatactgaaatgaacgaggccagctcctgtcctaaaagaactcacaagctcatccatgcccaactttaaaacaagtgatgataaatgcataagcacagtgctgagggaacatgtcagtgttacactctgattaaaaaaattattttttaatgggccattttctttctttttacttctgtccatttatttcttcaaaaggtaatgtttgtacctaatgatggacagcactaccctttttgctgaaaggataaggacatcctagatttttatttgcatatatgacagtaaccacatgaacaaaagatggcaaatggataatttatctcaagtttctgaatacctattagatgcatttctgaagtagttctggcctttagacctgtcatcacttgtaaacactcatgaatagattttgattactagaatttatgtgcttccttggttttcaggttagtatttcaaataggatttttttttgtttgcattgcagatataacctcatggtggaattttcaaaggtgctgtgagcaacccttatgacacattatatatatatattattatatatatataatatatacatactatagtatgtagtatatatagtattacacattatatatactatatatttatagtatatatatattatatatagtatatatattatgtgtatatacactatatattattttatatatatactatatatgtagcatatatataatgggtaataaagagaataaatcattgacactaataatttggacaaacacttacctccattcccagcagtttcaaggctttgggctgttaaaaaaaacgttgtgaacaaagttagatcagttagatctttctttcataaaggtaagaagagtcctattatatattttttgttttgttttgttttgtttttattgagacaaggtctcactttgtcacctgagttggagtgtagaggcatgatcatggttcactgcagcctcaacctcccgggctcaagtgattctcctacttcagtgccccacgtagctgagagtacaggtgcatgttaccacgcttggctaagttttaaaaatgttttgtagagatggggtctcactatgttgccaggctggtctcaagctcttgggctcaagtggtcctcccacctcagcctcccaaagtactgggattataggcatgagccaccacacccagcctccaagagtcctattatattttaaacaggtaatagaagaacactattgtaccatatggcgtttattttattttgctaaataaaacaccacaagaagaactgatttatagaaattccaagagaattttggattcggtgattttaatgaatctacagaaaatgaggaaactagccaggcataatgagattgcctgagaatagagcctgcaggtttataatgtcttttgtgaaccaagatttctttcaccttccataaccatcttgtttgggtgacaccttcacaacatgtagtatttgaacaagtgctttggtctgaatgtttttgcctcccaaattcatatgttgatattctaattccaaaggtgatggtattaggggggacactttctgggaggtgattagatcaagagagaagaaacctcaggaatgggattagtacccttataaaagaggctcaatgcagctcattcacccttctactggatgaggacacagtgacaaggtgtcactatgaatgaggaagcaggctctcaccagacactaaatctgctcgtccctagatattggatttcctaccctccagaactgtgagaaatgaatttctgttgttataagacatcctgctgatggtattttgtcgtagcagcctgaatagacgaagacaaatgaacaaggaaaccttctatcaagcagaatgaatcatgtatttctcaaacctctgaagagcctctattatctggagacctggggtattattcagaaatatattaatatgtttagattctttatgctggccgtttccctgtgctgctgcacatcagggcaagggcgagtggggccagagggcctgtgctgatggtggcaaaggtgcttaatagcatggaaagtgtcagcacacaggaagcatcattggccatgctgggaatgtgcaaaacaggcacaggctgagtcggagagaaaaggcaactcagaagaacacagaccctgatctatatttaccaggaggtaatacaaaattacatctctggggccaggaataacaattttaagcttttaaatatttcagaatggttgggcaccatcttgaaagttatttgagtaaatggtaagtgtacagcacttacagttcctccaaattgtatttggctattcatgttagaacagctcaaaccgaatctctctctctctcatttttctctctctctttcagcttctaaaatgactactaggctaatatctatttcatttttttcttatttatagttactggtatttttttaaaaattctgttatatatattttttcattttcaaacaaatccctgttgttaaattttaggtattttcaaagttctttactagttccacaaaatgctttcagaatcagaaaaaaactttgttaaatataaaaatcatggctccacacagtggctcacacctgtaatcccagcagtttgggaggccaaggtggcaggtggatcacctgaggtcaagagtttaagaccagcctggccaacatggcgaaaccccttctctactaaaaaatacaaaaaatagctgagtgtagtcgcacatgcctgtaatgccggctactcgggaggctgaggtaggagaattgcttgaacctgggaggtggaggttgtagtgagctgagaccacaccactgcactccagtctgggcaacagggtgagactgcgtctcaaaaaaaaaaaaaaaaaaatcatgcccactaccagctagagcagcagttctcagaatgtgacccatgggtcatgagggtccctgaaacattttgagagggtgtgtaaagtcaaagctattttcataatagtactaagatgtaattgggtttggcaccatcttgacatttgtactaatggtgcaaaagcagtggtgagtaaagctgctgggtgccttggcaagaacaaaggcagtggtacccacctttacccgatgtcattagactccagtgttatgcatttgcagaaagcaaatgcaaccgttttacttaagaatggccttgttgaggtctaaaaaatgattaactttattaaatccttaaccttggttaaccgtctttttactgttctgtgggatgaaatgggaagtatgcccctaaaatagttctgctgtatactgaactattatgggttgtcctgaggaaatgcacttatgcgattgtttggattgtattatagccacttttttttttcatggaatataatttttacttgaaggactgattggcagatggactaaggttatgtagacttggacctttggcagatgtttttggaatgaccaaagtgaggctgttatttcaaggaaaacaactgatcgtatttgctgccaatgacaaaattcaaacttttaagaaaaaaattgggattctggaaaacttgtatgtactccccccacctccaccatgactttgacagcttttcagtactgaaagacatttcccatgagatagaggtgatactaatgaaattgtataataaaatgtgtcaatatttggaagagctgcataccttaacaaactaattttccatgaccaatctatgatgttacaagatccatcaaagtacaagatagaccgttggattttactttgttattattttattgtattgttttagagtcagagtctcactatgttgttcaggttgcagggcaggggctactcacaggcactataatagtataatacagcctcgaactcctgggctcaagcgagtctcctgcctcagcccccttagtagctgggaccatggctggctagactagtgaatttcagtgtaacagaatttgaaaagttcacttacatggttttagatttcaccttgcaactcatttttaagaaacgttacttattaaattttggtgtagtatcaaaaaaatgatatttacaattatatgtaaagagggttaaaatactccttcctttgatatatttgctgtgtttgtcatatatttttgtggggtcagattttctttatatactttaaccagaatatcctacaacagactgaatccacaagtagatatctagccctcttctattaagctggacattacagaaatttgcaaaaggtaaaaaatgctcctattatgaacttattctttgtttttgaaaatatgtttttgtttgtaaacatgttctttatgttaacatataatgggattcctatgtttaacttaaaatggattaaatatttttagagtctccatttaaatttctaacatggtaaataaacaccaataggtagaattcccatagataaaagctccttgaggttctcaacaatttttaaaggtataaagacccaaaacctggaaaactgctgagtttaataatctcaatgataagattaatttgaatttcattacttttctttgattgtttaggttcactctcagcgcaattttctgattttaattccccttggagacaaagaagccacaacccaaatcccatacaccctagtcctcccaggaagggccccgaatttgcagccagcctcaccctcttggggccgaagaggttgtggtagagggtccggaagcgcttgcgcgtgtagttgcagcgataagccccgcccatcaggtactcgatcaccaggccgatgtcaatcaggctgattctgtagtctgggggcaggttcccctatcagggtagaatgaaacaaacagacaaatccaaaagacaacgtggtttactagggattctacttcacgtattctgtaactagagtaaaaaaaaaataatgaaaaaagaaacatatgaatgtattattatgctggttaattaattcaccttaaaatagatccaaccgaaacctggatactctcgcttggaaagaagacataagttaaataagaagatgcagtaatcgtcggcaataatagaaaatcaaaatatttattcaagtcttcagctggggagaaaaaaacaccagtgtagaagaaagaaacacaaggctagacagggcaaatgctatcactcccaggcactaggaactaggtttccccagatgctccccaagcccgcatttctgcctctgacccaggcctgttaccactctcttgatatcatttggtttctaccaccctttaaaggaagactcctttcagaagatgagtgtcattaccagagcctccatcagctgggattttaggactcgggtctcctttaatacaaaacctctatccataattttaaaaaattgacacttttttcataaaagaagagcaatatttagggaggggattttgggtgtcagaatgaggttgtatatgaacatcccttgcatttaaagagaagggggagagaaattggaggagacatttttatcaatggagtatttatttttctagaattaaggagattttcattttttcttttaaagagagtaacatttcttaaagatctagagttatggtgtcttttttagctgtttgccatctatacatgcaaaaatagtaaagattttcttattatttactcactactgctttctacttctaaagtttaggttcttaagaaaatttttgctgttaggtcaagggagagttagttccatttgtgagaaagtctgagtgcatagtgaattccaaaggtcatgattaatccactctcactgcctggtgtagctccttcttgcgggagagcgctctataccatgaatggctgggtgtcacactgcttaggaagcctcatgcccttagatctatttgggacagacacaaggggctccatccacttttgtccttaatgaaggacccacccaggatgctgtgtgagatttctgccacttcacagaagacgtgcattatgtatagtggtggttttccaactttggtggcatcagaataccctggggaacttggtgacattacaaacggctggactttgtctcacctacttcaatgtatcggggcctctgtggcctttcctagctcctcaggtgattctgatgcacactcaagtttgtcaaactgcttgtctactcagtaagtttctggtggtagtggtagattaggcagcagaactgggaaattcatagtgtcaaaagttaattgctttcagtcagaaattaattaaaatttttttgctaacctgagggtaggttttcagttgtccttactcagcttttctatgggcaactgtatccatttgaaggttttgggattcaggattagaggtatcccgctgcatcctatcattaaacctatagctttacatgtttcttgtttgatttatctttatatcctgagagcctcttataatatgcctggcatatggtgggcactcagagtgtttttgttgaaaatgtaaaccagtaaaacagtgaaattaattgatgttgttgggatcaagtctgggtttgggtttttgagtattatgttctcagtaacaaaaccaagtagccacaatcttgttagtcatccctggttggaatagccctagttcactatggaaatttgctctgaaatacaggtaatgctgtatctggaattcagtggctatcctcaatggagtgagaacaaatagatagtaattgaagcaccagcctcaggcatataagactccattgctgcttttttttttttttttttttttttgagacagagtttcactcttgttgcccaggctggagtgcaatggcgtgatttgggctcactgcaacctctgcctcctgggttcaagtgattctcctgcctcagcctcccgagtagcttggactacaggtgtatgccaccatgcccagctaatttgtgtatttttagtagagacagggttttgccatgttggccaggctagtctcgaactcctgacctcaggtgatcctcccgcctcggcctcccaaagtgctgggattacaggtgtgagccaccatgcccagcccattgctgctttttagacttcttgctgtccccagaattagctcccaccccatcccactgtgttctacctctcccttggcttggggtacatggtaggcttgggcatctaactggagccagccaggcaaaatggggctgtgtgaagggcatcatatatgaggtggaacattttgagacacagaccccttccgtccttgaccttggccctccacagcctaatctggcatccatttgatgagctgaatagtcccctcacaaaaatgacctctaccctcctcagaatttcaaaatctcctttgtttgaagattatctttatccatctaactgaatcagcaagctaagctatcctcaggctaaaaaagaccaattgtctgacttctttatgcaaagcatggcaaaaaatattaaaaagggagctcagagaaagttttaagatagtaacttttcatgtattagccttcccataaaactaaactgagtttaaaaatagtactaatgcaaccacttttctccattattttggggcaggctaacaaggccacagtttctgtatcctttggctttcctggactgttaggcgaggctgttatttaaagagtagaagagtctcagagactggactggcctgggtaagcctcattcatagccacagggctcctatggggatgaccgcccgaggatgcccacccatcgtgtcattttccctggcagggtgaggaggaagcacaccagtttccagtcagctgccccgggcttctatctgtcctttggccagcagacactttcccttaagctctcagatttctttccagtgaaaggggtttgcactccatggcctttatggtctgcagtgttcaaaggccaggtttcaggaaaatcctcaaaggactttttgtgatgctataaaaaggcaatcagagcagatctataaatttgtgcctagttttaatcttgtaggaattcaaaaaattttaagtgtgggctcacacctgtaatcctagcactttgggaggccaaggtgggtggattgcctgagctcaggagtttgagaccagcctgggcaacatggtgaaaccccgtctgtactaaaatacaaaaaattagtggggcatggtggcatgcacctgtagtctcagctactcaggaggctgaggcagaatcgcttgaacccgggaggcagatgttgaagtgagccgagattgcaccactgcattaccatctgggcgacagagcaagactctgtcttaaaaaaaaaaaaaaaaaaaaaaaattaaaatgtgggtaataccaagcctaacacctatgtattttgctttgagaaacttaggtgtaagcatcagttagaattctaaaaataagacaccaatattgcttgaagaccaatactgaaagggaatatttatgctttcaaggtgtctttgggagttgtcaggaaagtgattatagtaaaattcaaaatcaataaacatttaaggggcaaatagaacatttttagaaaatggctatatccataaaggacttttagcggtatatattggcaagcaagcaggtgctgggatcgtctcatataaagcttgattctttcagaatgatttatgtttggtcagccctgaaggaggataaatgattctgtgaccagtgccggggggggggggggcctgcgttctgtttgaccacaagggggcgatattcacctaaccgaagccaatgagaattcctcccttcccagcagcattttcctgcctcttccgttttttgttttgttttgtttttttcttttgagacggagtttcactcttgtcgcccaggctggagtgcaatggtgtgatctcgactcactgcaacctccgcctcccgggttcaagtgattctcctgcctcagcctccagtgtagttgggattacaggcatgtgccatcatgccagctaatttttttgtatttttaggagagatggggtttcaccatgttggtcaggctggtctcgaactcctgacctcaggtgatccactcatctcggcctcccaaagtgttgggattacaggcatgagccaccgctataaaacatgtatggtatatatatgttttatatgtactataaggccatataaacaaacccagagtggatgaaggattaggcgctaaggaatgagtcagatgctctcctgtaagtgatatttggaggagtgaaaatttaacaagtaatgtgtttgcattcagcctgcaaggctggatctcatctgtttcttcacagagattttagggagcaaagaagttagggaattacttttacctttcttactaggaagagtggaaaccttcttcgggaggaagaaatcggttttataacatgaataaaattgagtacaatttaggccccttgggataggtgtcctgcgtggactctgagggggatggcagcctcagtgcatgatactaagctgggccaatggccttgaccactgggacctgtggatgtcacagatgatgcatttgcattgcttctcctaggatgggtattgccaggtagaggggaacttatggatactcattcaggagcagccagcaacatgaccccatagaggaaacagctctgggttgggccatggtcctgaccccaagtgaccctggccagatcacttcctgtctctgtacctcggtttatgctgtgaaaataggtggcttggacacaataacttctaagattctgtctatttctaaaaatccaactgtatgaccactacttggcaggctgttcttactcctttcggcccactggccaaagaccctgttcagagcttccaaggttgatgtagcttccagtgatcccctggagtttggttagtggaaccagaggcttgtagacaagggatggtaaaaggatagatggggatggggtggtgctcagtgcatccagctcctctggaaaaagcagagaaggtgagcagtacctcacatgccaacaggtaaagtccaaacaccttctggaggagacttcctttgcttgggtccttttcaaattagaagtcaaaaaggatactggaggaacagtcattctgcctgctgtttctgttctagcacttccccctcccccttcggtaatgactttggtaattggtaaagcctgaactattatttcccatttcatgccttaacagtgggaggtcatgtgattcaagtaatttgctagacaggcttgggttctatgagtaggtacgatttgacaacttgaaaatgttgtcttcttttttcatgctatgaactgctaacctgaagctaaggtttacttcgtgccatgcataaggaaaccttttaattaaaagcatagtttaaattcacttattagatctgctcttcaaaatggttggggtttttcagatgtcagctcaccatatcactatcagatctcaactgtttaggaaaactgtcttcctttgaaactcataacaagccttcaaaacaagattggttccttctgagatacataagatataaaatgattgcggttgtcaggtttaccaaggaagtgtgaagaaaagactcccctgggacagcttgtataataaagaaaagtggactgcagttggtgtgagtaatcacccggtaggggcttcatctggtgagagctcaggggaaaagaggacatcaccccaatgtacagccccttaacatggcaatatatcgggcaaccaatcctctgaaatataataatgcttttgcaaatttccatgcatttagcagatgggattatgcaaatgtcctttccttacccaaagtgtgtctgaaatgcctttttttttttttttttttattctgaaaagctctgggtcttaattcccatgtaaatgaactttaaattatcataatttcaccactacttccacataacactcaaatagcatcctcttttggtggggaaggatagtataggtaatttgaagtattagcacatttaagaaaggaaaaaactactttaaaacgtacagaggcacaaagtgagcagacagctactaaaatggcaggttatattccacagaaaagcagacagacttgggccactctggtttaatatgagagcattggtacattcaatggatttatgcatgaaaatagttcagggaactgggttggtttaaaacaatttaaatttctgattaatgctgaagtgccactctttttacctcattgctcctagattgttcccttgatataaataatttgagatttcaaaacaagcttgggagcaattccccacattcagttctgttggtctcaaagaagaggtaaactggagatgtcatgctgattgacttatgatggtctgataattcctcaatgcattcctttggttcttaagagttatttacatatagttttacagatgtattatcaaacactatgcttaaggtctaggactgtgttcctaactcatgaatagcgttttgtaccagagttaataacttattcattaattttgtccaggttaaatatatatgcacacatatatttccccccataattgtaaagaagaaagcacacattaattattattattttctttaattttgaaaattgctttaagttcccaagattttcttagcattttaactctagttttgtagcctttgattatcctattggcctaaattgctagaagtcacttgaaaccacctgaaagtcacctgaaaccacctgaaaattgctgaaagtcacctgagaaagttgtgcaccaatgttaacttctcccttattcacttcttccccaaacacaaaacaaacaaaagtcttcattttcagctcccttaatccatataacataaaatgtaggccttgtgactcctgtgactaccattgttcatctttcttgctctcccatcatcagatacttaccttagtcctggaaataatgcattctgcatttcctgcttctactttttcccaagggaagaaattaaacattggctttctgtgtctccctgtcttattggcagtctctttttccaggtaaaaggataaattatttctagaccagttcagtactattcttggtcatttgttatcattttttccagttactaaatttgcaagtaaatggtaactgcatgcttatataatgattttcttgctctaatatttggatcatacttaaaaggaaaaaaaaaagctgcttttattccttcttcctcccaaattcttaccatcctgttctttcttgttagtctatattatttttcaggtacatctttagctgagaagctacaaaaaaccctaccttagagatactttacatgccttctaatcatacaagtgacgtgagcaaatgcaaaaggcagctcaagggatttcagaaaagagaaaacaatattgcaaagcagagtcctatggggaaaagaaagtaatgagagggattttaataatttatactcagtgaaatctaactgcaaaaatccctttgaaaattagacaagaccttattgctgggaggctgggtcattgaattggatgagcgactctttttaaaggtttgggttggtgatgactgggattgagggacaaaggcatagctgtctctttagaaaacctcacaattccttcagggacagagattaacttaaggtgaaggagagaatactccaagtcattactttagaaaaactcaaaacatttggttgaacatgagcaacaactatctctctgaagaagacacatcgaatgtgtctacttctactcttctgagtttagttttcaggcaattttaagccaggatgaattagacaaaaccggaaggttcaaaggaaagagaaatgggtttgttgagggtagatctactacgatggcatggaatgggtagaccagtgaaagacacaatctcaggaaagtggttgttgagttgggagtacagattgcatagtgttttcccctcttgttttgaaaaaactacaggcttcacccactcaagtagatgaaaaatccttcattaaggtggtatagagatgggaggaaagtttgcaagggccaaaggatggagattttgattttctgtgtgttatttttatatcctttactcattcttagcaaagatccagcaggtgaataggtacattataagtagccccaaggcctttgcttggcctttcaaaggaaaaataaaaaagtagttacaggatgcctaagggcaattctagccaatcacttcctgtgagatgaagaaatcatactgtatttttgacttcactttgtaggtttctctgaatatgtcctgtggactttggtgaagaattgttaccaagtggcgatagtgggcaaatgtgtgcatacatgtatgggcacataggtaaggggcgggggcagtgccatcttctgttttattttttggaattaaaacatcactttctgggatggatttaagggttcagaactcaagctacctctgaaggagataatatggggcaaaagaacaaccacttggctaagattaaacagaatctccctatacttcattcttcttgtctttaagtgggaataaaactgtattataataataaaataataattttttgatggaatctcactctgttgttcaggctggagtgcagtggcacgatcttggctcactgcagcctccacctcccgggttcaagtgattctcctgcctcagcctcccaagtagctgagcttacaggcacacaccaccatgccaagctaatttttgtatttttagtagagacagggtttcaccatgttaaccagaccaggctggccttgaactcgaccttaggtgatccacccaccttgggcctccaaagtgctgggattacaggcatgagtctctgtgcctagcctataataataaaataataattctatttcatagaattgttgtgaagattaaatgaattaagatgcactgaaagtatgcagcaatgctgtgcacctagtcatcactagctcatgactattattattttatcattattaataaaatgaactgaactttaaacctagctcttcactaaatgccaatatagctctcatctccttgtagttcggcttcctcatctgtaaaatgaaaataattctacccgatccatacctaccaacatttttttcccatctaatgagatgaaaagtgtgaaaaaatattctggaaaaaatagaatgttagaagaatggaatgcatatttatgttttagtccctgtttttagaaaatttggagctatgcttactacactctatgtaatgctagatgtgacattgtatcaggagctggtgaatgaagatttactcttgtggtcagtcaggcagctccccaaacagtgaggggcatatggaaaaatacaggtatggcataaatccacttggcacggggaaagccaagagttccgctacccaaaagcattatgtccaccaaaagcatctaaaagcacggcgattggagataacaccacagctgcatcatgaacagaagcatcagagttaaaagacacatacacacacacacacacacacactgttctgaaatgagtggcgcctgatagggacaggaatactctggcagctcatgcaaaacagaggcactctctaatcacaggaagcagtcaagacagggcctccgacctgcagtcgagagggttcttacctttttgacatccctgaccaagtggtacaatgtatttgagggcccatgtctctgaaaacaataaagaagaatcaaacagttttgctagtcaggggctctggttggcaagacaagaaggatctagaaggaagggtgctggctggtggagggcagttcattaagatggaccttgttctagttgctcagtgtatctgccttttctttctttcttttaaattgtccccatttgcagatgaaaagctttgtcagtgatttttttttttttttttttttgatacagggtcttctgttacccaggctggagtgcaacggcataatcacagctcactgcagcctcgaactcttgggctcaccttagcctcctgagtagctgggactacaggtacacaacaccatgcctggctaatgcttttgataaaatttttttttttttaaagatgggggtctcactatgttgcccaggctggtcttgaattcctggcctcaagcaatcctcccacctcagcctcccaaagtgctgggattataggcataagctaccatactggccatacctgtttcttctaaacaaacacgttggcagatttttgaattgtatttcctcaagcaaatgtatttgagattctaggttcaaactttgtaagggaggttgtcaactctgttgacagctaggccaaaatatgatggaagaagccagttttgcagccgggggctgggatgagggtgggagaacaaaaggacccattgaccgcactggaaatacacttgggcattctgccatcacaacttgtttattacccatcatgaatgagaaattgtccaagaaaagggttggccaactttttctgtaaaaggcctgagagtaaattagactttgtgggtcacacggtctttactgaaactgttcaactctgctgttgtaatgtgcaagtagccatagatcatatgtaacaaatgagcttggttatgattcaatgaaattttaattatgggcacagaaagtcaaatttcatattattttaatgtgtcatagaatatagcatttttcttttgattgtttcaaccattaaaaatgtaaaaaaaaaaaaaaaatcttagcttgcagcccatacagaaacaggcagcaggctggatttcgatgacagtttgctgtaacttgatttaaagaaaaagccacagactgtttgggaaaaagagagttttgtaaaaaagacggatgtttgtttgaggtaaatataaagtgaaataagttgccattctattgtctttcaggaataggaatgtcagataaaatccaagatgcctaattaaatttgaatttcagataaacaatgtacaattttaatctaagtatgtcccatgcaatctttgggatataacaaaattgtctgttgttaatctgaaattcacatttaactgggcatcctgtattttatttgctaaatctggtgagatgattagataatctaaaatagtgatggcttttttttttttttttagttagtctcgctctgtcacctgggctggagtgcggtggtgtgatctcagctcactgcaacctccacctccagggttcaagatattctcctgtctcagcctctggagtagctgggattacagatgtgcaccaccatgcccagctaaattttgtatttttagtagagacggagtttcatcatgttggccaggctggtctcaaactcctgacctcaagtgatccatccgccttggcctcccaaagtgctgggaggccactgcgcccaaccaatggcaaattcttaagcactgttgcaaccattcaagtattgagacaggtctatgaaatgcggcaacgacctgcccattcatgtggacgtgcccatcagagctctttttccactgaggggatgctggattgtgcagtgatttagcctacagactctggagtcagagtgcctggctctacacctctgctgcttactggctctgaacgtgggcaagcaacttaactgtgactcagttttatcatctttaaaatgggaatgacagtatcactttatctgatggggttgttgtgaggattaaatgatataatgtttataaagctattaaaaatggtgcttaatgccaattagtgttagctattattattactgaggctatttactgttccataatcctcaacaaagtattccgggaagccaccaccagcagactgaagtgatcaaacttactggccttcctcagtctagaattttcctacccacccccactccccagtctttggaataaattactcccttgattctctaattgatagaccattcaatgcttgtctttatttatttattttttttaattgaaaacccattattcttcctgaaagtctcagtatgctgaaccaagaaaagtctctggagaaaacagagactaggagacattctgctaacccgtttctattttttgcagatggtgccagcgtggcaccatctaacaactactactggctggggacaggaaataagctccatcctgcttgccctctgcgtgatgggacagaggcattgtgaaaaatgaggggtagaataatcttagagacagaagcttgggttcggtacttactggctttcttaggagttttgtgaccttgaattcaccttggcctctgctatggtttgaatgtttgtgtcctctccagaattcatgttgaaagttaatttccaatgtactagtattaagaagtggggcctttaacgtgtatacctgtgtaatgaacctgcacgttctgcaaatgtatcccagaacttaaagtataataataatcacaataataataatagaaaagaagtgggacctttgggaggtgattaggtcctgagggttcctcctttgtgagggggattaaggccattataagagaagcttcacacaacattcaggccttttgccctctgtctcttctgccttgtgaggacacagcatttgtcccttctggagaatggcaaaacaaggtgccattttggaagcaaaaagcaaccttcgccagacactgaacttgccagagccttgattttagactctccagcctccagaacccagagaaataaatttctgttgtttataaattactgagtctaaggcatcttattatcatagtacaaatggactaagacagcctcagtttcctcatttggtaaatggggaaaaatttctgctctttaaacttcactggattttagtatgagctcagagccaatgcacttaactcatgtgaatgctctcaataacttcataaacagtagttttacctatgattactccttggtatccctagtgagtaaattaacaaatcattactaagctaaaaaacaaaacaaaacaaaaccaaaatttttgagtgactcaaaaaagagatattttaccttttcttccactttatagctgaactatgaagaatgaacttcatagctctgaggataaaaaatggcgcaggttacttaatcagccttttgtgatgcttagagttaaaccaaccctcctttgctaattgcctctaacaccctctgggcttacagaacaaactgtgttctcatttccagagccttgtggctttgtataagaatatgagaatgatacacttaggttattacataactttttgccttacatgctgacaactgagcaattaaaacaagcggaatcttggtgacttggtgtttgtcatctatgtaggtctaagggagtatttgtgatgaatgaaccatgcatttggacgggagaagggaagagaatcacaggcatatggggggcaggagaaggtaaaacaaacagaaaaaaaagaaaataaaaagtgccttagtttggccctaccgtattgtacaattcctctagtctggagatggtgagaaaacggtgcatgcttactccattctctatgagtaatttcacaaaatccactctgtccagaactaaggcatccaacatggcttgctccagagatcccacctgcaaaccaagtcactgagttagtctgccccagggtctatctatggatgcagttctttagtgttcacttgaacagcttagaaatggatgcctttgacatctggtaaaccttcagcacatctaagaacatgctagcaagactgttcacagattcacttttgggacagccacacctctcccatgtttgggtgcctgtctttgcaaatagaagtcaagcatttctagttccaaaaactatttcttccctgaatctcttgttctggatcccaagaaggtgcaagggttcacaaggtttttccccttgcaattatctgattaaatttctcaacaccagcgaagtgtcaaagggggcacttttgctgtcttcatttttgttatccttaggctctgagggagaccccaggccaacttgagaagagggacccaagtcaacagaccaaaggccctaaatcaatgctgggtctctgtagaagcaagaccacaaagatgtcacttaactgaaaacaaaacaaaaacataacaaaacagaacaaccagcctactttctggatttgccaatagcttagatttttatttaatccatttcacaaaaatgttgcagggtctagactctgacaaatctttccatgttagcaatccaccagcactgaatgaagacaggggctccatcccaggcagaaactctctaggggaaaggaaggagtaagataaggcttgccggtgagtgctgtgattccaggcacagaaaccgagtttcaggctgctgggctgcctcctgtggatgcatacatatcccacctgatggccaatctctcaaatttttatttttggtagagtcaattgagggaagcaaaccaagaacagttatataaagcattggtttcctcatgttgttctttgcaaatagggaggacctgtgctcagtcaccaggaccagatggcgcctgcagagggaagcctgctaattctgcatcctgaggtgtgacccttccctttgccccatcaaagacaatcagaagcaaattaataattctaccccttccttaattttagttaatacagatttgtcttatattttttcagatgtattcaaataaatggcatcatttgcagctgaaaattgctattaaagacaactcatagagatggaaatatttggagttgtgttcagttgaaatttccactagatggcggtgctttcctaaatatgagaaagggagctcaggatacagactttgctaccaaggaacacattccatcttaaagaaaaagcaatcgttttctgagctgacctcagaggctccttaaacaaatacccttggccaaccaaagtgggcttttcatgggagacgatatatactctaccggccactgttgcccgtaaataaagatctggctgcgagcgatgtcgactctgttccaggctaaagctaagctcagttggtctggggccgaggcattggctcctgtgtgaggacaagtgggagaaaagagtggaagagagaaaacgacgatcagttattacaccaagagcgcctgctccatccctctgccattaatgcccctattcccaaagagcctgcttggctatacagcaggtttctcaaacttggtattattaacattttgggtaactctttgtcacagggctctcctgtatattgtagattattattattattacatttttaaaaactttttaaaaagaaggtctttgaaactccatgcttttttgatatataataattgtacatgtttatggtatgcatgtgatattttgatgcatgcatacaagttcattgtagattattaatagcacgccttgactgaacccagtagatgtcaatagcattttcccacccccatccttccagacatgatgctcaaaaatgtctccagacattgccaaatgcccccatgtgtgaagggaggcaaaactggcctggtgagcagcattgctctaccgtctggctaggcaaagtgtggttcacagagcagctgcagcagtgccaccctggtgcttctttgaaatgcaagtctcagaccctgtccccgacccactaaaccagaatccgtattttcacaagatcccagatgacttgtgcacacactcaagtttgagaaactctgctctaccacacattttgcttctgctggccaatcactggtttcaaggcatcacttgaatagtattttgcatggggagggtgctctcatcaactagcgtaccaacttgccacttttctgaaaaagagttaggaaggtcttttaacagagaggcaaaccagcggcttaggtttactttgatttgtgggtagaaaccattggaactatttcccaggttcttatttttctccagattctgtctctagagctgtgcggttcacaggtggctaagtttaaattaatcaaaattaaataaaattaaagttataattcctcagtcaggctagccacattttaagaacttaatagttccatgtggctagtgactactgaactggaaagcacagatacagaacatttctatcatcacagtaagtgctattggcccagagctcatctaggtgaatgcatcctgtccatagaggcagcctgccaagcagctggaggggaagctggaaatggaggcagtgcagtaacgaaagcaacattaggctccaggcagggggcccaagtgagagtccctgtggctcctctcagccactgttgattatttgtgaaatggaggcaataaatatccagtttacatggctggggtgtgagactgaaatgagattgtataagtgatttctgtttaaacaggtttttcacagttcaccaacacccttagtgcactgaggaagagacacccctaaataattgccaagcttcatgctgctggatatctcacgatcggggaggaggataaagagacaaccttcctcagctcagagtttttaaacatcaaacatgtgctgggcaaagtattaggcacttccatatgtcatatgtaacatcccagttaatctggggactgggtcttattgtctcctgtctcattgaaacatatgagactactgagatccagggaggtggaacagccaaagataaaacagctactaacagggtaaatggaagaagtattcagcaaactagaggtgagagtcagatccagagaattcctcttcatcattgctgcttctgatgtttaggaaagaaatatagcaaatgtgtatgctgttcattcctctgggttcgccagcagtcaaggccagaaacaatgaggaggtggggcagggttcctggtcgttaacttacatcagtgattccaaaactttgctgcacattagaatcacctggggagcttcgctcagggtgcatcccataccaattaaatcatgttgcttgggatgggatccaggcgcggatatttttaaagctctccatgtgcttccaatgtgcagccaatgtccagaggctgggaattactgcgctgtgtgcctcctttcctgcttaccctcgcctcttccctctgggctctgagatactgacgttataaattaggcaaaaaatgtttgctaagtgaacacttctcaaattttagcatgcataagtacaattcggagaactttttaagacacaggttcttgggtcccagctgcagaccttgtgattcagtagctcttgggtggagcctaaggttctgtgtttctaaccagctcccaggtgaggccgctgctgctgatctggggccatgatttgagtaacaaggccctcaagagctgtggtgctctgttcccttcgtaggttgaagagcatttctgattctggtgtccacacattgatgggcttattatcgaccacatacttggagtaaatttattagtgtttacaatgatgaatatcatttcagctctcacgtggaattttccattaaaaattatctcctcaggtaacaacagggactgcacactcataccagggtaactggcatacacaagtgataagtagaaatgtgtcaaaatgttctgtcatcaatttggagaggaaaagaagtgaaggctcattgcgattgcatttggaaaggtagcactttacatgtttctttgcttctttagctggtctactggttggtgctgacttgctggaatagtttaatcattccctttgccatttgtatgttgcaaattagtatgtcacccaagtcaataatagcagcacgagcctgaacaggaacacatagcaggaagcagttattgaggtcaaggtgagctacaggcctgaatgtaattaggcaagtgtcaaatgaaagcatgaaaccaatgagtcttgactttcaaaaattgaaaatacatcactcaagaatggccgtgggtgacagtttggatcagtggttctcggctaaggtgaccagccatccaggcttgcccagtgtagtcacagtgttagcatttaaattcctgcactctgggagatgtgtcaatcctgaataaacctagtggctggtcaccctattctcgactatggctgtgcacttggaattgcctaaagagctttaaaatatactcatgcctggggcacagccccacagattctagtttaattggtcctgggcattgcggtttttaaaagttccccaatgattctaatgtgaggataaaattaagaacttctagtgtagatagcatatgttcattcattcactcattcatctgttcatttacttatgcgttcaaagatactgatttcatgcctccttatatgggaggcagtatgccagcatgaggaccgagacatataaagcagaatactttgtcttgagagcttacagtctagaggagaagagaagtctgtaattaaatacattatttcatgcagtaattcatttatctcatcaacagatatttattgaatactctctctgctgggaactgatttgtcattgaacgtccaatgacaaacaaggtagctaaggtcaacctcttcacagagcttacatcctactggtggtggggaagtactcggaagtaagcaaataaactcatgaacagcatactttcagattgtagaagtgctgtgaaggagcagtgccactcctagggtatgtgggacctatgcttatacaaacacatcaatgtagcagaaccattctggctacccgaccttgcatgtccccacaatagaagtattttgctaattggctggagcaatctgctggcccggctgccctcctgaaatgagggctgaatatggagtcattggacaaccaacgacaaaaaccacatgattatctcaatagatgcagaaaaggccttcaataaaattcaacaccccttcatgctaaaaactctcaataaactaggtattgatggaatgtatctcaaaataataaaaaccatttatgacaaacccacagccaatatcatactgaatgggcaaaagctggaagtattccctttgaaaactggcacaagacaagtatgccctctctcaccactcctattcaacatagtactggaagttctggccagggaaatcaggcaagagaaagaaataaggggtattcaaacaggaagagaggaagtcaaattgtttctgtttgcagatgacatgattttatattcagaaagccccattgtttcagcctcaaatctcctttagctgataagaaactttggcaaagtctcaggatacaaaatcaatgtgcaaaaaccacaagtatttctatacctcaataatagacaaacagaaagccaaatcatgagtgaactcccattcacaattgctacaaagagaataaaatacttaggaatacaacttacaagggatgtgaaggacctgttcaaggagaactataaaccactgctcaaggaaataagagaggacacagacaaatggaaaaacattccttgctcctggataggaagaatcaatattgtgaaaatggccatactgcccaaagtaatttacagattcaatgctattaccatcaagctaccattgactttcttcacagaattagaaaaaactatcttaagtttcttatggaaccaaaaaagagcctgcataaccaagacaatcctaagcaaaaataacaaacctggaggcatcacacttcccatcttcaagctatactacaaggctacagtaaccaaaacagcatggcactggtaccaaaacagatatatatatcaatggaacagagcagaggcctcagaaatagtgccacacatctacaaccatctgatctttgacaaacctgacaaaaacaagcaatggggaaaggattccctatttaataaatggtgttggaaaaactggctagccatatgcagaaaactgaaactggacccctttgttacaccttatacaaaaattaactcaaggtggattaaagacttaaacatataacctaaaaccataaaaaccctagaagaaaacctaggcaataccatccaggacacaggcatgggcaaagacttcctgactaaaacaccaaaagcaatggcaacaaaagccaaaattgataaatgggatgtaattaaactaaagagcttcttcacagcaaaaaaaaaaaataaaaaaaataaataaaactatcatcagagtgatcaggcaacctacagaatgggagaaaatttttgcaatctgtgcatctgacaaagggctaatatccagaatctataaggaacttaaacaaatttacaagaaaaaaacaacctgatcaaaaagtgggcaaaggatatgaagagacacttctcagaagaagacatttatgcagccaacaaacatatgaaaaaagttgatcatcactggtcattagagaaaggcaaatcaaaaccacaatgagataacaactcacgccagttagaatggcaatcattaaaaagtcaggaaacaacagatgctggaaaggatgtggagaaataggaacgctttttcactgttgggagtgtaaattagttcaaccattgtggaagacagtgtggcgattcctcaaggatctagaaccagaaataccatttgacccagcaatcccattactgggtatgtacccaaaggattataaatcattctatgaagacacatgcacacatgtttattgaagcactattcacaatagcaaagacttggaaccaaccccagtgcccatcaatgatagactggataaagaaaatgtggcacatatacactatggaatactatgcaaccatagaaaaggatgagttcatgacctttgcagggacatggatgaatctggaaaccatcattctcagcaaactaacacaggagcagaaaaccaaacactgaatgttctcactcatagtgggagttgaacaatgagaacacatgggcacagggaggaaaacatcacacgccagggcctgttagggggtgaggggctaggggagggatagcattaggagaaatatctaatgtagactatgggttgataggtgcagcaaaccagcatggcacatgtatccctatgtaacaaacctgcatgttctgcacatgtatcccagaacttaaagtataataataaaaaaaaagcagtggaactaagagttggttttttgaaaaaatacataagattgatagaccactagctagactaataaagaaaaaagagagaagatccaaataaacacaatcagaaatgacaaagatgacattaccactgaccccatggaagtacaaaaaaaaaaaaaaaaccctcagagtctattagggacacctctatgcacaagaactagaaacctagaagaaattgataaattccttgtaacatacaacctcccaagattgaaccaggaagaaactgaatacctgaacagagcaatagcaagttctgaaattgaattagtaacaaaaaatctaccaacaagaaaatgccctggaccagcgagattcacagccaaattttattagacatataaataagaggtggtaccaatcctactgaaaatattccaaaaattgaagaggaatgatgcttccttaactcattttatgaggtcagcatcattcataaccaaacctggcagagacacaatgaaaaaaaagaaaacttcaggccaatatccctaatgaacacagaagcaaaaattcttaacaaaatactagcaagctgaatccagcagcacatcaaaaaacttatccatcatgatcaagtaggcttctttcctgggatgcaaggttggttcaccatacaaaaataaataaatgtgattcaccacataaacagaactaaaaacaaaaaacacatgataatcttaatagacacagaaaaagcttccaacagaattcaacatccctttatgttaaaaaccttcaacaaactaggcattgaaggaacatacctcaaaagaataagagccatctatgataaacctacagccaccatcatactgaacaggcgaaagctggaagcattccccttgagaactggaacaagacaaggatgcccactctcactacttctattcaacatagtactagaagcccttgacagagcaatcagccaaaaagaaggaaataaaaggcatcccaataggaagagaggaagtcaaactatctttgttcacagacaatatgattctatacatagaaaatcccatggtctatgcccaaaggctccaagaactgataaacaacttcagtaaagtttcagaatacaaaataaatgtataaaaatcagtagtattctatacaccaataatgtccaagctgagagacaaatcaagaatgcaatatcagtcacaatagctataaaaagaataaagtatttaggaatacctagcaaacaagggaggtgaaagatctctatagcaagaattataaaacactgttgaaagtaatcagagacaacataaacaaatggaaaaacattacatgctcatggataggaattattactattgttaaaatggccatactactcaaagcaacgtgcagattcagtgctatctgtatcaaactaccagtgtaatttttcatggaattagaaaaaactggccaggtttggtggcttatgcctgtattaccagcattttgggagatggaggcaggaagatcacttgagcccaggagtttgagaccagcctgggcaacatagggagacctcatctctataagtaatacaaaatagttgacaggcatggtggcatgtacttgtggtcccagccacttgggaggccgagatgggaggatcacttgagcctgggaggtcaaggctgcagtaagccatgatcatggcagcctgggcatcagagtgaaatcacatctcagaaaaaaagcaaaggaaaacctattctaaatttaatatgcaacccaaaaagagcctgaatagccaaaacaatcttaagcaaaaagaataaagctggaggcatcacactacctgacttcaaactatactacaaggctataataacaaaaccagcatcatactagtacaaaaaaaaaagacacgtaaaccagtggaacaggttagagaacccagaaataaagccacatacctacaggaatcagatctttgacaaagtcaacactaacaagcaatagggcaaggactctctattcagtaaatggagctgggataactggttagccacatgcaaaagattgaaactggaccccttcgtttcactatatacaaaaatcaactcaagatggattaaagacttaaatataaaacctaaaactatgaaaatcccaagagaaaacctaggacgtataattctggacatagcacctggcacagatttcatgacaaagactccaaaagcaattgcaacaaaaccaaattagacaatgagacctaattaacctaaggagcttctgcacaacaaaataaactatcaacagagtaaatggacaacctaaagaatatgagaaaatatttgcaaattatacatccaacaaaggtctaatatccagaatatataaggaacttaaacaaatcaacaagtaaaaacaacctcatttaaagatgggcaaaagacatgaacagacacttttttttttttttgagatggagtctcactctgtcacccaggctggagtggaatggctcaatctcagctgactgcaacctctgcctcccaggttcaagcaattctcctgcctcagcctcccgagtagctgggattacaggtgtttgccaccatgcctggctaatttttgtatttttagtagagacagtgttttgccatgttggccgagttggtctcgaactcctgacctcaagcaatctgctagcctcagcttcctaaagtgctgggattacaggtgtgagccatcacacccagcttaacagatacttcttaaaagaagtgtatacatgtggccaataatcatggggaaaatgctcagtatcactatcgttagaaaaatgcaaatcaaaaccaaaatgagatactatctgaagccattcagaatggctagtactaaaaagtcaaaaaataacagattttggtgaggttgcaaagaaaagggaatgcttatatactgctataataagcattattataatgtaatgggaatgtaaattagctcacttcctgtggaaagcagtccagagatatctcaaagaacttagaactaccattcaacccagcaatcccattactgggcatacactcaaaggaatattaatttttctaccataaagacacatgcacatgaatttttatcacagcactttttgcaatagcagagacatggaatcaaccctgcccattaatggtgaattggataaagaaaatacggtatatatacacaatggaatattacacagccttaagaaagaatgaaatcgtgtcctttgcagcaatatggatgcagctggaggccattattctaagcaaattaacacaggaacagaaaaccaaatgtcaatgttctcacttataagtggatgctaaacattgagtacacatggacacaaaggggagaacaagagacaccaggacttacttgagggtggagggtgggaggagggtgaagactgaaaaactacccattgagtactatgctcactgctacctggatgatgaaatgatttgtacacaaaaccacaggggcatgcaatttgcccatgtaacaaacctggacatgtacccccaaacctaaaataaaagttaaaagaggaaaaagaaagtctaaggccagctcaatttttcccctcataaaagacttggtcattttgcctggaggcccagggtatcctttatttttctctgaagtttagtaactttattaggatctttctgggcattgatgattgtgggtcagttcttcctggcataaggtggctccttcaatatctagatcaagtttaatattttttaaaaatgaaaacatatctaaattatattttaaattatgtacttatattttaaaaatttgttttgattcattttttcggtttccttctttggagaccagttatgcttttgttggatctccactttctgtcatataatttctctttaatccccatgaactctttatttccacttcatttcatttttgttcgcatttctatcctctgtgtcctgcactgggtttttcacaatgtatatttgatcttgcaacatttctcagttcatctgcaattctgtgatgattcccccgcttcattcttgagtgctattcatactttatctccttttgctgcctcatctactcttacctgaattttggcatttcagcttttaagtatttcttcatagatgagtgcttcaataagattaaaaatttttaaattttatgttacctacttattcataatgttcatctgttccccagaaaaatttttctccactttttatcgcaaagtttttattgaacaatagtaacacgacaataaaaatgatacacatatgaaagtgaatgaagatctgcagtatagaaaaggtgtgtacaaagagaccaacgttcgggttatatagttctgtaaaattttagccatagcactttaatactgatcaagcagacacataaaaagggaaaaagtttatttaatgtttttgaaacttagacttctgactacccagaaacatttttataaagagtattattcttctgttaatagattttgctcttttgttattctttcttagaatatctctgtatgcagtctatgctaatcccttttttattatttatcatttaaaagggcccaggatagcatttcagtttagttattaattatcacaactggaagtcttcctgtagtctactacaatgtcaaactccctcctgtaagcatggcttatctgacgtggcccactgcctctatttctgtgtaataagtcagggacaggagggactactgccaccaaccaactcactcttgtttttgcacatactgttccagacaaaggagagaactttgcatcttggggtgtcactcacatccaggaataatatttctgttggcgctttgtgaggactgccactgttaatttctatctcccctgctttcaccccttcctccttcctcctgcatagctcctgcatgtacaaacattttggaatatagttcctagcttcacctaacatgcagtctgattgtttttctttctttcttttttctttactatttcttgaagctttctaggagaagaagagaaggatgagttaggtagtcatgtctacgttggaagtcctgaaggattttgtaggtagaagagtgttctgatcaaagctttgcattagtattattagtattcctctaactgaaatattgggaatggataggaacgtgctcaataggaaggaggaagacccttcagaggccactgcaataaatcaaagaaaaatcctgaaggcctactgttgctgagcaaggaggaatatgaatagatcgacatggggttgatatgacagatattctggagacaaaaaatgctcggaattggcaagcattttcttggacaaagggaggaatgtggaggaggcttcgaacctagataattgaaaagatggtggctatatgaacagaaataggaaaatcaggtagaaatcaggttttggaggaaagatgattactttgtttatattattattattattaattatttttaagacagttaatttgattgaatttgaagtgctaagtgacacccgagggagttgtccagtaggcaatcagaaaagggtgagcagggagggaagccagggttggaggcagacctagagttattcatgtagacgtgatatttgaaaccatgggactttataagtttggtggaaggtgaagtgaagaaataaggacatctaatgaggaagacaaaggagtggtcagaaaggcagaatactcaggaactttgacaccaaggaaaggtaaaaataaatagaattttcatcatacagtgacagccaattacatgctgggcatattacatgtatgatctcatttaatgctcacaaaaaatctgtacagtgagtatctttattcccactttgctaattggaaaataggctcagagaggcagagtaactcacagtatcaggctttaaactgtggtctcccctcaaagtagaaaatagttgccagaagaagtggataaggtcaacactgtcaaagtggctgagaggttcaggaagatgattattggggttaggagacaatttggaatcttcaggagtgtggaaagctgtgtgaataagtttggtgaggtagaagctgggatgtaagagtctgcagagtgagtgagtgagtcaagaatttagagtacctctcagagtttgctggttaagaggagaaaggttagatgctaccttgcagggcttggtggagagtagccaaggacttgttaggtcgatgagggccttgaatgtgcttacagcagaagggggaaaagccctcggaaagggaaaccgtgaaagtgtaaaaggaaagaacatgtacatgatggatgagatcctagagaatggaggccagggaggatttgggtttagccaagaagagaggtctttagagagaggaagaaaagcaaagagggtgagtgaagaaactaatattcatgaatggaaaagaatgataggaagggagcttggctgaggctgaatgttataagtagtaacaggggataccatctgctgaaggtgagagggaatggagacatggagagaatagaggaatgtgggcagtgtattagaggatatggcttaaatgatgagggagttgcggaccagagtcagggcccacttgaggtaagacatcacaagcatgtcacggccctagtgattacatgttgcaggaaatagttgtttggggatatggtttttttttggttgtttcagtctttctcccatcagatttgaccaactccacttaacttggtcaaatccaagtgagaattccaaattatgggtaacaaagcctctctaatttggctaaaattcctcacagctgcaaaagaggaaaacaaaacaatacaaaacaaacccaaaacactatgcacttggtttctgagtttgcttcctgtctcaaaaaaaaaaaaaaaaaaaaaaacaaaccaaacaaatgttctttcatttacttttctttcaccctatacctctttccccttcaccatctgctttactaaaaaatctggagaaggcttctaacgacttgaactcctgtaaagaactcagaacaaaggtgccactcacccctgttggggtgttctgttttctttgtggagtttcaagagtcatgggtggattcttcttagttctaaagttctgttttcctatattgtatgatttgacctctttggctttgtgggtaccagagattaccttgtactgtgaggagatttgaccttggtgtgtgtaatggcactgagagctccaaacttaggggtggctaagcacagtttacaggaggtggtcttggctctttttttttttcttccttggaagttgttgtttaaggatcctaattatagttcagagatgtattctaaagcatcttctctattgctttttctcccaaaattaatctcagttcagcttgtctgtgtgcatttgtgtgaggaactgaactgttgtttttataggtaaatgagggactgagttttctcagccttgaagagaaagggcatttgctcctcccagccaaaaggtgcccctgggtgactgggggccttgtggaagtgtctggtgcgttgacctcccataatgtgcagtggcccttatagggaaatccccaacaaaaagttatttaaaaaaaggcttgtccaggaaatgcatacaagggctgatcacttggtgttttgagccctctcagaggtcatggacctctggagggagaaactgagacatataagagggtggaaatgatccagtggtgacacactgtggagtcctgctcatgagcagcacacatcgatccaccacacaaaacccctaggccacagctcaattcctccttttaagaaaaacagtgggaaacaaataatctaagaatgaggagtaaacaaggagaatgacccctttttaagcactctgtagttttttttttttttgaggtggagtctcgctctgtcacccaggctggagtgcagtggcgcgatcttggctcactgcaagctccgcttcctgggttcacgccattctcctgcctcagcctcctgagtagctggaactataggcacctgcaccacgcctggctaattttttttgtatttttagtagagatggggtttcactgtgttacccaggatggtctcgatctcctgaccttgtgatctgcccaccttggcctcccaaagtgctgggattacaggcgtgaagcactctgtaggttttacggcacttctacctgccagagtttatgtaaaatggaagtgatggccagtgtggtggctcatgcttgtaatcccagcactttgggagcccaggttgggcagatcacaaggtcaggagttcgagaccagcctgaccaacatggtgaaaccccgtctctgctaaaaatacaaaaattagccaggtgtggtggctcgtgcctgtaatccctggtactcaggaggctggggcaggagaatcacttgaacctgggaggcagaggttgcagtgagctgagatcatgcccctaaactccagcctgggcgaaagagtgagactccgtctcaaaaaaaaaaaaaaaaaaaaaaaaagaaaaagaaaatgaaaataatatggcctttgtgcatattcacattaaggaaaaagagccctaaggttgacctgcaaactatggagttcctaagttctcttttttctctattttcttttcagcctgctttaaatctgctattatttttctattaaggtaaaaaccactgtttggctccaacaggttttttgtttgcaagccagtgaatttgtatttatctcatggctaagttctaaagtaaaagctataggatctttgtgtgcgtgattatatgtgtgtgtgtatatatttaaaaggcctttatggtttctacaattttatgtttaattggcaattaaatctgttttaatttccttctagcacaccagactttttctctttgtaccttatgacgtaaattttgctatttgattttcacctgagttgtttccttcagtatgcaaatttaaagctatgtagctgataactgcttaggttactgaaagagttataataatttaaaaggttatcaagaatttgaaagtctaaggtaggaaaaaaagctctttttgaatctataagatatatttctattggcatgcctaatacctctatgtatttatatgttgcgtacacaacgtttcactactgaaaacatataaaagagctctaattaattggcttaagaaaataaaagtgcttgaatcaaataccttatcagaaaaagtaaagtctagttaaatgctttgtcaagtttacgtaacttaagcaaactgtttaataaataacctagctttaaaattattggtaaggtaatattagaaatgtcttaagaattgacagcatacatttttgtttgcatttattaatcaagcaattttatactaattcctgccaagtactataaagtgtcaacatttggcataggggttaaaaaactataaacccagcccaagacagaatgatctttgtttatgtaatgtttaataaataagatactcatattggtttaatggaaacaactacatcttgaatttagtaagattaccataacttctaatcttgtggctttaggcggtctagtccacaggcagtaagatttgttttgggaaaagactgttaccatctttgtttcaaagctaaactataacttccttccaaagttgttaatagtttggcctatgcccaggaatgaatgagaacagcttggaggttagaagccagatggagtcagttaatcagatctttttcactgtctcagttataattttgcagtggcagtccataactgtaaatgatgactattgaaattttcataaataatctaggtaaacaaaataaaataattaggcaaatgtaatgggataagcacttgtagacaaactcattgtaatttagaatctaaagttgtattaaattaaataatagatatttcattatttgggtattttccaatgaaaataaattgtaggaaaacattctttctaaaaaaatgtgtgtcctttctaaaaaggtgaacaatttttgtatcattcaaagcttatttaaaggttatgtataaaacaaggtaaaatgaaccaggaaataagagagatgtaaagaaagttataaaaaaaagtgttttttttttggtaagaaatcttaaaaagaaatattttatgtaagaaagaatcttacatggtaaatgtagtcctagaataaaatgactggttgtttaagaaagagggacgttcaggacaaaccaggaagtccaagaatatcatgaacaatctgtataagtcacaataagaggatttatatacataaaaaacccaaaaaacttttatatgattaagtagtttgtaattaaagggaaattataatggtctttctacacattgggcttgaggtaaaaaaaaaaaaaaaaaaaagcttgtacaccactaaataattggttagaacaatgaaattttcttaaggaatgtatttactcttaaattgtaagttttttttttaaccaaagttcaacttttattgcatctcactatttttgcttttttctccccttttaaaggccacgaaatactaacaactcattttcagctcatataagttgtttttccttgggttctgtttgttgtggcctgatgctaacaatgttttcttaaaggtctaaaggaaatgttttcttccaatataatatttggtacactgtagaaggtcttttcttttgccttttggtaactggcctaactggcctaacagattttatggtttattgaaacaattcctatgccattattattaagtttagtttgcacaggaaaaaatctgagattaaaaaattttttttaaattaagattattacacctgtgtatctttctgtatgtgcttttaaagtgctttgacattgagttacagggcttttactcctgagtctaaaaaggacagcaattcctgctaaatcttaaacactgacagcaattaatctcacatcttcgggtctggtagaagacgccgatcaaagtaaactgcattctggagacacagggccagaaattaaagctattcaatcctcaaggcccagggactattgcagaagaggtgagtgtgtgattgtaagggccaattttgagagagaaaataaattcagtttctataaattaatcatcaatgtcaaaggcacactgatgcaagaccagcctatgggcccctatatcagattaacaaggttttcttgaagcattaactgactccctaataaaggttataaaaggcttatggaagttatatcttatggttaagattgcaattttatagattgtttataaaattttgaaaaacaaatttaattagcttcatgctgttttattagggcttattgtttggaaaattaagtctcctgtcccaaagaatgaaggttataacctgttcttttttgaaatccttgagttatcactttggtcaaatgagtgacttattttacaatgacctgtgatatcaagtgttttaaacctttgatatttgacaaactttccaaaatcaaattacaaattatgtatttttctgacctaattaatcctctaagatattaggttccctaaagtccaaaaatgacataatttggcttatttggtataaaaattatacaggaagcattgtcaaatatgaaatggtgtttggttttctttgggctgtgattgtataaatatgttattggtatgtgtttcaaaattatgagaaacttctataattatgatatgacttagtgtatgttattagtaataattataatcgttatgttaaatttttgtatactacagaggtaacaaatttccttgtcaattgtgtctttgactatggctgccctaaaactttttgtcatccatggacaattgttgtcttgtttttgtcctctttagaaagtggttttataatcagctataaaactctaacaggtgcttctgaacacaggtttctgataactttggagattgtgacatcagaatagggaaaaaactttcaggactcatggagagctgaaatgttcatgaatatcaagcagaacaggaattaacagcatggactgaactaacagaagattgaagtaatctttttgacttttggtttaaaatgttgctgatcatttgtttttttgtcagagtcaagaaaacttttcttttgagttattgacagcttttaagaagttagtatactcctatgaacaaaatttggagcatatttttttctctctacctgatttctccagaatttggaaactatttgtgagtagtcttaacttatggcaatacaggtatttgaataagtctaataagaagctgttttcctttgtaataggacacaactggagaacctggttattttaccaagactttgactggaatggtgtgctttcctttaaggaactgaacttgacttatggagccaataaaagccccttgggaaaactggcctcataccttgtttacacagtccttgtacagggttcctgaccggtggtaagtaaagaatctcactttctgacaggcccaggagccccaagttttatgttgggacctcaagaggagaggaattgacccaactcataggtatttgatggtacaaatccatggctgggttgggtttttacaaagtcttatctgagattccttctatggaacaaagttccattaaagccaatataaaagcctatgtaaaaaataattattcttgcagcactgtatacaaataactgggccaagtataataaagcaaatctgtcctaccatgatgtgtctttagtaaaaataggaaactggagaaaaattatgtttcaaaaactatagtatacctgttgttagattctagtcttgtctaatgtttttcaatttttattattttctacaatttggactgaattctaatttttcttggctacaagtcttcaaaataatgttaatattttttcctttttttcctcacttttcttaatttggagtcacaaaaactaagctgtgctttcataaagccctgtgaactgaagctagacaacttaaacttcagaagaaaataatggtaacctatttacatacataagccactttcatacctgcctactgatggatcgacttcacagtaatgtggcctatattgattttccaagattgttcttttgtctgttgttgtttttctcccttctccccctattttctcttcataggacatgagacttaacaacctgctaaaaatgagctttcctaacaacttgggacctacctgtctaggaataaaccattatagccatgacagatcagatgaaacctgagatcagagactcattttcttctaaaatgctttctccaaaagattttaaaaaagaaaagggggagtatgtcaaaggaaaatcagtcttggggcctccaaatcactgagctaaagggaaaagtcaaactgggaactgtttaggaccaacttgcctcccattctattcaaagacacccctctgcttactgagataaatgcatatctgattacctcctttggagaggctaatcagaaactcaaaagaatgcaaccgtttgtctcttatctacctatgacctagaagccccctctctgcttcgagttgtcctgcctctgcttcaagttgtcctgacttcctggaccaaaccaattttcatcctacatatgttgactgatgtttcatgtctccctaaaatgtataaaaccaaactgtgctctgaccataactcctcagaacttgctaagactgtgtcatgggcacacaacctcaactttggcaagataaactttctaaattagctgagacctgtctcagatatttggggttcatgaaggctactatgaacatctttacacacacaaactagaaaatctataagaagtgaatacattcctgaaaatatacaaccctcctagattaattcaggaagaaatagaaaccctgaaaagacaaataacaagcagcaagattgaataagtattaaaaaatgccaacaaaaatgtccaggactagatggatttacagctgaattccaccagacattcaaagaagaattggtaccaatcctactgaaactattccaaatgatagagaaagagggaatcttccctacatcattcgatgaggccagcatcaccctaataccaagaccagcaaaggacatgtcaaaaaaagaaaactacagaccgatattcctgatgaacacagatgcaaaaatcctcaacaaaatactagtgaactaaatccaacagcatatcacaaagataatgcatcatgatcaagtggtttcataccaggaatgcaggaatggtttaacatatgcaagtcaagtcaataagtgtgatatattacataaacagaattaaaaacaaaaaccatatgatcatctcaatagatgcagaaaaataatttgataaaatctagcatgactttttgaaaaaaaccctcaacaaaacaggcatagaagggacttactttaaagtaataaaagccatatctgacaaacccacagccaatgtcacactaaactgggaaaagttgaaagcattctccctgagaacaggaacaagacaaggatgctgactttcaccacttctattcaacttagtactggaagtcctaaccagagcaatcagacaagagaaagaaatgaaaggaatccaaatcagaaaaaaggatgtcaaaccatcgctgttcacagattatatgattgtatagctagaaaaccctaaagactcatccaaaaagctcctagatccaataaacaaattcagtaaagtctcaggatacaaaatcaatgtacaaaaatcagtaacactggaatacaccaaaaatgaccaagctgagaatcaaatcaagaacaacagctgcaataaaaagaaaaccttaggaatacacttaactaaggaggtgaaagatctctaccaaaaaaaccctacaaaacactgctgaaagaaagataagtgaaataaacaaatggaaataagttccatggccatagatgggaagaatcaacattgtgaaaatgactgtactgctcaaagcaatctacagattcaatgcaattcccatcaaaataccataattcttcacagaactagaaaaaacaatcctaaattcatatggaagcaaaaaagatcccacatagccaaagaaatactaagctgaaagtacaaatataaaggcttcacattacccaacttcaagttatactacaaggttacagttatcaaaaccgcggggtactggtataaaaataggcacatagaccaatggaacagaaatagagaacctagaaataaagccaaatacttggagccaactgatctttgacaaggcatacaaaaacatacattgggaaaaggacaccctattcaataaatggtgctgggaaaactggcaagccacatgtagaggaataaaactggatctccatctgtcaccttatacaaaaatcaactcaagatgaatcaaagagttaaatctaagatctgaaatcataaaaattctagaagataacatcaaaaatactcttctggacattggcttaggcaaagaattcataattaagtacccaaaagcaaatgcaacaaaacaaaaataaattgcttcttcatagcaaaagaaattacagagtaaacagacaacccacagagcgggagaaaatattcacaaactatgcatccaacaaaggtctagaatccagaacctacaaggaactcaaatcagcaagaaaaaaacaaataatcccatgaaaaagtgggcaaaggtcatgaacagacacttctcaaaagaagatatacaaatggccaacaaacacatgaaaaactgttcaacatcactaattctcatggaaatgcaaatcaaaaccacagtgagacaccagcttactcctgcaagaatggccataattaaaatgtcaaagaacaatagatgttggtgtggatgtggtgaaaggaaacacttttacactgctgatgggaatataaattagtacaaccactacagaaaacagtatgtggattccttaaagaactaaaagtagatctaccatttagtccagcaatcctgctactgggtatctaggaaaggaaaataagtcattacataaaaaagacagctacatgcatatatttattacagcacaattcgcaatggcaaagatatggaagcaacataagcgcccatcaattaatcagtgagtaaagaaaatgcagtatatacacaccacggaatattactcagccataaaaaggaatgaaatattgtcttttgcagcagcttgggtggagctggaggctattattctaagtgaagtaactcaggaatggaaaaccgaatattgtatgttctcactcataaggggaactaaactatgaggatgtgaaggcatacgaatgatataatgtatgttggggattcagagaggaaggttgggagtggggtgagggataaaagactacatattggatacagtgtatactgctcaggtgacgggtgcattaaaatctcagaaatcaacactaaagaacttatccatgttcaacccaaaccacccatactccaaaaactattgaaataaaattaattaaaaaataactactgagtgttcaaaaattatgaatgagcaagtgaatgaatgtctcaccataccctcactatagtggttataataatttatcagatctttgacattatattgttattattttccttttcattgccactatttcccctgaatccaggagtctctttcatttgagcctttttcatattttatttgtaatttatattatggtctctacttctaccatattttaagattgttttacacatctttaagactttgtagcacttaagttaatgatttgtacacagtaggtgtgccagggattaggtaatttatctctggtattaggatggatacaccctggcttcttggagaactgaataagatctaagccaaatggcagctatctgacgcaattctgatctgtgtctggttaccctttactggatagcagttgagtggcaagtaaaaatgtgggccatgacaccttctttgggtgaaagagaaagagcactgattttatttattatttgtaggagctggagaaaattacttaacctctccaagacttagtttcttcatgaataaaatgatgtcaataatatcttcttcaaaggatcactttgaagattaaatagataatattatgttattaaggcactgtacaaatatttttagtgttttacatatttccaacaataaatttaccaaattaataagttaatagacttagcaggtaaataatgccactgccatgcagacactcctggatggagaagagttaccagccaggttattagtttgatttctgctatagttaatgagaatatttaggtatcattgaattttcataaaaagatgctctctactaaatccctaatttttcagaattaagtacagatagccctaaattacccagggcttgtacacatagaattgctgatcagtattagaaattgttctctggcagaaatcagggagtcatccaaatgctaccttctattgaggctttcttttcagacacttccctaagtgagtttaagcttgtaaaggctaagatataaacaagaggatgtaaatttattgcagtgcaagagtcttaatctagatacaggtgctctatttagattttaagaatgtgattgctttgatggaacttaacttgagagaatttgttgtgtgtttatccccaggtagcctgggccatggacatgggggattctccatgagagccacaaccacacccgattaggagagtagtttttttttttttttttttttttttttgagactgagtctcactctgttgcctaggctggagtgcagtggcatgatcttggctcactgcagcctttgcctcccaggtttaagtgattctcatgcctcagtctcccaagtagctgggattacaggagcacaccaccacccccggctaatctttgcatttttagtagacatgggtttcaccatgttggccaggctggtctacaactcctgacctcaagtgatccacccccctcagcctcccaaagtgctgggattacaggcgtgagccaccacaccggcctaggaacgtacctctcacgccctcccagggctgcctggtctaacaggacatcactctggattctccagtggcacctgacacaggctgctgatagaattgtagcacctgtcctgacaggtcagggctggctgacagcgcctcagaaactaaaggccacttctcttctgaggattgcaccctgcctggagtgggagctgaactcttcctcttcccgggtctagggatggcaggaggtggtaattcagcattgtttgtttttttcctcttacctattgagtgtgcatttcctgtgtaagatctcactcactctgaagaactgttcttagtttcattttcagagctagggtattagactttgaagaatcgaagctatatagaaacctcacaaagtcagataattaaatatgtctgtctccttggtgatcttggccaggattttctgcagtaaatattgccactatattctcatgtgcaagcagaaaggaccactgaaactatatggccttacgatgaataacattggaaagcaccagggtatttgcttcattttgtcaacctatccaaatagacacgttctctttattgtgccctctgccataaagtcagtcagtacttcgcaggtgtcccatgaacgtgttaacagagaacttcatgagtgtgtctgttttatacacaatatgcaaagctgagaaacatgttactaatataaaactgagggagtaaaagaaaaaccattcaattgggctattctgcttacttatgacaaaaaggaattcatttacacagctggatatataaaaatacctgcattccccatatttttatttttgagcaggagtctatggaaacctatgtcctgaagttctggtgtattttctggaattattgcaattaatgattttcaaccttctgttccctttttcttttactcattctgtctctttgagttctgggaaattcaggaaccatatatgcttcatttttactaaagttatacatgcacagagttgagagtcatctattcccgcaagatttggtgtaaaaattacaagcctcaatgccccattcctctttccacagaggcaaccagaggattagactggttctttctgctagttggtctttgaagatggcttccaaggaaccgtagctcccagtgttcatactcttgtgacatctcctctcatgcagaatctgggctggcctggtggctggctgtagccaatagaatgcagcagggtgacatgacggcagttccaggcagaagccttagcaaggtctgccagctcttgcttttgcctcctaagctcctgggggcagaactatcaccttgggtctcccttcttcacgatccagggaatttccaactcctctgttttgtgtggaagctcctatttcttgtgttttgtgttctgtatttgtttattattttttggtttcctctttcattttggtagagcacatcctccagtagtttctgaagaaaaacatctgcagaaagtggtttttccaggcacctaatgcctgccaatatctttattttaccatcacaagtgatcagtagattagatataggcctagattgaaaatacatgtcttcagaatttttaaggcattgcaaagttgtataatagctttctgcattgttgtttggaagtccaaagcattctagctcctagttctttgcatgtggcccactttttctctttagaagctctcactttctctcttttcccctgttctcttgctcctgtgttcctctatattatgatagtatgacttggtataggattattttcactcagtagtttcttacaacctgaaaatgtatgttctggagttctgggacattttctggaattattgcattgtttttttatccaccattctctcttttattcttcctgtctctactttctggaagagtatttcaattttatgttttaattattcccttaattttgtattaatgctatcctatttttaatcccccaaaactctttctagttcttaaaacaattgagtgttttataggatgttgttctttttttaatggttaaaacattttctttgatttctctgaggctattaaagacagtattggtgaatttccttctccctacatagctctgtttgctccacactgcatctcgctgtttatctctctctctctcttctgtgttagaggtctttcctatgtgtttggcaatccttggttaactgttcatatttaagagtgggcataagagtgctgactggaagcccccgagaacataagtggaaatgatcaactgtgaacttaatggttagataaactggttgggcttcttatctgggaaatcttttgtgtgagtgtctttaggtcttatttcttgggaagatcaaaatttacagaaaaggctccttccagtcttttgcctggaggataaagaccaagctgccagcacactgggaaccaagttggggaagagggctgaggtctcagcatctaatatgcattaattgatttcatctccttccccttgcatggccctctttcagtgttgtggcccaggtctcactttgtacctggttcccctagaccagaaaatctgttttactctcactagagaataaatatttaccttttgattggagtgtgctttgcagagtagaggagaggatatggcattctgtctgcttcttaaaaaatacaataaatcttttatattttctctctcttcactctccctttttgtttctggatgccccaattcctgggccttttgagcattttaaaatgtaagtcagtttgatatcagcttaatattcaggtttgttttctggtctgctgttctccattcttatctgcttctcatcttccatgttagaaatgccacacatcacttctgatcacatcccattggttgaagcacactcacatggccccaacttctctgcaaaggaggctaggatagttagtcttccagtgtataataagagaaaccagtgtggtgagcatgaaatatggtttctgccctaatccttttaatataaaactggtcatgcttgtttggaggggtccagaagagaatgatagtagattcttgtgtttagtggactatatttatctggtactttgtctgtattatttcatgcatcaagaaaagtttagtcatcattgactgtcccaaacatgtcaaacatgggggtggtccttaacagtcgatcatggccatcgatgctcagaatgcagagcaagtgtcctggactcagacaaactgggttcacgtatagattccatgaacttctagcatgtgaccttggccaagatacttagcctctccatacctcagtttcctcaattgtaagatggatgatactgctagtacctgccccattgtggtacttgtgaggattaaagtagttaatatttagaaacatagtaacttctgggccgggcgcggtggctcacgcctgtaatcccagcactttgggaggccgaggcgggcggatcacgaggtcaggagatcgagaccatcctggctaacacagtgaaaccccgtctctactaaaaaatacaaaaaattagctgggcgtggtggcgggcgcccgtagtcccagctacgcgggaggctgaggcaggagaatggtgtgaacccgggaggcggagcttccagtgagccgagatcgcgccactgcactccagcctgggcgacagagcgagactccgtctcaaaaaaagaaaaaaaaaaaaaaaaaaaaaaaaagaaacatagtaacttctatattagttgttattgttgtatgttagatttactgttatatctattttttcatgcttagccaggaggaacatacttttattattaatgtaagctacttatttcagaattgtgctgctatcaatttctgtgattatgtaatgcagactaggcagcaactgatttaatgaatgaagctgattcattgccctgaagcaagccaagaaagaaaagtatgattccatagccctgctgggaagtcggcagtgatgagttcctcacaagccaagaggagctcagaagcgttgggatggcaattagcttactgtgcagatcactaaacacaatgagctctgattctgtgccagttctgaggcacgagaaagtcacagagcacaaggatgcccagcttctgtgtaactaggggctgggggtgaccacagctgccatcagaactggctgcatggcgcaggggaaaaaataattgacctgggtgtctgaagacctggattccagttcttccttcaaacatcagcagacacctctcagttccctaaatgcgtataactctattcagctttcagatttcacagtgagacaatattatggatatggtcataatcccgaaaaatcttctaggaatgtcctaagacttgagactggtgaaccctggtgttcttggtctttgcaaggacttaagtctacatgttacagcttttctcctggttatgaccctgaaacaaagaacaccatgctgtcatcttctgaggagagatgggagtccaggccccattctctcacttactacctatattaaagaagctgaagaaagctgaagaaaccactctctcctgtgaaatgccattggaactctgcttaggaagaggactaactttgcaaaaatatcctgcaaacctgcttataatagatgaaccttgagggcaggggtcaaaatatcagaggacagggatgaactagaactactctgtctgaaaagagaagaggtggtttcatttttctttttcttttcttttctttctttctttctttcttttcttttttttttttttgagacagcatctccctttgttgcccaagctggaatgcagtggtgtgatcactgtgggctcaacctcttgggctcaagcgatcctttcatgtcagcctcctgagtagctgggactacaggtatgcaccactatgcctggatatttaaaaaaatttttgtagacatggcatatcaccatgtttcccaggctggtctcaaaatgcttggctcaagctatcttcctgctttggcctcccaaagtgctaagattacaggtgtgagccactgtgccagcctgtttaactcttaaggggaggtgactaatgggagaaggagtggtggtggtggtggggtgtgagatagtatgatactgcgaaagtcacaggtgaaatttctctggaaatttctgttggaagatggggtttgatcatacctaccagtttgcctggacattctgattcattccaggtgttctggcataattattaatactgccaactttcatgccgaagaaagtgccagtttggaggtaaattatctggtaaccattccgcagggttgtgaaaattaatgataaaacttgtataaacatgctctgtgaattataaagcactgtacaaataaaaggaattaagggacttaagttcttttattgaattctcctgttagagacaaacaaatatgtctaaaattgttatctactttggtctgttattggactgagatctgtttggatttccatgaaaataaacctgcaagaaaattaattttattttaaggtagcttagcatgtgcttaaccactttctagattcaattcctttcagtggtctgttctggattctcacatgtatgctagaggttttctgctgtttttgtttttttcaaatttatgagtcctttcaaatctggcattttacagttttgatggattttgaatatgggggatatcctaatgccctaggaatttttaaaacccgtttcagaagggaaagagtataaaacgattatgtgttaagtatttaccataaagaaggcagagtagagtgtccgcccttaaagagctagcaataaccatgtcatgtgtcccttatatcaaaccatatgggagaggtttaattgatttcccttttcacatggaagggaattgaggcacacagaggttagataactttgtttactggctacagccagtaaagaattaggatttaaggacatctaatctgagccaaaacctgttgatcatccattcagaagttacaaatatatattgaattccgactctatgccaggcactgtgtatatgagtacactgtggtaagtaaaacaggtgtggtccttatttctagtttggtgtcatcattatcaatcaggccatcatctattaaatagatatcccagatgttttgttaagtgctttgcttgcattatcaattaaaattgttacaactgtgtattattattattatttctatcttatagatggggagactgtggctcaatgaggtcaaacaatttgcagtcagggagtagggatgctttgaatatggccatcatctcactggctcactgtggtaagtaccacatgcagggactgtgggtaggagtgggagctgggctgagaggagcctagtggggaaagcctggagcaacctgacccttatggaatcatttttaaaataaggaataggctttggtcttggaaaaaaagtgttaaaaatgtaatctcttcacaaattcttgtcaaaaataatgaagtacaaaaccattaaaattaaaaaaggtaacagtgattattataataaacattatatggtaagtaatggtaggtaataagtgatatatttaggtttacttgaagtaaactttatgagtatgacttgagagaatgtctgaaccctgattagtattcacttgacctagttccagtttttatctgctgaatgaagaatgtatccctggaacatagatttataggtgcttgcatttgaggcaaatttgacatactttgcccctcagtagttttatttatttattcatttttgagacagagtctcactctgttgcccaggctggagtgcagtggcatgatctcagctcattgcatcctccgttacccacttcaagcgtttctcctgcctcagcctccccagtagctgggattacaggcatgtgccaccatgtccagctaattttttttttttttttttaagtagagacagggtttcaccatgttggccaggctggtcttgaactcctgacctcaaatgatctgcctgcctcggcctcccaaaagtactccttttaatataattgtagagatgtgtatttcttttagttgcttttagtcttaccagcatcctttctttccccctctcctggttttagaacctctgttttctttgggaaccaaaaaccctgacatgaatacagctaaccccatctctcattccacagtcatagggattctctcaattcccctgccacagtgatgaattcagggatgggcatggatccaagatgagcaaattcaagtactcccgggacctttctgttgcagttatcaggaaagatgtttccttctgattggggttttctcagttagctgggcatgagtctggtactgctcatgatcactctgtctaacctatgtacagattagtgtccaagagatacaggacagactctgatgacatcatttgagccctggatgccactttgcctgaattcagtttatctttaaactttggtcatgtgaacttacaaatctgttttatttgtttttgctggagcttcttcaaattgtgtttctgttacttgtaactaaaacaattcccagtttcagcaatattccactgatgctctaacaatttaaaaataaaacaagtatgagatcacccttattcttgccattatattagataaaactgtgggcatcctagtttcttcactaaaatattggttttctttttttttccatttcttccttaagttctggtgcattcagggtggtactcgtgtctgaataattactagttgtacttttgtagggggagtgatgccaggaggacttctgttccaccatcttgctgatgttactctccctcactaaaacattgtgtgtgcaactagggtcatctgggcagctggtaagtgtgccgagaattttaggaagtagacatccagatctgttaattagtcgagatcccccagaagcacaggtgcaaacacctgtgcacctgtggctttgtaaagccagggaatcttgtatcttccaaagcctaatgtatgcaatgtaaagaaaagtgggtagaagtgaagagacatgggtttaagctttggctctgccactaacttgacaaactatcttgagtatctttcacactctttggtttcaatttcctagtctgtaaaatgcatggagtagcaagggggaaagtggatatttggcttccaggtggttttgggatgaggtagtaataagaggcacatggaagacactggctttgggggttccatcctggactccaacttctgatgaccaatttgcttcataacatcaaagttaatgatttgaataaaggggtaaaatggaccaccaagaaacaagtgcatttgaggaagcttgatctgcaagtcagaagacacaaggaagctaaaagtggcctaaagcagagaatggcttaataaatacttttggaaagactcaacactataaaccttacctggtgtgtttagtccctaactaaaacactttgctatccacctacagtttaccaacccacacagtaatgtcctaggcacttttatgtctaaaatagatggaaaatgtctcacattttgactttgtagattgcttttgcacaaaatttcatctaccttcatttgttcactatttaagagccataggatgggcacagtggctcacgcctgtaatcccagcactttgggaggccgaggcacatagatcacaatgtcaggagttcaagaccagcgtggccaacatagtgaaaccccatctctactgaaaatacaaaaaaaataaaaaataaataaaaaaattagctgggcatggtggtgggcacctgtaattccagctactcgggaggctgaggcaagagaatcacttgaacctgggagatggaggttgcagtgagccaagatcgtgccattgcactccaatctgggagaccagagtaaaactccatctcaaaaaaaaaaaaaaaaaaagagttatagtaactttgtatctcataaaaatgtcaacaagtatgtctcttttattggccttatgagggatatataaacagtataaggttaagaaaataataacattaaaaagaaagcaatcatccatgtggtatattaaactgtctgcccacaggaaagaggggcagcaagtcttgtacacataattagaaatattttttattatcaaagttaggccataatacattcaataaaatacattcatgaatcatgaggggttaagcaaggtaacttctcagtaaacactctgggataagttagttgtttatgagagctacctgatgcatggaattattggacataaactacttcaaaacatatgccaaagttttactaagttaactaggatttaactaggttttactaagttactagttaactaggatttaccaagttaactaggatttaagttattttttaaaatgagatgagttaggcagcaaggccaattgcttattgatgttagtgaaggttggtgatagtaactctgcattttctagttaatagagttgggagacatgcattcagaagtcatttcaaaacattatatatataattttttttttgagagagatagggtcttgctctgttgcccagcctggagtgcaatggtgcaatcatggcttactgcagccttgacctcctgggctcaagcaatcctctcacctcaaactcccaagtagctgggactacatgcatatgccactattcaggctattttttttttttttttttttttttagagacaaggtctcacaatgttgcccaggctgatcttgaactcccaggctcaagcagtcctcctgtcttggcctctcaaagtgctgggattacatgcatgagccattgcacccagcatatatatgaaatttttaaaaaatttatctacctttaagtttaggttttcttttttcccctaaagatacaattgtacaattgtaatggaagatgggtcagaacatagagattctcattattttgtgttatgtaatctaatcaacagtatgctttcctaaaacttttctaaagtcatataaaacatactggctattctttttgcatttcaatttcaatttcatttcatttttatttttattattattattttttgagacagagtttagctcttgtcacccgatctggagtgcaatggcatgatctcggctcactgcaacctccacctcccaggttcaagtgattctcctgcctcagcctcccaagtagctgggactacagtcacgcactgccatgctccacttatttttgtatttttagtagaggtgaggtttggccatgttggccaggctggtcttgaactcctgacctcaggtgatccactcggcctcccaaagtgctgggattacaggtgtgagacactgtgccaggcccatgttatttttaaattattttataatttgaacaaatttacaaatggatatattagaagttattctccatgtatctataagtaattaagtagttgattaattattgatagcattaattttgtctgaagatcagaaacacataaaataaaatgataggaactatataattatctctgaaataattgtatgagttcatatgaaaatttgatttcatacagtttttttagttccacattcatatatctcttgcttaaataccccagtgatatttctggtcatttctaagatcaacagtgatcagctattattcatagctatgtgatttctatagatactttgtatagatattacctttgcctgtcatagtcctttgaatatatatatgtgtttgacctttaaggttaattccaaagatcgctatctccttttttgtctttttgacatgaaagaattgtggaggtttttgattacaatatgtctcctgctcagattaacaatatgtgatatcattcttatttatctcttaacatttttaaaaaagcctaaagcccatactttattcacattttcttagtttttaacttaataccctttattttctgctccaggaacccattcaagaaaccacattgttcctgctgtgacaatttctcaggcttcccttgtttttgatgaccttgacatttatgaggagaaacatattgttttggcactctcttttagctcttttgaaatgctttccagaaaagaaagcaagcaataaaggttactttgtccctgtgcctcagatggacttatttaccagtgaagattaaacccaaagaacacaaatttctcatttatggaggacagtgatcatcacatattactcttcagtgcacatgtacgaatgaaactatacagtcatgtggtctgactttatattgaatccaaggcctatgagaatagatgaatggtgggggtaattttattcacagaaagggtccagagaccacttacaataacttcatttgctgtgaatagatattttctgcggttttggagcctggagcaagaggtttatgctgatgtatgagggatgctgacaacatggggctgctgagagagcagactgataaacaccaaagagtttattaagttaactttgggctcctctcttggaagttttctctggttgctgtgattaaggcagggccagctgagaggagcaggtggacagaggggttagcggacctccctaaattcttgagttattcttctcaaagaatctcactcttgaggtatctgaggtccagaaatagaaatgatgttggggctcagaaaaatgattgataggccaaacttgccttaaggctaaactgaaggtcccagaagcagactcagaagcgaagtttctctttgatcttcacctgccctcctgtctctcacctttcattctcccccaaggcaagccatggaaactggaaaccgtcttccccaaggcaggtcatagagaccagaaccccattttcccaaagccagtcataaagcctaaagctattacactaatcccaccccccacccacttctcctgtccttctgtgtcacagctggccataacgaaattaatacccttattccagaagagatctatctcacacctggaagcaagtaaggtaggaggcgggacttgactccagaggcagggctcggacactggaccaaagtgagaactagctaaaacagggccagggtggaagcagctttccataagacacgccctccagtgtgccatgtcggcttaccattgccatggcaacacccaggagttaccacccctttccaaggcaatgacccaatgatgcaaaagttaccactcttttcctagcaacttctgcataaaccaccccttaatctacatataattaagagttggtataaatatgactgcaaaactgtcctgagctgctaatctaagcacactgcctattgggtagccccactctgcaggagcagtaacagagctgtaacggtgccagagctataacactccttcagtaaagctggctcatccttgaattctttcctgggcaaagccaagaaccctcatggcctaagtcccaccttggggcttgcttgtcctgcatcagcaggaatgctacacagagaggccaagaagcatctgataagacaggccttgctgggtttcccctctcagtgtgttagcattccatcagactctttctgtgtaatcatatttctacagagctgttcatacttcactgagcctaagcataaaaatgaaaagttttctgtgtatcttcagatcttcattctgaaggctggaatgtcacataaaaataagatcaaacatatttgttatgcttttctcttgttaatatgcctttgttacagaagtgtcagctatgacccttaagatggaaaagggatcgccccctttccacccctaaaataaggtagcttgttttagcaaataaagatacagcactcctagtgaagtttgaatttcaggcaaataataaacaattttttttttttttttttagtataagtgtgtctcaagtaagacacacttataagtatgataagtccccacttggggacatacttatgttcaaaaattatttgttgtttatctgaaaattcaaagttaactgaatatcctggtgtgtgtggcaggggcagtggaaggctaatgcaggaggagagtgcccagtctctggcctgagaccaccgaccttgtggagtggtcccatcatgtgaaagacaaatgtgacattgcccattcttaaaagctactcgaggtcatcagctgaagaaactgtgagccccttacatctctgactgaaacaacattctttcttcttctttttctttcttttcttttttttggagacagtcttgcgctgttgcctaggctggggtgcagtggtgcaatcgtgactcactgcagccataacctcctgggctcaagtgctactcccgcctcaacctcccaaagtgttgctgttacaggcatgagctctttttgtctctctctttcttcatttttggacagacactggataagtctgtataatataaatagtatcctctaatacagaatatgcagatcccaaggaaaaatcaaacccaacaggatcagaaacaaggagcagcaaagaaatcttttccccatggtcacctgatttcctgtcctttcttgtggcctctggatctagggaccaatgggtcatttcctggctttctcctcttcctaacttctggttctctcagaaatttctcagattccgcagaataaaaactggattgcacaaagtttctacatgcattagataattgcaaactaaatgtaacaatttggtgttaaaccatgttacatgcccacgcataattcaaaaaaagtaggaagaataatttaataaacttaagagtttgaaaccaatataagtaggctcttggcctccgaagaagccagcaaaagtactgtgcttgatagcctttacaaatcaaatgggtcagcaactgagagcatttcaaagccttcgcaaaatagagttgacacatcataatcttttaatggcataaattcccattagcatcaactgctgcatagataatgttcatgatggtgattagaaatgttaatttcttagagcaatcataattttctttaatcttctgtggcagtgtttttttaaactgcaggttatgactcattagtaggttgtgaaatcaatttagtgggatataatcagcatttaaaagaaaagaatagattgaatagaaaatacccaatttcattgcatattgcaattgcatattgtcaatgtaaatattatttcatctacattaatttcaattttccaaatacatatgtgtaactatttggttataatataaaatgtatttcatatggtatgtcatactcaaaaatgttggaaaacaactattctataatgcaatgaataaattctaagactgagctgaaagtgaatcacaacttaaattctcacaaattcatgagagaggaagaaagtattttcagtagaagatattataatggccaatatgtttttatcaataattggatcacttccccatttgctgtgagttttgttcagggttgtaaatgtggtgcttcatttcttatcagtgggaaagggatgcgttttttatctccatacataagtgagggctatggggtcagactgtctctaccatttaatggtcaacttatcttgagcatgttactgaattgctctatgccccaatttccttatttataaaatagagcctgtaaaatctggtaattgaactattgtaaagaataaacaaatgtatacatggaatgcatccaacacagtgtttggcacatagtaagttctcaataaatgtcagttactgacattattactttaaaatatctttatttgagaatggcaaatatagggtaacttgcctcaaatttttatttttgtctctgataaggggagagtggggcctgcagtatgctttgtggttcagttcatgcctggtccctggtcccgtgattcttctgcaaagcctttgtatttcttagttcattgggataaaatgctttagagcagcggttctcaagctggacacatgatatgattcatgggattgcaaaacttctaagtcgcaatcaggattttgaatgaatgtgcatatatacacttggagagtgggtgaagagaactgacaaattagtattgtcagaggggtcacatggtatagtgaagagttagacatacttggacctaaggccaagcttgctaattagcattttaacctttagcgaattacttaacttcctgtagctcaacttactccatctgtaaaatgggaattaaaaatagctcctatatcatttggttgttgaaataaataacgtttacagtatttgtaaagagttgagcatggtagcacatgatgggtcctcaagagaatattaatagtagaagaagagtagatacactggaaaatgaatgaaatagttggtattctgagttttcattttggaatgctgaatctatcactgaatcattgagtagcccacttgtcccttcatttattaaacaaaacttgattgaatgttgccatgtgttaaggattgtgtgaggtgttaagaaggtagtaatgaaccagacacattctctgccctatctagggagatgacaaacaggtagtgaccaaccatgactctacagcaggcaaacaaactatggggctaagagagaatgtaggagacatttctaactcagaaccacattcaacaagtctgtggttttgttttgtcttatagttctagtttgaatttcagcactgaacaggagaaacttccttctgtttaacactgcaaattagtagtgaagtgtaatgtacttagtaaagcacaggaaggattggatttaatccacagaacctaaaggaaactgctcttcatatggctccaaggatgaggacagatagatgaggactttgtagtattgggactagagaataggacaaatacccactttcaaaacaagttacaacgcagagtattaccatttttgccttgacttccaggaagcttaaatttaatgctatattataacaagtacagtaccataatttttttccttctccttcttctcaatggtttttgattttccattttaatatactattgtgtgtgttaaggtatttattattgtgtgtatatatatcacacacacatatactcacacatatgccatatcaaatggtttttgaaagtagatagggtaaaaattactattaaataacctcagataacactgcatcttacatattatgtcagcctttttctttatatacgtttataattcatggacataactaaactgtagtatatttaaatcttataaaattgagtcacactataatatctattctaggagaatttaatagcagtaactgtcttacaggagagacccctatgttatcaataatttattgtgtcatagtatcatttgggattatatctattattaggagacataaggtcactgtattaattcgtttaaattattttcacactctctggacacagactcttttacctttgagtaaagctgtcaggatagccaaatcaatgtcctggtgtccttctgatcccatccgaaataccgtaatctgcaatttgagacaaggtgatcattagcaaagcatttttcccccaagagaaattaaatcaatgagaccacatctgagcagagactatctctatatctacaaagtagattcttaaccacagggtaagcacacataacaagaatccgatgagagagctctgcaatttattaagagggagatgcctcagtagtttccaaacacagaccacttatagttgcactgttttggtcataaccatatacaccccactatggtctaatggtcgtgttcccccaaagtgcatatgttgaaacctactcaccaatgtgatagctttaggaggtgggtctttgggaggtcattaggtgatgattaatagtcattataaaattagtgccattatgaaaggcctctcccttccacctcccaccacgtgaggacacagctagaactgctgtttatgaaccatttgaatctgtgctgccttgattttggacttctcagcctccagaactgtatgaaataaatttctgttgtttgtaagctacccattttatagtattttgttttagcagcctgaatagactaagacagcctgctcccccaataaaaaaataaaactatgattttggggcccttgctatgagtcaggcatagcaatgcatatttaaaaatatgttaccttccattctttctggttttatgtaaatacataaaataaatatatgtattacatgaggaaagatatatatgactatgtaatcaaaacatcactaatgcaaacatttatattagatatagatggagaaattaatacaactaagcaatccagttccataactcctaaattgtacaggacagctggtcacagacccatttaatagagtagaggataacttcaagcagagtaagtgggtaaagtccattacagtgttggtggagtacatctgactttgtatttcaccctagaacaatgagattgtcacagagtccatagatcactgatgtggacagagagtggctgacataatggagtatcattttgtacataaacaacatagttatgtggcctcaggcataactctcaacttctggggcagtgataactaatggcagagaaagagggaaagaaaaatttccaaacaatgcttaacaataatgaagcatttgttttccaagtcagaggaggctatagaaaaaaagccaaaatattgcttgaatatccacatttgagttattatagtactcaactgtttcatgcctcgagcttatctctagaatgggataataatggtgcttatgtatttccaactacataggaagtaaacaatcagatttgctaatctataagtctaggttttatcactatggtagtgagaatagacacacagaaccacagactgttaattagttgccttagaaaacttccagtccaccacctaaagacaaggtagtttgtttaaggtcacacaatgagctagaagaacagctgtgattggaattgaataactctcacctttataacttgggaaaaaataaggagagggaagaataagataatacgaacacttgactcttgtacctgtttacgtcctaaggtcagagactgggatgagggtaaggcagaaattgcaaattgaaatgccttcacagatatttgaactgaaaacaattttttttgagacaaggtctttttctgtcactcaggctggagtacagtggtatgatcatagctcactgcagcctcaatctcctgggttcaaacaatccttccacttcagcctcctgagtagctgagactataggcatgtgccaccatgcccagcttccttccttcctttccttccttttctctctttctctctctctccttttttttttttttttttttttttttttttgtagagatggggtttcattatgttgcccaggctggtcctgaactcctggtcttggcctcccaaagtgctgggattacagatgtgagccaccatgtatggccctgatctaaaaaacttaaaatatgaagagccaaacaaactccatctatctgctgtatttggatcataggttatagttgtgatctctggtaagggccgtcaggtagaggtgtgtcccaattcaattaaattttccagaaatctgcttctgcataactacaggtttggccaagatgccatctggacattatcccaaacagctatttaatgcccccaaagtttccacttggaagttgagagggaactattctatcctctgaactcaggaagggattcctgaattaaggggaaaatttggggtccactggagaaagaaccaggggacagaggtgaaattttggctggccctttaagtcaactctttacgccagggctggctatggtctgaaagatattatcatgtatcatgtacttagctggcagcaagctgaggacactcaggataacatcagagttcattgtttagaattaagaaattaggcatcaaatggaattccttaaccatctgacttgttctgctgatgactaaaattttgcttcataaagatcacatttcagatggaaattcttccgaggcagcaaatagataagattaaatttaccctgaaatacaagattatcaggttttcctagcaacacatttaggtttgaggttgaggaaaggaagatgggtaaatgcagtgtttccatagggtttctgaggaaagggccttggaatattttggtacaacagggcttcacagtttttctggaaaaccgatgtgggggcaatgactgctcacctgttcatgccccatccttgtgctggtttcagaacccaaggacccgggagtgacccagggtgtgggaggaaggatgccttaaaaagaggaaaagggaggaccaaggggaggctggaggctccaaagagaaagttacattataatcttgcctggactaacctgagatattatgtattcatcaccactccatttttattttatttgaaatttgaatgtttaaaaatattaattatatatttttcatatctgcttcagaaaaaaaaagtcaaagaaaaactaaggccttcctttcctatcacccatcaatgttggcagagatggaaaaaacaggtattcttaaatattcttggagggaatgtgaattaaaatagtagttttgggagatggtatgtcgacataaaattccttgattttgatgcattattcttagcaacactgaatcttatttgctaatactttatttaggatttttgcaatgatgtttgtgagtgaggttggtacctgtcaccagtcttatctggtttgggtattagagttacgctaaccttctgagttgggaacgttttccccttcatgttgcagatagtccctataacaaaggaattcacctgcttctggcagagttagcaggatgtttatatgctgtttggtgccggaccatttttatggatagattgctgattatctttataatttcttcaacagttattgatcagttgagattttctgcctctcattgactcaagttcatgtttttctagataatcgagcatttcatcaacattttgctaatattttatttcatcctaaataaaatattagcaaataagacccagtgttgttaagaatatcaaaatcaagaaattttatgtcaacgtatcaaatcccaaaatttcaaattttcacatttattgttatttagttgtacatagaattctcttactgttttaaaatctcttttatatccagaattatatggcaatgttttcattcctctctctgtttcactatatcaaaatcatggtcatttcaaagaatcagtttttcattgtattgatcaatattattattattgttattttctgagacaaggtctcactctgttgcccaggctggagtgcaatggcatgagcatagctcagtataaccttgaactcccaggctcaagtgaccctcccacctcagcctcctgagtacctgggactacagtcatgcaccaccactctctgataaatttttaactttttgtagagatgggggtctcactatgttgcccagagcgatctcaaactcttggacttaagccatcctcacaccttggcctctcaaagtgttgggattacaggcatgagacaccatgcctggcccaatattattacatacagtttaaagtattatcttttatcattatccattcatttcttctacttttgcttccttaggtgttcttttcatagaatcttaagttgacttcctagtcaatttatttttattctttcttgttttctaattaatgcatttaaaattatgtatctcacattttttatatgcactgtcattttcgttcatttttaaatgtaatttatttccttttactaaaaattgtgtttttaatattacagtggatttatatatatcctataaattacctaatcatatacatatatatgtttatatggttaggtatatgtgtatatatatgggtatatatgtgtgtatatacatattaatacatatatacatgtattaatatatgtaatatatacacatgtgtatatatacacacacatatgtaaaaccacacatgtatatacacacatacgtatgtaaaaccacatatatgtacatatacatatatacaaataatgatatatgtgtatatatacatagatatcataatttgttggctgtagaatattttattatatgcatgtaccatgacttatttagccagtcttccgctaatgaacatttggatcaattttcaatcttttgctattacaaacgccattgcagtgaatatctgtatatgcacatgggtgagtatatcagtaaaataaactttgtagatatggaatttcttggcctattagctactctgaggggagttctttaatttattattctgattttactctcagggccctttcctgttccctgcctttattttgatcctgtatggtaactgaaataactgttcatagtgtatacttttctcctagaataatttggaaacccctccctccctccctccctccctccctccctcccgcccttcctggaaactccttcctccctcactccctctctcccttcctgccttccttcctggaaactccttccttctttccttccttccttccttccttccttccttccttccttccttccttccttccttcccttcctccttctctccctccctccctccatctttccctccttttctctctccctccctccctctttcttttcttttctttttctttttttttttcttttttgagacagggtctcactctgtctcccaggctggagtgcatgatcttggctcactgcagcctcaacctcccaaggctcaggtgatccttctgcttcagcctcctgaatagctggggctacaggtgcacaccaccatgcccggctaatttttgtatgttttttagagacagggtttcaccccgggctcaagtgatctgcccgtcttggcctcccaacgtgttgggatcacgggtgtcagccactgcgctggatctgaaacactagtttctatacctcctttaacattccagaaattgctaaaaatttcttgtctcataatgtggtatacttttccctctcccttcatgatgagcacttatagaatctgctgaggagatatacatatttgtgattttgtcttttttgtgttatttgaggatgaggagcaggaagggagataggcatatatgctcattctatcaaatctcaccaatatgaattttaatagaaaaagattttaaattgggtagaagtaaaagttattaacttaatcattttgtaggtgatttagtaaagtctgatatttatttactataaaattggtattttcaacatgcaccctaaaacttttggatgtttgcaactgggtagttgatcttatcaaagcactatggaatacagtgagattcttcttgaaaatcccaaaaaactcaacatcaaaacattttgttaaaaaaacacttttcctccgaattcagtttgatggattatatcttctgctctcttgtggacagattaccttaggctagatggaattttgattctcacgttgaagagaagcaaaatctttcaaactgatatggtccccttttctccatcccaccaacccgcctgccaaccagctttcctgtgtatgtgcttgctcttattttgtgcccccttaaaagtcagaaatctgcacattgcacttgtcactctcaccctcttgcatgtagttgatttgttattgggcatattaattgagtatctcttctgtgccaggcaccgtttaggtgctgggaatggagcagtgaaccacactgacaacaactccctgccttcatagaacctgccttctagaaagggaagacagagcaaaagtaagtaaaacatatgatctgccagacagtgaaaagttctctgccacatgggttcttcctcctatctacttctctttctctgtcctcattgtcagcctttgttcagtctgtggcatctactattacactcctttttttgctagtcttcttgattctggtcctgtccatccctcctttcattctagtctctgtgcagctgttcaggccatcttccatgcctgattatatcactctccatattaggacgtttaaagtggccttcattccctatgacataaagctaaaaattcttagcagggcattcaaagactgctgatgtcacactcccaaaactttaaaaaaattatttttatttcaatagtttttggagtacaggtggcctttggttacatggataagttctatagtggtgatttctgagattttagtgcacctgtcatccgagcagtgtacattgtacccaatattgtacccaaccatcctcccaaccttcccccacaaatccccttagtccattatatcatacttatgcctttgcatcctcatagcttagctcctacttattagtgaaaacataccagacttggttttccatcaatcctttctttggtcttatctcttgctgactgcactcccaccatcacagcatgacccaatcccacgtacctgatgccctagctgggctgagcatcttgctcctctcaggatcctttacgttgtttctagcctatctgcctttttgttcattcagttccttgctgaaatacccttccctctgcttggtgaacaaactagaagactttcagtagacatgtgcatttaagaagctctcttctataatgtaactaggatccaacccttgctttctcttcatgcccctatgattctctaagcttaaggcattccaggatgccacttccaatctctatttgcacacatctctctgcactgaagagcagtttatttgcagtcaggagtcctagtccttgctcagtaagcatttgttgagtagatgaattattaccaagtggttatgtttaggagactggtttgaaagaagcaaacattaaaaaggagtacattcaacacaagaatggtaacatagcaaagtgaatgtggtgtattaagccacagaccaagagtttgtcacaagtgtcaagagccaattttaacacaagagtctactgaacactctattattgttcaggggtcaatcacccagtcaagcattatgggatagaaagtgggctgcctcaggttaggcattatttaaaacatttttggggggtggtaattgcatgggtaaatgtatattttgctattatttaaaactatttaaaagacaactgacttttataacaataataatacattgtagaatttataacatatataagtaaaatatattatagcattagcataaaggcagggaaaggcaatagaagggcacagttttaaggtttttacactatcgatgaatactgaaaagtagactgtgaaaagttagtgttatgctgtaggtcccaaagcaacaactacagtaaccatcactaaattactttaaaaaaaaaacaacaagagagatgaagtgaagtaataataatccaaaagaagacagggaaaaagaagtaacaaagcacagacggaaccaataagagaatgataggctatttttttgagacttgatatgagtgtgacatttttgagccataggcagcaccaatttaccctaaagcatgtttcactaatacatatgaaactttggttctatatagtttaaacttgaagactcaaagcaggaatatattatagaaaaaccaagcagaaacatggaaataattttatgtttgaaaagagtttggttcattttctgggaaaaaaataggcatattcaccacctaaataacaagacatagtatatgtggctgagttagtcacagactttccatttctaaaactcagcaggtcttacagttaaataagataaggatataaaaaatattgggacaatgaaattgactcactttcaaggtatctattaattagcttaatttgtgatttatatgtatgccacggtgagcaatgaatccatgaaaatagagatgaagatgtagtagagcttttgaaaatgaaaataaacatgatattagagtgaaaagcatctataagctgcaaggacagtttggttcaatctatcaaaaaatataaaggaacactctacaatcatttcatgctgtgttagatatgtaagaaatgatatctgagtttgacaaatggtttgtaacatgtctgagaattttagaaatattctcatagctatacgatagataatcaacaaagaaagttcttatcatctaagaatttagaacagtctgcctataatcatgttaacaataggcttgagcacactaaaaatggtacatcttcggctttcataaactaatctctgaaatatttcctattttcctactcagttttttcatagaatctggcaatgtgtttaccaaggatagaagcagggaaacaggaagagaattagactcagtaagcaattcagtcgctacaatgaaataactttttatttatttatttatatttatttatatttatttatttttaaccccacctccagggctagggagaagctaatgcagtgacttttaaaagccgccagcttagcataatgtttcctggatgaatcatcagtatttaaaataatttgaaataatgcagcaattaatagaaaacacaaaaatctatgttcatcaagatacgaaatgatacaagactcttgatagggatccaaacaggattcctgatcagcaacgaaatgcctgtaagcacatattagcttctgttttctctttggcgtaattaaagttgacttggtacagggaagagaacaatgccaacttgatgaatagaatactatgcatctaaaacatattcgtattcgattttcagtctttgagaaaaactgtctttggttgataaaattcttaatgttaacattttgccaaagagactgacttctagaaatgaacatgatgatttatatggaggagggaaggaaattggagaaaattaggaaatgcaaacacacctggaactgagcaaacaaaagatcagtggaaagtgaaatgcaaaatttctactagaaaattaatatcagataagttcaattatttgtcaccaagttccatataaattaaatattgatttttcgtgtaatatttttgaacaagtctcaaagttttaggtcgaagtgggtgacttaaaagtgatgctagggagctagaaattgggtgaaattgatatgattctagtatgtcttataagactttcatgtatgaatttatacattagaaaaaataagcgattatttgactttcaaaaggatattttattttacaatggacttgtcagtttattttaaaggtgcattatgtctaactttagaaaacatagtctgatttaggttactttaagtaggagattgtcttatagattcaagcacactcacagcaccactcaactccatactctcccaagggatcatcgtggatgaacaacttggcaattagtgaagagtgccagagaacgacagaggttttgcttttgactctaatccctcattccttttttcccttattcctcccaccgtcatttaagaaccctggagtttgtttctcctcccaagaaatgcaattcagaggctagaggtctacaggttccaacacagaaaatcatttcttttttcttattataaaagcaatgcatacttatcattaaaaattatagaaagtttagaaaaagatcaatgaaaaataattccccaaacctcaagtcctactcaaagacactactgagactactgaggatattttggtatgcttccttttgcatgtcccagggagagtatacagtcatgggttcttagttcctgtttctggttgggccagtaaagcccccttcctcatccctcttttcctcttatcactagagacagaaactaaaatccatggctttaggctgctaaaagtctaaaacaaaacaaaacagaacaacaaaaacaaaataaggtgggttggacacgcttgcggggctttcttttttcccccctgccataggcagagtttgtggggggaaggggagagcatatttgtgaaatactagtttgtagtctcattttattctccattaacattatcaccaagcacttttctgtattcttgggaattcttcaaaacataatttttaatgtttgcagagtattttgtccaatagatgtgttgtagttcacttaatacccccattgctggacacttacaaagtttctaaatgtttcatataaataatagtgtgatgaacatctttatgtatgagtcctgttctatatttagcatttagttttaaaaataacccctagaagtttggggcttttgtcataaattgcctcgtagctagaaatgagtattttagcaaataaaagcaagttacagtaaaaggaagcttgtgttgtccttgaaccagatttgctgtgatggcactccagtcccattgatgaaagtcctagggagaggtgattgctctaaaatggcactgcaaaacacaggcatgtgcatatgttgagaatgtagcctttatacttcgaggcggaggagccatgcgcagaatcagctcttattcctctctatttgcactactaccaactgccagaatgagtttaagctctcgcttcttggaaaaggggtcctgaaaaaacatattgactttgtcactctctcctattttcactttcctgatttttgctttagcactttgaatgctgcatatggcttatgcagtgcagtgctggcttatattactggaggagcaaatgaaatcattcagtgaacatgaggtttggggttttttaaagcacatatgacatatcacagtgagaaaattttaaaatatgggtcagtcactcaaccaagcctccctggacctatgattgacatatctttcatccttgagagagcagtctttgatcctaaggtgacatgtcaggaggacaggagaaagcagctctgctgattttgtgatgagggcaaaaaatggaaacaagtgaaaattcttcatctagtaattctacaggaaaagttcattgaggttctctagggggttggaactagatgacaacgtgtcgtctactcttccctgctttcaatccttttcctggcaattgatgttacctctttcattgatcataaaactgtgtaatgtacctcactagaggctaatgtgacagatgccacaggtccagcaataatatttccagaagcttctttatatatctcatggccttggctagcagaattcagaatatttgttaccttccatcttgtcagccaaccagatggttgaaaaaattagtagacatccctctgagaaggaacacccagaaccagagacagttcttccaggccaacaccatatggatttcttatggggttgtaaacatttttagcgctttttttttgacattttgtcatattttttcatcattacaagatggaactatattttctgtacttccctttcatgtttgtcaggacatcaaatacttctgcagcctgagcccttttttaagaaactatcaccaggcgagagagtgtcatgaaggtatcataaagtgctatagacagagaagttttcttgcctccctactcaaactagtccagttcccctggtgacaatcttgacacgttccagttggtagaccagatgcccttggtttacctctctggggacctgcccaccaggaggtcataccacttgttactgggccaatcttacccttatctaacttgggtggggcaaccctgaatcagaaccagcgaaagggacctttgagggtacaaaaaatagcagttcggattttctgattactttaggaaaagatacattttacttcttcttcccttcctgcttaactatgaagaacactagagaccaacatcctaatggcagggtgtataagctcgctgaggctgagggatctgccttcttgcccctttggcaccttgcctggtggagcagtgggagagagctgctcaaataacactcactttagagactctgagagactctgccatggaggtcaggggaaatgttttggaagaaaacatccatttcagcctgtgtcactggtcactgcctttagtttcctgggttttttttgtgagactgaccgtatgaggtccttttagtatggcagatgtcctgtgttgaaaggatcttggcctaatcacgtcccttttctaaaccttggttttaccatctgcaaaaaaaataagtttgactagctggtgactggagatcttttaagctctagaagccatagattttctttcctcaggctcagaatggtagaaaatcagcattagggcatctaataggccctgtctcctacttcatacattaattccttaacaacatccataggaagagacgttggttttcatggatggtaccatatgaaaatctttttttttgagacggagtcttgctctttcacccaggctggagcacagtggcgcgatctcggctcactgcaagctccgcctcctgggttcacgccattctcctgcctcagcctcccgagtagctgggactacaggcacccgccaccacgcccggctaattttttgtatttttagtagagatggggtttcaccatgttagcccggatggtctcaatctcctgacctcgtgatccacccgcctcggcctcccaaagtgctgggattacaggcgtaagccaccatgccatttgctgttttagggaatctgttcattagcttagggcaaattaccattttaaaaatgttgttcatatgtttttcggctggaccatggcaccatgatctctattctacaccacaaataccacactgttgatgcttagccagttagactcacccagttcttatgcctacaaagtaagctaagtgtcacgtgacaaccctccccctattcgggaaaacccgttattcctaggctgataatatcccatcaatgcccatgacccagagcaatgctcaagccttttactgcagacactggcactttcttggcctagctcctgggttatcattttccacagctcccatgcccctcacaacaactggatgtattttatactctggctcagagaggacagattgtgtacggagcatggacttttgaatcatacagatgcaaaactgaatcttgccagttagtagcagtataaccttaggccatctactgcacctctctgagctttggggtttcttcctcaaataagtgaaataaggatgactctatctcaggattattgcaaatctttgtgtgggatcatctttttaagtcacacagcacaatttctagtagctagcatgggctcagtaactgctaattccctttccattgctgtccctggcgtgtttcctggtcatgctctctctccctttgtggcagctttgcccagtctgttctctctgctggtctgtcttgtccctgaagctctgtctggctatctgttccttgtgctctgaggcacagttatcttctgcaagcttatcttggtgctaattacgccttgcctgggttagacacctagcctccgtgctgcctctgaactatgtgaatatgcctctatcacagcacaaacgataccaacattggtgacaacattactaatggtcacttattgtgtacttacgacatgctaaacactgggcaagcacttcacaaacatgacttcatccaatcccacaaaaggatactccttagttactgttactcttcccatttctcagctgatgaccttgacgccggagaggttagataccacatggagaaccatgcaggcggaaaggctgagatacactcgagcccagacagcctggcttgaaggcccattctcctactgcttatctgcatcctttaatggcctttgatttcttggagggcaagggaaagaacttgctcaagggcaggtacagctactaagagaccagacagagactcacgtacaagcaaattgactccagacactgcttgcttcaaaactctgctgttacttggacaatcagcttgaagaaggggcaaggatcttcccctccgttctattctatctctacatccccttaacccagtagtatggctggcgcattttgggcacccaatgaatgtttgtggaataattcctccaatctcagtccaagtctagcctgtactttttagatggggaatatatccaatactgaccactcccgattaggttcaggttagtcacggaaggagtattagttgcccaatgtctgggctgtggtgccagtatgtttctgcattatttcccatccggagaccgatcaggtttcctcctaatacacatcctcagtcttaccagtaaaggccaaacaggctcagtgctgtcctgggacactcagatcttaaagagttaggactcactttgcttgtagccttgtaggataatcataggcaaaagagatactatcatttggtcaggaacattcccatgtgctcataagagccaatattaaaataaattcatggcctgagacagggtaaagaaagaaaagtttctgggttgctctgtggatgtgtgcgcaaacccgtgtttgaaggacacgcagggccaatgccaggacattctggagtttgtgcttgacccaagataatcctaaattttgtttaatatatctgaaagcatttgtaaacagatacgagattatattttaacatgatgattattgtcataaacaatgacaaataaagaagaaaatcacaaaggtcatttatcagaaatctaatccccccagacccttctctgcctgtaagtctacctgcctgccaggtgctgggcgctgttcttctctccttgctcctgtgtgtctgtcctcagtcccacgggcagagaaaatcccttgtttatttacacaatgcagggcctggagaagctgcttttttttctgttccttttttcagttttcaatttcaatttgtgctttcctcatggcatttttctagggccactcgagaagaagaagcaaagcagcgtcctttgtcttatgacaagaatggaaatacaaagggaaacaaaaagcagccccagtaggtttaccctgcaaaccagcttgacaaattaaaactaaagctggtgggagaatgcaagtcctcacgtaaaacttcattttctgatctgacaatggaaaaacatgacttttctttttaatggtaaaagggactattagcctaaggccctgtcatattatccccatctacaatgaaccttattttgaaaagtgttctattatttcaagctcagatggaattcaatcaaagaaaaaacatttctgtttatcagctttattatcactttgggttcctaaacccaagtaatctctctctcttccttgagccaatatggacatagaaacgtacatacattctatcactgaatagttgagtttattctcattattattatgcccattgcacaagtcatagttgctaactactccagggtcaaaactctgcataaaaattataggctacgattttcagactattaactttttttttagaatgactgtttaggagtgacagcttttctcccaagaggagtaattctttcctctctgtttctcttaagattgtttttactgttgcatgtcacatgtaaaaaattaagtggacctctctgactacttgtgaggaagtttcaagaagagtaattatcagtataattgtcattatcagtagttaataccactaatggtatatggttctccagcaaattcttttgtctcctcctttacattaaatccacaatttagccacttctcaccattccaggtctgggctactatcccctctcctaggttaccgctatagccccattaagaagtttccttgtggctgggctggctcacatctgtaatcccagcacttcgggaggccgaggagggtagatcacctgaggtcaggagttcgagaccagcctagccaacatggtgaaaccccgactctactaaaaatacaaaaattagccaggtgtggtggcatcagcttgtagtcccagctactcaggaggctggggcaggaggatcacttgaacccgggagacggaggttgcagtgagctgagatcgcatcaccgcactccagcttgggtgacagagcgagactctgtctcaaaaaaaaaaaaaaaagaatttttcttgcttatatccttgccccttcttcaagccgattctccatgtaacagcagagttttggagcaagcagcctctggagtcaatttgcttgtatgtgagtttccgtcctgtctcttactagctgtgtctgcccttgaacaagttctttgccacctctaaacttcaagttccttatctgaaaagtgggagtaattatacttcccattggaattgttttctgttgaaagttaagtgagataatgtacactaagtacttagcatatagccctgagacacgcatgctaacattattattactgaattatacagtaaaagcgggtgagttttaatttgacactaggtctgcagcaagagaaagtataggtgttaaacatagtgatatggtttggatcagtgtccccaccaaaatctcatgttcaattgtaatccccggtgttggaggtgggcctggtgggaggtgattggatcgtgggggcagagttctcatgaatggtttagcaccatccccccttggtactgtatagtgagtgagttctcatgagatcttttgtttaaaagtgtgtggcactgcccgcttctctctcggttctgctccttccatgtaagactccttctcccactttgtcttctgccatgagtaaaagctccctgaggcctccccagaagcagatgctgatatgcttcctgtacagcctgtggaaccatgagccaattaaacctctgttctttataaattacccagtctcaggtatttctttaaagcaatgcaagaacgaactaatacacacagaaaacacacatcctcagcaaaatgatacaatttgttttgtttctttctcacagttaaggccttgttaaatgacaaatagtctatgtaaatccccatgtatattcagcctctatcattagcagcctaaaaactgcttttggggagaaatagagattcaaatatcaccaaaatcaagaagctgtgataaaagtgacaagaaaattttttctaggaaagaatttaagggctaaggagacaaaggtcatttctggctgggatgacacagtaagacgtcatggagaagatgaggatttggcctggactttgtggactatattaatttcaatagcaaagtttggtggtggggaggtgcaggaagaagaaaatggtaagagaaaataagagaaaagtgaacattaaaatcagagtgtgcaaatagtcaatttgctggagggttgggtaaagaaaaggcaacttataaaaaatcaagctagaaagcaagtctgggacaagctacggatgatcttcaatgattcactaaacactaggccttgagccaggcactttatatacattacctggtttaatcctcacaccaatcctgtgaggctcagagattgaagtagttactcaagatcactaagctgataagtgacagaatcaagatttgacctcagatctggagcctctctaggctttcttgctaaagtaaaacactgttagaggtaactaaatcttggagtgaggattggaggtggggcccagcttcagggaagctgcaccaggcttgagatgagataataagggcctggaataggggtggagtgtggttgtgatgcaggggcaaagccgtgtgtgagggacttctaagaagaatcataaggcatgttgacttacaagaataaagggcagggaggcatcaaagatgactccaagttctttggccacagtgctgcgagcatggggctgctcttttttgtttgtttgtttgtttgttttcgtgagacagagtctcgctgtgttgcccaggctggagtgtaatggtgtgatcttggttcactgcagtctccgcctcccgggttcaagcgattctcctgcctcagacacccgagtagcttagactacaggcatgtgccaccatgcccggctaatttttgtatttttagtagagaagggctttcactatgttggccaggctggtcttgaactcctgacttcaggtgatgcacctgccccagcctcccaaagtgcggggattataggcgtgagccaccacatctggccaagggctgctcttaacagaaacaggaaagccaggatgatttgggggaaagtgacaggtttatcaagagcttccatcctttttgactcaaaggttgagtataagcccagggcaggaccctggaagatggtggaggccgggataggggggcgatgaatcagacaaagttctactctgcagtggaatcagaattagagtctctactgcccccctgccctggaaaccttgcttttgttctggttagcaaaaagactgtgctctttgttaaaatgcttttgaacagagctatatcgcagcctggaggagattctaaatagtgagaaaagaaacggatttggcaaaacttataggctgtcaacagctttttagacgataactgccatagaacaatgtgtgtgtataccagatgaaaaaaatagaaactttcatcagattgatctctttggagagtgaaactggagagaagttttatccacatccacttgcctatcatagcaataaggaactatgtagacgtgcacacatgtatgtacatacaatggttttgtgaatcacatgactgggcaatgttaaacgtgctaaatatgctaaacgttgtcccagaaagcaactctggtatgattttactgtagagggcaggttgtccatttccccagcaatgacttttccacaaagaacacttggaaaaatgttcaaatcacatttaccacttcagtcagatgctggcattttttttcacatctccccattataatgattgtagttctagaatgatgcctattttatgtagaaatattgaagaatgaagtgctctataaattttctagtcaagtatgggttatccattaatgccaaataaaaacaagtgaattctcttggatgaaaacgtttctaaaaaggaatagacacatctatcttcctagacaacattaagtaggatgaaaatccattattatcttttgttgtgacttagcgatgttctcattgactgtcagggatgataggctatttgggcctctctcaatggccccggactgctcacagggagagttcacgtgtctgctatttatagttttctgtctcaatggtgtgactaactgtcctcaccactctcactgactgtgcctccctgatttctaattgcattgggcaggagcacccgatcaaaaccaagcacagaagcggtggtttctgtggcatttaatgcctgtgactgtggggaatttagtgattgtctcatatcaatgtcaggcttcaaattagtctttttttcctttaattttcttattttctgattcttgcatatattctggggtagttaagggatctgtattagggaccatttgataaattagggattgccatattcttagcaggaacattttctaattatttttatttgatctctttctgctaatctctactaggaagttaagaattgaacatatctagattcttaaggagaacagttgctaagtgaaataaatataactgcttaaggtaggaatagaagtgagctcttaacagtaatgaaagcaactgcagtgtccaccgctcctctaagcattgtacatgtgtgagtctacatcttcccagtgatgttcagtattatcattcttattccagtagggataacacagatttaaaaaggtagactatctactgaaagtcacatggctagaattcccatgctgtgtagtctgtggcaggcctctccactcatttggattttgtggagggacagaaggggaatgagtgaaagcctcaatgaggtcagaggtagtattccatattaatttcaatggtcactatttttgagcaagtaaagaacctactgagagaacaacaggttgagcagcaacagagcctgtgtggtcatcagagaggcctgctggcccttggggccacattaagcagctgctttgtcactggagccacacttccccttattttgtatagttcattcctctactcaatggacccttgaaagaaaagcccactaccggtgggaagaaaagaaccatgacagtttgtcaacttcctctttgttctctaaagtacagaattcaatctcctcttatttcctggaaaaccatcaatttacaggacagggtaaaaagaatcttagttataaagaaagagccaggcctacactacagacttgaacttgctctctaatcctttggcaagagcacctactgactggtcacattattcaaatgtattttatcactgatcatcatctcttttaaactttgccttttcagtagagaattctctaaatgcccacaagtagaactagcatggaataaagcaagctgttaaagaaagtcgaattccaaaaagttggcttggtaaaatagcatgaaaaggtgtatatttttagctagaaattacaaacctgctgcatttaagtgaggcaacagttgcacaaagtacaacgtaattattttctgtcccgtgcctgtctttgagtctgtcactttgctattcacttatggacatcagtgagagatgtttctttcctttttaacctctcccttgtcagtccattgcaggaaagtactccttagcttgaaagttatgtacaggtagaggcatacaaacattcgagaaacattcaaatgcttagtccctgtctcatacaaaccctgcacttcagctggttatgttttctccttctttatttcttcccgccctttcaaatgtattaacgaagagcctttaaagtgtcaggcattgtgtgaaggcctggggagactgtgtgtgtgtgtgtgtgtgtgtttgtatacactgtgcctgtctttaggatcacttgtgccctttatctcaaattttggatgactgggtagatactgggtagatgaaatttaatcatcccttttttactaaactttaaggacaccatgattttttgtttctacacagtagaaactataggtaggtgaagctcaaagtttataacctcaaaaatttcattattacagcaattttattagctaaaagagcaaatataatttttaggtgatgagtaagatgtacctaatagagacatttttggagccatggttatttcaaataaaaaaataggattttttagtagctaaatttagcagtgaggacaattacaaaattaagtactactcaataggtccctaaaattctgaatgaaaagaaaattcatgggtttataccaggtataatagacaattctaattccttgaaaataaatgaggtttcgtttttattcactctttagaaaagaaaaacctagcttttattaggcagtagggtctgtttgagaaaataccattttagtggctcttcataattatggtgtcagtctaaaaagcagctaatgccacgttctagccaaatatgagaactccatgggcttaaggcttgagacaagtaaggcagtccctaaaataaattgggtaactggaagaagaattctttttcagaaggagaaatatgtgaatggtaagccctataattgctgaggacattaacttatcaattatctcatcatcttttaaaaacatatataattaattttttaaaaaagtagagatggggtgtcactatgttgctcaggttggttttgaactcctgggctcaagcgttctgccctccttggcctcccaaagtgctgggatttcaggtgagagctgccgcgcaggcccatctcctcctctttaaacgaaaggctacccaaagcataactaccatgctgccagggactaacaaggaaaacaacccacagccacaagcatcctggatgctttgaaagaggggcaggcttggggacattttccaagttgcttggtgtttagaacctatccatcaggctagttcagttcctccaaaaattcccagaggtgagaggcagtcaacagctttgctgggcatgacaagtttcatttcaaggagcccagcttgtaatttcaagcagactgctgttgtaggcccaatcaactcagagtttcaattgtttttcaagcattgcttcattgaacacactcagcaatcacagaaccacccgtgtcaacgtggcaaggactgggaaagaactcacaagtcacttaacagaaaagcatattttagcagttttctgaaacaattgtcctaaacatacctttttacagtgactgatcctaactttctgatatggacttggaaaaaagacatttctggaactggcatacaatcagggaggagctggtaatgtacaaatactgccttgtgaaagaatattggatgctcttgttctcactcctactccaaattgttattgggctttacctatggtttctaaaatcatcaggttttaagaagtcattttacatttacattcacacacacttaaacacacatcaaatacatttatcacatatacacattaaacacacacacacacacacacacacacactgatgataaaaatggaatttcccggaataatccccgcttcaaatattctctccagtttttagctcacatccaagaccatctattttaaatttttagcttccaaaatatggtcactgaatcaagatgatccatattatgactctaagactgaaattcagattttgattcaacagatattttcttaacactttcttcagatgtggggatgatatttcaatgcaatatcttatgaaatcagaggatctttattacatggaatatagcatattttgtccttgattttcctcagtaacatataatggacctattgcgatactcttgaatgaaacagacaatgcatagaagcttttagaaaaatggatttctgtaaaaataaaaaataaacatcatatgttgaaacttatgtttcaacatataatatttattatttcttatataacaatataattttattataatatatatttaatataatttaatataaataacaatataaataatataataatgtataacaatataatatatcaggccacttaagtggctcttgccttgagcaagtcatctaacttcttgttttcctttctttttgagacagggtcttgctctgtcatccagggtggagtgcagtggtgcaatcatagctcactgtaaccttgaactcctgggcttaagcgatcctcttgcctcagcctccctagtagctgggaccataggcatgcacctccctgcccgactaattaaaacaaaattatttgtagacatggggtctcactctgtggcccaggctgatcttgaactcctggcctcaagtgatcctccagccttggcctcccacagtgctgggattataggtgtgagccatggtgcctggctgtaacttcttgttttacagatgaaaacactatctccttcataaattgtgagaaaaataaattaatatgcacaaaaacagtttaaaaagaccctggtatatacttggagaaattggactaacttaatagatgggcttaaaaagtaacctggataatgaaagtgttcagtaaatgttgttgctattgttgtcattatttaaagtcccagtttcctcatctgtaactgaaggggtagatttaatcttaatgatctctacagtttctttcctttggtgatgctctgttgcctgtcctttaagtttctatgaagtgaccaatacagaatatgagttggtcaggttaacatttaatataaataaaaatttaccgtgaggtgttaagagctgatagcagaaacaggagcataagagtaactgttttgtcttgttttatgcaaataacttccctgtgtttgcttttttataatgacaaaatgatgaaatggtaataagcaggcaatttccaccaggggcttaaaaacttggcctagttttgaatgttttagggtccagaaggagagaaacctagctcagccttaacaggaagcagaacagcttgtcaatcggttgttttagctccctggagtctcattctgatatggtaattttgtgttataaatctgggagaatgttggacaggctgaggtccagttattccaacaactgctactgtaaatccttcattccctcagtagttgccctcttcctcaaatatctttccatgcagagtaaatgctagttatgggggctataaactgcttaaaattaggctttgggctagagagtgtgtcttctcctgtaaaaacaagcttttccttatattttccagtattttggctccaacaaaatccaagggctatatttcttgctcccaaatgcatagaaaaagtaatttaaaaaatttttaaaaatgtaaatactaatgagaggcaaagcagtcaagaagataccatttctctaggtaccaacagttcaaacaataaaaatatacttatttatcaataatttgatttcaataatattttacaaaatgaaccacttctgatcagatatagatttattggtaatactgcttgcaaaacaattcaaaaggaaaagaaagacaaagtgaaatagagcttgtatgagagagagaatgaaagattatctttggtggttctaattgatttctgacattgtccccaacatagcttttgttgcatgtaaagaatactctgtacagtggcccaaggctacttcaataatagttcactgttttgttagtcaacagctggcttgtatgtgaccttgatgtttgtattatacccaggaaacaggagacttacgatgggactttgaccagggccagcattataaccacattaatggagaatgcaaattcaaattgaggtggggctggcaggagttcatcattgaaaggctgcattcatcacagatgtcaagtacaggctgggtcttcatatttctttttctcatacaatgacttcttctcctgtggctctttcacatggactgtgtattcaggggacaaagcttctgcagtaggctttgagtaaggtcaaactccatggtgcctaagagtctaggacactcactaaaattgcccagtaaaatgtctggacattaaataaattgtattatatgaaattcatgagtgggaagggcaagcactaagggtcatttctgtattatggtatttaacaattgcttccattcaaatgctacaatattatgcagtctgtagtagatgtccatgcacagcattcacattcaactttaatatttaggaaagcttttgttaggcagacgtgggagtggtatgctaatcaatatgaacttttctcaagtgttcttaatagggtaataacactgatgccaggataaccttgaagtttatatttgccgaggtagatatcctgcagaaagaagttttgagaactatagtagaaatggaagaaaaatatattaatagcatagacttgggtatccttataaccagatacgtactcttttctaaaaccatcgctaaaagggcttaggtgctattggtaacttcctcctagtttaaaactcagcctaatgttttcagtggtggggagggatctgactctatgaaataatgaattgttcagccttaaaaatatgtttataaacagcatgaaaaaatgtaaatattttatggctaaatgaaaactttcactgtatagatatatgcaacatgattaccactgtgttcaaaacaacgtaaaataaacctaaaaccttatacacagaaaaaaataccttagaagaaaattcagcaaaagtcattggtgttgtggggctgtggaagatctttttcctctgtttatattttgatagttttaaaattttctataataagcatatttctaattagtatatattactttcacaatagaaaaaataaactggatcaaagctatactcaacttcaagatgactgttcactgagaaatgtgaaattaatatgaaatatgaaagaaaactcttactatgtaaatgaatcacagaatccaagaaagatgtgccggatgggaactagaggtcatctagattgcattctgtctaatcagatcatatgaaggtaagatttctgggctgaagagttaaaagtgtatccttctcacattagaagagagaaatggaaagaatccaagctttttattcaaacaaggctggatttaaattttgatgctgcttcttaactttctgtgtcctttgggcaaattatttaacctctctaagatttagaaaagaaagatggcaatagtgcctacttcttaaaatggtttttagatttaaatgagaatggggaagatagatacgtaggtaggtagatagatgtagatacatacgtacacatattgccgaatacctaatatgcagctttttagcattattattatcaaagcctcttttattcctcagtggccattggctagaaatattttgatatcatttcttttgggtttaaaagagaaggaagataaccactgaaatctctttgtccttttttaaaaaaaagcatggtaagcacatttaacatgagatctaccctttcaacagacttttaactgtgaaatacagtatttttaactacaggacaaatgtgcaatggatctctataacttacttattttgtgtaagttcctgttaactagcaactcaccatttccccctctctgcagcccctggcaaccaccactgtgctgtctgcttctacaggtttgactatttcagattccccagagtcgtgtgtcttccaatactgatagaatagtattgaagaccatggtatatttttttatggacaagagtattgtgatatcatctcttgctgtctattctccttcagcttcttcccttagtttttcttttcctatagcgcagaatctcttctgtgtcctttctccagtctcattttctgttgaatggcctctattcaggatttgtttccgtaacactactgaaaccgtacttctcagggtcatcagtgaactccatcttgctaaatctggtggcaaatttttattccttttagtatgtgatatattagcacaagatggtttccttctcctggaagttcttttttcacttagcttctaggacatcacatctttctggtcttctttccatctcactggctgcttcttttcaggtctcctttgtggggccctccttctctctcccatctataaatgtcacagtgcttgggtttcagctcttgttccttgctccacccacattccctcctcagtaagcgcattatcttccatggtgggaatacagtctatatgctaattggtctcaaattcgtatctcctactccgatttctccctgaagttcaggtcataaatccaaccgcctcctttattactatctggatgtccagtaggcatctaaaaattatcatgtccaaaacaaaactcttgtttccacttcctcaaaaatccaccccttccccatgcttccctggtttattagaaggcaactccattttccccaatcacccttgaaataatccagaactcttctctttacctcatacccatcatctacagcaagtcctgttgcctccaccttcaaacttgatttccagtccaaccacttctcaccatctcttagctcagcccacagcacctacactggactggagtgtaatgcctgcattactttgtagtctcctaaatgatctcctagtttatatatttggcaggtgccagaatgatcctttaaaactctaaattagatcatattattactctgctcaaaaccatctaatggcttctcatcccactcagaataaaacctaaactatttatcatgttctgcttctccagcatcatctcctatcactgccggccttacttgcttttctccaggcacaccagccttcttgctgtgtctcagacacgacaggcatgttcctgcctcagagcctttgcacccactcctccgtctccctggaatattttgccgtcagatctttgcttggcagctggctccctcacttagtactaggttctcatctttaagtatcacatcttcagggagggcttctccaatccccctttttatactctcactcactctgagctaggtgctgttctaggtgttgggggaacagcagtgaatagagagctcctcctctctgaggtttaccccacctcgtcctatcccatcccatctcattgctctgcacctattaagttcttcttttaattttttttctcattgtacatattattgcctggtacctttccatatatttattttcttctttatttacaatctcttctctgttagaatgtaggctgaatgaggacaggtactgttgtatccctagcccctagaatagtgcttggcaggtggcaggcactctataagtgtttctggaatgaatgattgtagaagtagtttgataaatagaagtctattgcaggcaataggcagagacttcatcttgccatatgtgacttagaagggatgtgagtagaatatgaatgaatgtttcaagctgaagcctacttcatggatgtcactagcagttcctgagtacatcctagatgtccattcagtgttctatactttatagctttgaatgatgatttggctttcaaaagatatacatgtccatcttgaatttttcgcagtgagtttcggttgcatatgccccggtttatttgtgtatgatatgtgctgtgcctggcatctgctctgctttctggccctctgtgtgcctgtgcccagaggacatctgagagttagttggcatattataaggtagtatcagaaaacctttgctctgagccctctgactgatcctattggggttgagaaacctatcaagtactgctaagctggcagaatgacaaaatcaactcacacaaggaaataaatcaggcgcggtgggcatggagagccttgaggaccaatggcagaggaagacagagattatggctcatggatggtagatgattgaggactggatagaaactgggttgtccagaaacactatgtcttagccagagctggaacattggcatttgaagctgaagactagtcctggcactttcaagctctatctgtgttaggattggggtcctctcctccagtcacttttctttttgtccataatggaagttgcaagttgacacttataagcccagagttttgagatgctggtgggtgtgttttctgggcagagtacctttcccccagtgctctcagccagtccagaggcatctctctgatgatgcagggttgggtatgatgtgcctacacctgcaatgaggcaccggaaatataggcattaagagaggagatttccatgagagtcatagaaaagaaacttgccattcaaagtggctttttgacttcactgtttccaggaagtgctatctctgacaggaattatttccttgctttctgccagtgatcgtgcatgtttttggcaatgtgaaatgtgggtgcttggaggagaaatgcacaaataaaaggagaggaagggagataaagtaaaggcatcattgttgttcagttcttcagaaagattatccatcctctctaacagtgtctttttttccttagtgtcacagagtgaaaagagcaaaaactttggaattagacacatttgtgcttaaatcctggatatttcagttatggtgttggcttaggcaaaaaatcttaatttctcaaatcttaggttattaatctgtaaaactggataaataatatctatgatatagggttgttttgagtcttaagtgaaataggtgcaaagtacaaagcatagggcccgaaagattcctctataaatagtaactttaaaaaggggagtcaggagagaaaataccgcatcagatatgaacgacctgggcttcacttattaatttattgagcaaattgttaaactgagcatcttctttgaatctagaaacgggtgatatgatgggcaagatagatatgcctccttagaggcaaaaggtgcagacaggtaaaaacacatgcaaatgtaaaaatataagagaagtgctaagcatgataagtgtcactatgaaaggaagagaagaaggaaaggggaaactgctttatatagagtgatcagggaaggcttcctggaggaggtgatgtacaagctgagaaagaagaatatgaaggagccagacatgtgaaggctggagggaagggttccaggtagaagaaaggatgttagcaaatgtttgaggccaaacaaaacttggtgtgtttgaggtactgaataccagagtggctgagatgagagaccagtgccagaacacgagagacacataggatgaaaggactggcagttattcctggggaaagtctctcttgagaacctgtcacaagaacatgccatgttgtaagaaggtttctccctttggttattagtcttcccccaacagtcttggaagtaaaatgaagctattttgttgtaatgcaatagtttgcctatattggaatcattagcattcgatcatatcttagtgttgctctgtgagaggatggtgcattatggtgaattatctgctgttctccacaggagccaaagctgtcttcctgttagctccagagtaaaagtagcctgcagcccacaccctggggtctgatgaaaggactcacactccagtctgcattcctgctgcacctgccagaccctgctgacaaaatttctgtttctccattgaccaaataaaactgcagtgtggccccttggagggttccaggaaaactgaagctccacttctcgttttttaagttagcctgctgccacctggagctgaaagctgtaatccccactcaccctggtggggacctgacctctctcccactggaaccaggttggtgggaagtagcaagagaacttgatttcactcctatttagagagtctatgttctctgcttctggtctcaccttcaaaattagggcagtggtctttgataggatgataacagcaagacaggagaggtaggcatcggccaaaccatgccactgaatgacataacagctgaatgacctctagcaaattatttatcttctccagacacttttttttgtccctaaaaataggaacaacattatctatctcttagtgttgtgggggaagatatgagtacaaaaagcaattggcatgctaggtgttaatttattctttcttccctttttctcttcccttcccttctctggtcagtgagtgcttctccctcttttctgtctcttattattgaatatctcatctttcgtatgtgatgtggtggtgaatcccaggtgggcattctcaccacttgttatatcatggccaagtgcttggagaaagatgtgatcacaatattgaaaattaagtcatttagagtcaatttcacttaattatgctctctctctctgccccaacatccaccaggcctgctctcaatgtgcaatgttgcttcatttggtagtatccttggaaaatgaggggtttcatataaatgagtttttagagctttttcaagaaaaattaagcccatctttttgtggcaaattgtagcaggccttctcttaggcccaaaggcacagtagcaaatacaatgtgtaagtggtaatggtgctgatgcaagaattttcttagatcagaaagtcccacctggggagattttaacatctttcacactcaggccatacctcgggccaattacatcagaatctctaggggtgggatccaggcatcagtattttttaaagcttccaggtgattcgaatgtgcaaccaaagatgcggaaccactgctattcagtttcttaacgctcgaaacctctgaatgtgtctatgtttctatgaattaaaaaagaacactataatcatgtgtttgctgcagggcaacattatggcccacagggatgggggtgaatgaagcctcagtcagaagcagacacatctttatggaaatgaccatgagaggccagctctggcaaggcatgagtattggccaccacagctgatagccatgtgcccataacaaacagtggaattgtgccagttttcaaagggaattcttacaaccattgtggaagacagtgtggtgattcctcaaggatctagaactagaaataccatttgacccagccatcccattactgagtatatacccaaaggattataaatcatgttgctataaagacacatgcacacgtatgtttattgtggcactattcacaatagcaaagacttggaaccaacccaaatgcccatcaatgatagactggattaagaaaatgtggcacatatacaccatggaatactatgcaaccataaaaaaggatgagttcatgtcctttgtagggacatggatgaagctggaaaccgtcattctgagcaaactattgcaaggacaaaaaaccaaatactgcatgttctcactcataggtgggaattgaacaatgagaacacctggacacaggaaggggaacatcacacactggggcctgtcgtggggtgggggggaggagggagggatagcattaggagatatacctaatgtaaatgacgagttaacgggtgcagcacaccaacatggcacatgtatacatatgtaacaaacctgcacattgtgcgcatgtaccctagaacttaaagtataataataatagaaaaaaaaagccagtggaattgggcagtagaataaaggaaacacagaaagtcagatgagaaggtgaaagaagagaaatggtatttaatataaaggagaggttagctggtaaaacatttaaatacccttcaagggagaagatggttaagtaaaacagataaaaagccaaagataaatgataaagtgattgatagtctttaggcagtatacatatatcttccccaattaggataattttctcagatcaaggtttgggtttgatgaaggtaggtaatatattgagagactgatatattgagctctacatcaggccaacgcacttggctgaaaccttgaaatctgatgaatgtattcatttactaagcatcacctctaacaagatgaagcataaatattgatatagaagaaagtgtagatgaatgtattcaaataataggaggtattttatgtcaactgattagcaaggaagagaaagcacaaagtatctggttttcagacacctggcttacaagtaatctatgcatatagatagtttccctagctccttcctgtctattttcttctcaaccctctactaaaatacaacgggtgaaaaatgcaacaaaacttataggtttgaacaaatattgtggaatcagaagtggagaaagggaataagctggaaaatatctgtttattttggagcagtgatttccaaactttagttttgtgtcctttagtcaaattagttttactgggaagggttagagaactaaaataaatttaaaacagaagaagagtggcccagggtcctttatgttcagtctccattattctccttacccttacccacactggagatgctgaaggaagcagagtttgggaatgattggaatatgagttgcatagaaggagattgctaagaagattcggcattttatgtggcattcccaccccttcctaacccctctgacctgtatttccccttgactttgtcatactgccttgacccccaatcagtcattcctttggatcaatatgtgtcctctgctgaaagtacaagcacattatgaggtcaaagagccatcagtcccacatacatgagtgtgaacttaataatgccactagcctccagattcctaggtgagttcgtttgtggtgaggaaatggagctgcaggacgtgggagacgggtaatgctggggaaggatgatggggaagtcctgttagtgtgtctctagggattttgggggtaccctgggagcaatgctgcagaagagggaacaggttctgaaaagaaacattgcctattattttttattttctggaatcaatcctgtcccgaggaagggggtggcaatctctttcttcttcctaccacatttcttggtttcttgttcccagtgtctttatagcaaatgagacttttgcttaattatttacattgcttgatgagaaaattgattccggtttgtaaatagatccctggatcacagcccatttataagctgatgacttcctaaaatgcacaattgactgttttgtgtggaagagattacctctaaaaaaactgttaatgagaaatgtgtacgtttgaacacttaaaacatgcttaaagaacattaaatatttatccaaatgtggcacctctgaggactatgaggagtttatggcttctgtgattttaacttagttgctaccacggagaggaccccagagcagtggttcttaactcttgagagttattgataccttggggaatctgaggactgtattcatcttcctatgatatgcaagcacactccaaatcttgcatgcattttcagaggtttcacagaactccctaaagacttttgagttttcagggtctttgagctaagaattgttactcaattgactggaggagtaacactggcctgtgtatatgagaaaaatccctatttgggaataggttgtcacttaggataagagagtctatccctatcctatagggtctactgtatttaacaactgaaaaaggagtcaagggcttgtatatctcccaaacaaatacattggggagtctgtgttctgccccttatacctgggaaattcaccaagaatctatagtgctataaagattgaagatgggacatccctacaatattctttcctaatggaggatttaggaaagacttatttattctcattcattcttactacatctattgaacaccaattttgtggaaagtcactgtgctaggtgtagtaaggggacacaaaaatgtataaggcctgctctttttttaagttgcatgccattttgtagcagacataaactttgtatcctaatagtatagggctcaggagagcatgctctgaaacttactgtccctttcagctgtgttccttggggatgttactgtgccttggtttcctcatctgtaaaatgcagataatagcaggatgaccatataatttataatttaagtcaggatacctttgtaagtggagggctgctattaatagttacgctgggccacaagcacaaactgggctatctcaggaaaatgaggaccatgatcactctagtgtggaaagattatcctagggattgaagaaggcaatgcataggacattatcacatcatgtctgtggctgggcaaatgttatctgctgtgattggtgttatgggtacctaaaagaaaaagtgatatttgaatttataggggagacggatgattatttcttaagaccaacatttattatatactctttatgggctattggctcaaaccagtgaaagaaaacaataaaattagaactccttctgcaaaacagtcctttcatgggcatgataagtatctccactagctgcaacatgtttctattctggtcctgctttcctgtgcattacagtcccatccctttacctgtctatcaaaagttttcttcagttcctcatagtgatctttgattcaatatatatctgactgaaacaaatggtggataggaggcaggacaaacttgcagctcctgtcagacagatagagaagtgtgtggagactcacactgtgagcttttgctccaagaactaccacaaaaacacatcaggaaagctgacagcatccacagaccctttgaaggaagcagattgctgctgcaggcccatagagacagctgaaaaactcgaagacaaagggcataatctcttgggaactctatgggcctgcccaccacctgatcttacctatactaccgcagctgatgctctcttgaaagcaccacctcctggctggaggccaaccaacacaaaactagcacaataaacaaaactacagccaaggaccctcacagagtttacttcactccgttgccaccccacctggagcaggtgctggtatccatgaccaagagatctgaagacggtttacatcacaggactctgtgcaaacactccccagtacctgaagccccatagctctgctgggcggctagatccagaagagaaataacaatgactgcagttaagttctctggaagcccctttcctagaggaagggagagaatactatatcacgggagcacgctgcgggacaaaagaatctgaacagcagcccttgagccccagatcttccctctgcaatagtctacccaaatgagaaggaacaagaaaaacaattgtggtaatatgacaaaacaaaacaagttcattaacacccccaaaagatcagcaatggatccaaaccgagaagaaatctgaattgccagaaagagaattcaaaaatgtcaattattatgctaatcaggtagtcaccagagaaaggtaaagtccaactcaaagaaatttgaaaaatgatataagatgtgaagggaaaactcttcagtgaaatagatagcataaataaaaaacaaaagcaacttctggaaaggaaggacacacttagagaaatgcaaaatgcactggaaagtctcagcaacagaatcaaacaagtagaagaaagaacttcagagctcaaagacaggctatcgaattaccttagtccattcaaagacaaagaggaaagaatttttaaaaaatgaacaaagcctccaagaagtttgggattatgttaaatgacgaaacctaagaataattggcgttcctgaggaaaacgagaaatctgaaagtttggaaatcacattggaggaaataattgaggaaaacatctccagctttgctagagatctagacatccaaatataagaagttcaaagaacacatgaaaaattaatcacaagaagatcatcacctaggcacatcgtcatcaggttatctaaagtcaagatgcaggaaataatcttatgagctgtgaggcaaaagcatcaggtaacctataaaggaaaacctatcagattaacagcagatctctcagcagaaatcctgcaagctagaagaaattggggccctatatctagcctccttaaataaaataattatcagctaagaattttgcatctagcgaaactaagattcataaatgaaggaaagatacagtcttttccagacaaacaaatgctgagagaactcaccactaccaagccagcactgcaagaacagctaaaaggagctctaaatcttgaaacaaattctggaaaatacaccaaaagagaactcctttaaagcataaatctcaaaggacctataaaacaaaaacacactgaaaacaacaagaacaacaataacaacaacaaggtattcaggcaacaaacagcatgatgaatataatagtacctcacatctcaatactaatgttgaatgtaaatggtctaaatgctccaattaaaagacacagaatggataagaattcaccaaccaagtatttgttatcttcaagagactcacctaacacataaggactcacataaacttaaggtaaaggagtggaaaaaaatattccatgcaaatggacaccaaaagcgacaaggaatagctattcttatatcagacaaaacaaactttaaagcaacagcagttaaaaaattcaaagagggacattaaataacagtaatgaaagcaactgcagtgtccaccgctcctctaagcattgtacatgtgtgagtctacatcttcccagtgatgttcagtattatcattcttattccagtagggataacacagatttaaaaaggtagactatctactgaaagtcacatggctagaattcccatgctgtgtagtctgtggcaggcctctccactcatttggattttgtggagggacagaaggggaatgagtgaaagcctcaatgaggtcagaggtagtattccatattaatttcaatggtcactatttttgagcaagtaaagaacctactgagagaacaacaggttgagcagcaacagagcctgtgtggtcatcagagaggcctgctggcccttggggccacattaagcagctgctttgtcactggagccacacttccccttattttgtatagttcattcctctactcaatggacccttgaaagaaaagcccactaccggtgggaagaaaagaaccatgacagtttgtcaacttcctctttgttctctaaagtacagaattcaatctcctcttatttcctggaaaaccatcaatttacaggacagggtaaaaagaatcttagttataaagaaagagccaggcctacactacagacttgaacttgctctctaatcctttggcaagagcacctactgactggtcacattattcaaatgtattttatcactgatcatcatctcttttaaactttgccttttcagtagagaattctctaaatgcccacaagtagaactagcatggaataaagcaagctgttaaagaaagtcgaattccaaaaagttggcttggtaaaatagcatgaaaaggtgtatatttttagctagaaattacaaacctgctgcatttaagtgaggcaacagttgcacaaagtacaacgtaattattttctgtcccgtgcctgtctttgagtctgtcactttgctattcacttatggacatcagtgagagatgtttctttcctttttaacctctcccttgtcagtccattgcaggaaagtactccttagcttgaaagttatgtacaggtagaggcatacaaacattcgagaaacattcaaatgcttagtccctgtctcatacaaaccctgcacttcagctggttatgttttctccttctttatttcttcccgccctttcaaatgtattaacgaagagcctttaaagtgtcaggcattgtgtgaaggcctggggagactgtgtgtgtgtgtgtgtgtgtgtttgtatacactgtgcctgtctttaggatcacttgtgccctttatctcaaattttggatgactgggtagatactgggtagatgaaatttaatcatcccttttttactaaactttaaggacaccatgattttttgtttctacacagtagaaactataggtaggtgaagctcaaagtttataacctcaaaaatttcattattacagcaattttattagctaaaagagcaaatataatttttaggtgatgagtaagatgtacctaatagagacatttttggagccatggttatttcaaataaaaaaataggattttttagtagctaaatttagcagtgaggacaattacaaaattaagtactactcaataggtccctaaaattctgaatgaaaagaaaattcatgggtttataccaggtataatagacaattctaattccttgaaaataaatgaggtttcgtttttattcactctttagaaaagaaaaacctagcttttattaggcagtagggtctgtttgagaaaataccattttagtggctcttcataattatggtgtcagtctaaaaagcagctaatgccacgttctagccaaatatgagaactccatgggcttaaggcttgagacaagtaaggcagtccctaaaataaattgggtaactggaagaagaattctttttcagaaggagaaatatgtgaatggtaagccctataattgctgaggacattaacttatcaattatctcatcatcttttaaaaacatatataattaattttttaaaaaagtagagatggggtgtcactatgttgctcaggttggttttgaactcctgggctcaagcgttctgccctccttggcctcccaaagtgctgggatttcaggtgagagctgccgcgcaggcccatctcctcctctttaaacgaaaggctacccaaagcataactaccatgctgccagggactaacaaggaaaacaacccacagccacaagcatcctggatgctttgaaagaggggcaggcttggggacattttccaagttgcttggtgtttagaacctatccatcaggctagttcagttcctccaaaaattcccagaggtgagaggcagtcaacagctttgctgggcatgacaagtttcatttcaaggagcccagcttgtaatttcaagcagactgctgttgtaggcccaatcaactcagagtttcaattgtttttcaagcattgcttcattgaacacactcagcaatcacagaaccacccgtgtcaacgtggcaaggactgggaaagaactcacaagtcacttaacagaaaagcatattttagcagttttctgaaacaattgtcctaaacatacctttttacagtgactgatcctaactttctgatatggacttggaaaaaagacatttctggaactggcatacaatcagggaggagctggtaatgtacaaatactgccttgtgaaagaatattggatgctcttgttctcactcctactccaaattgttattgggctttacctatggtttctaaaatcatcaggttttaagaagtcattttacatttacattcacacacacttaaacacacatcaaatacatttatcacatatacacattaaacacacacacacacacacacacacacactgatgataaaaatggaatttcccggaataatccccgcttcaaatattctctccagtttttagctcacatccaagaccatctattttaaatttttagcttccaaaatatggtcactgaatcaagatgatccatattatgactctaagactgaaattcagattttgattcaacagatattttcttaacactttcttcagatgtggggatgatatttcaatgcaatatcttatgaaatcagaggatctttattacatggaatatagcatattttgtccttgattttcctcagtaacatataatggacctattgcgatactcttgaatgaaacagacaatgcatagaagcttttagaaaaatggatttctgtaaaaataaaaaataaacatcatatgttgaaacttatgtttcaacatataatatttattatttcttatataacaatataattttattataatatatatttaatataatttaatataaataacaatataaataatataataatgtataacaatataatatatcaggccacttaagtggctcttgccttgagcaagtcatctaacttcttgttttcctttctttttgagacagggtcttgctctgtcatccagggtggagtgcagtggtgcaatcatagctcactgtaaccttgaactcctgggcttaagcgatcctcttgcctcagcctccctagtagctgggaccataggcatgcacctccctgcccgactaattaaaacaaaattatttgtagacatggggtctcactctgtggcccaggctgatcttgaactcctggcctcaagtgatcctccagccttggcctcccacagtgctgggattataggtgtgagccatggtgcctggctgtaacttcttgttttacagatgaaaacactatctccttcataaattgtgagaaaaataaattaatatgcacaaaaacagtttaaaaagaccctggtatatacttggagaaattggactaacttaatagatgggcttaaaaagtaacctggataatgaaagtgttcagtaaatgttgttgctattgttgtcattatttaaagtcccagtttcctcatctgtaactgaaggggtagatttaatcttaatgatctctacagtttctttcctttggtgatgctctgttgcctgtcctttaagtttctatgaagtgaccaatacagaatatgagttggtcaggttaacatttaatataaataaaaatttaccgtgaggtgttaagagctgatagcagaaacaggagcataagagtaactgttttgtcttgttttatgcaaataacttccctgtgtttgcttttttataatgacaaaatgatgaaatggtaataagcaggcaatttccaccaggggcttaaaaacttggcctagttttgaatgttttagggtccagaaggagagaaacctagctcagccttaacaggaagcagaacagcttgtcaatcggttgttttagctccctggagtctcattctgatatggtaattttgtgttataaatctgggagaatgttggacaggctgaggtccagttattccaacaactgctactgtaaatccttcattccctcagtagttgccctcttcctcaaatatctttccatgcagagtaaatgctagttatgggggctataaactgcttaaaattaggctttgggctagagagtgtgtcttctcctgtaaaaacaagcttttccttatattttccagtattttggctccaacaaaatccaagggctatatttcttgctcccaaatgcatagaaaaagtaatttaaaaaatttttaaaaatgtaaatactaatgagaggcaaagcagtcaagaagataccatttctctaggtaccaacagttcaaacaataaaaatatacttatttatcaataatttgatttcaataatattttacaaaatgaaccacttctgatcagatatagatttattggtaatactgcttgcaaaacaattcaaaaggaaaagaaagacaaagtgaaatagagcttgtatgagagagagaatgaaagattatctttggtggttctaattgatttctgacattgtccccaacatagcttttgttgcatgtaaagaatactctgtacagtggcccaaggctacttcaataatagttcactgttttgttagtcaacagctggcttgtatgtgaccttgatgtttgtattatacccaggaaacaggagacttacgatgggactttgaccagggccagcattataaccacattaatggagaatgcaaattcaaattgaggtggggctggcaggagttcatcattgaaaggctgcattcatcacagatgtcaagtacaggctgggtcttcatatttctttttctcatacaatgacttcttctcctgtggctctttcacatggactgtgtattcaggggacaaagcttctgcagtaggctttgagtaaggtcaaactccatggtgcctaagagtctaggacactcactaaaattgcccagtaaaatgtctggacattaaataaattgtattatatgaaattcatgagtgggaagggcaagcactaagggtcatttctgtattatggtatttaacaattgcttccattcaaatgctacaatattatgcagtctgtagtagatgtccatgcacagcattcacattcaactttaatatttaggaaagcttttgttaggcagacgtgggagtggtatgctaatcaatatgaacttttctcaagtgttcttaatagggtaataacactgatgccaggataaccttgaagtttatatttgccgaggtagatatcctgcagaaagaagttttgagaactatagtagaaatggaagaaaaatatattaatagcatagacttgggtatccttataaccagatacgtactcttttctaaaaccatcgctaaaagggcttaggtgctattggtaacttcctcctagtttaaaactcagcctaatgttttcagtggtggggagggatctgactctatgaaataatgaattgttcagccttaaaaatatgtttataaacagcatgaaaaaatgtaaatattttatggctaaatgaaaactttcactgtatagatatatgcaacatgattaccactgtgttcaaaacaacgtaaaataaacctaaaaccttatacacagaaaaaaataccttagaagaaaattcagcaaaagtcattggtgttgtggggctgtggaagatctttttcctctgtttatattttgatagttttaaaattttctataataagcatatttctaattagtatatattactttcacaatagaaaaaataaactggatcaaagctatactcaacttcaagatgactgttcactgagaaatgtgaaattaatatgaaatatgaaagaaaactcttactatgtaaatgaatcacagaatccaagaaagatgtgccggatgggaactagaggtcatctagattgcattctgtctaatcagatcatatgaaggtaagatttctgggctgaagagttaaaagtgtatccttctcacattagaagagagaaatggaaagaatccaagctttttattcaaacaaggctggatttaaattttgatgctgcttcttaactttctgtgtcctttgggcaaattatttaacctctctaagatttagaaaagaaagatggcaatagtgcctacttcttaaaatggtttttagatttaaatgagaatggggaagatagatacgtaggtaggtagatagatgtagatacatacgtacacatattgccgaatacctaatatgcagctttttagcattattattatcaaagcctcttttattcctcagtggccattggctagaaatattttgatatcatttcttttgggtttaaaagagaaggaagataaccactgaaatctctttgtccttttttaaaaaaaagcatggtaagcacatttaacatgagatctaccctttcaacagacttttaactgtgaaatacagtatttttaactacaggacaaatgtgcaatggatctctataacttacttattttgtgtaagttcctgttaactagcaactcaccatttccccctctctgcagcccctggcaaccaccactgtgctgtctgcttctacaggtttgactatttcagattccccagagtcgtgtgtcttccaatactgatagaatagtattgaagaccatggtatatttttttatggacaagagtattgtgatatcatctcttgctgtctattctccttcagcttcttcccttagtttttcttttcctatagcgcagaatctcttctgtgtcctttctccagtctcattttctgttgaatggcctctattcaggatttgtttccgtaacactactgaaaccgtacttctcagggtcatcagtgaactccatcttgctaaatctggtggcaaatttttattccttttagtatgtgatatattagcacaagatggtttccttctcctggaagttcttttttcacttagcttctaggacatcacatctttctggtcttctttccatctcactggctgcttcttttcaggtctcctttgtggggccctccttctctctcccatctataaatgtcacagtgcttgggtttcagctcttgttccttgctccacccacattccctcctcagtaagcgcattatcttccatggtgggaatacagtctatatgctaattggtctcaaattcgtatctcctactccgatttctccctgaagttcaggtcataaatccaaccgcctcctttattactatctggatgtccagtaggcatctaaaaattatcatgtccaaaacaaaactcttgtttccacttcctcaaaaatccaccccttccccatgcttccctggtttattagaaggcaactccattttccccaatcacccttgaaataatccagaactcttctctttacctcatacccatcatctacagcaagtcctgttgcctccaccttcaaacttgatttccagtccaaccacttctcaccatctcttagctcagcccacagcacctacactggactggagtgtaatgcctgcattactttgtagtctcctaaatgatctcctagtttatatatttggcaggtgccagaatgatcctttaaaactctaaattagatcatattattactctgctcaaaaccatctaatggcttctcatcccactcagaataaaacctaaactatttatcatgttctgcttctccagcatcatctcctatcactgccggccttacttgcttttctccaggcacaccagccttcttgctgtgtctcagacacgacaggcatgttcctgcctcagagcctttgcacccactcctccgtctccctggaatattttgccgtcagatctttgcttggcagctggctccctcacttagtactaggttctcatctttaagtatcacatcttcagggagggcttctccaatccccctttttatactctcactcactctgagctaggtgctgttctaggtgttgggggaacagcagtgaatagagagctcctcctctctgaggtttaccccacctcgtcctatcccatcccatctcattgctctgcacctattaagttcttcttttaattttttttctcattgtacatattattgcctggtacctttccatatatttattttcttctttatttacaatctcttctctgttagaatgtaggctgaatgaggacaggtactgttgtatccctagcccctagaatagtgcttggcaggtggcaggcactctataagtgtttctggaatgaatgattgtagaagtagtttgataaatagaagtctattgcaggcaataggcagagacttcatcttgccatatgtgacttagaagggatgtgagtagaatatgaatgaatgtttcaagctgaagcctacttcatggatgtcactagcagttcctgagtacatcctagatgtccattcagtgttctatactttatagctttgaatgatgatttggctttcaaaagatatacatgtccatcttgaatttttcgcagtgagtttcggttgcatatgccccggtttatttgtgtatgatatgtgctgtgcctggcatctgctctgctttctggccctctgtgtgcctgtgcccagaggacatctgagagttagttggcatattataaggtagtatcagaaaacctttgctctgagccctctgactgatcctattggggttgagaaacctatcaagtactgctaagctggcagaatgacaaaatcaactcacacaaggaaataaatcaggcgcggtgggcatggagagccttgaggaccaatggcagaggaagacagagattatggctcatggatggtagatgattgaggactggatagaaactgggttgtccagaaacactatgtcttagccagagctggaacattggcatttgaagctgaagactagtcctggcactttcaagctctatctgtgttaggattggggtcctctcctccagtcacttttctttttgtccataatggaagttgcaagttgacacttataagcccagagttttgagatgctggtgggtgtgttttctgggcagagtacctttcccccagtgctctcagccagtccagaggcatctctctgatgatgcagggttgggtatgatgtgcctacacctgcaatgaggcaccggaaatataggcattaagagaggagatttccatgagagtcatagaaaagaaacttgccattcaaagtggctttttgacttcactgtttccaggaagtgctatctctgacaggaattatttccttgctttctgccagtgatcgtgcatgtttttggcaatgtgaaatgtgggtgcttggaggagaaatgcacaaataaaaggagaggaagggagataaagtaaaggcatcattgttgttcagttcttcagaaagattatccatcctctctaacagtgtctttttttccttagtgtcacagagtgaaaagagcaaaaactttggaattagacacatttgtgcttaaatcctggatatttcagttatggtgttggcttaggcaaaaaatcttaatttctcaaatcttaggttattaatctgtaaaactggataaataatatctatgatatagggttgttttgagtcttaagtgaaataggtgcaaagtacaaagcatagggcccgaaagattcctctataaatagtaactttaaaaaggggagtcaggagagaaaataccgcatcagatatgaacgacctgggcttcacttattaatttattgagcaaattgttaaactgagcatcttctttgaatctagaaacgggtgatatgatgggcaagatagatatgcctccttagaggcaaaaggtgcagacaggtaaaaacacatgcaaatgtaaaaatataagagaagtgctaagcatgataagtgtcactatgaaaggaagagaagaaggaaaggggaaactgctttatatagagtgatcagggaaggcttcctggaggaggtgatgtacaagctgagaaagaagaatatgaaggagccagacatgtgaaggctggagggaagggttccaggtagaagaaaggatgttagcaaatgtttgaggccaaacaaaacttggtgtgtttgaggtactgaataccagagtggctgagatgagagaccagtgccagaacacgagagacacataggatgaaaggactggcagttattcctggggaaagtctctcttgagaacctgtcacaagaacatgccatgttgtaagaaggtttctccctttggttattagtcttcccccaacagtcttggaagtaaaatgaagctattttgttgtaatgcaatagtttgcctatattggaatcattagcattcgatcatatcttagtgttgctctgtgagaggatggtgcattatggtgaattatctgctgttctccacaggagccaaagctgtcttcctgttagctccagagtaaaagtagcctgcagcccacaccctggggtctgatgaaaggactcacactccagtctgcattcctgctgcacctgccagaccctgctgacaaaatttctgtttctccattgaccaaataaaactgcagtgtggccccttggagggttccaggaaaactgaagctccacttctcgttttttaagttagcctgctgccacctggagctgaaagctgtaatccccactcaccctggtggggacctgacctctctcccactggaaccaggttggtgggaagtagcaagagaacttgatttcactcctatttagagagtctatgttctctgcttctggtctcaccttcaaaattagggcagtggtctttgataggatgataacagcaagacaggagaggtaggcatcggccaaaccatgccactgaatgacataacagctgaatgacctctagcaaattatttatcttctccagacacttttttttgtccctaaaaataggaacaacattatctatctcttagtgttgtgggggaagatatgagtacaaaaagcaattggcatgctaggtgttaatttattctttcttccctttttctcttcccttcccttctctggtcagtgagtgcttctccctcttttctgtctcttattattgaatatctcatctttcgtatgtgatgtggtggtgaatcccaggtgggcattctcaccacttgttatatcatggccaagtgcttggagaaagatgtgatcacaatattgaaaattaagtcatttagagtcaatttcacttaattatgctctctctctctgccccaacatccaccaggcctgctctcaatgtgcaatgttgcttcatttggtagtatccttggaaaatgaggggtttcatataaatgagtttttagagctttttcaagaaaaattaagcccatctttttgtggcaaattgtagcaggccttctcttaggcccaaaggcacagtagcaaatacaatgtgtaagtggtaatggtgctgatgcaagaattttcttagatcagaaagtcccacctggggagattttaacatctttcacactcaggccatacctcgggccaattacatcagaatctctaggggtgggatccaggcatcagtattttttaaagcttccaggtgattcgaatgtgcaaccaaagatgcggaaccactgctattcagtttcttaacgctcgaaacctctgaatgtgtctatgtttctatgaattaaaaaagaacactataatcatgtgtttgctgcagggcaacattatggcccacagggatgggggtgaatgaagcctcagtcagaagcagacacatctttatggaaatgaccatgagaggccagctctggcaaggcatgagtattggccaccacagctgatagccatgtgcccataacaaacagtggaattgtgccagttttcaaagggaattcttacaaccattgtggaagacagtgtggtgattcctcaaggatctagaactagaaataccatttgacccagccatcccattactgagtatatacccaaaggattataaatcatgttgctataaagacacatgcacacgtatgtttattgtggcactattcacaatagcaaagacttggaaccaacccaaatgcccatcaatgatagactggattaagaaaatgtggcacatatacaccatggaatactatgcaaccataaaaaaggatgagttcatgtcctttgtagggacatggatgaagctggaaaccgtcattctgagcaaactattgcaaggacaaaaaaccaaatactgcatgttctcactcataggtgggaattgaacaatgagaacacctggacacaggaaggggaacatcacacactggggcctgtcgtggggtgggggggaggagggagggatagcattaggagatatacctaatgtaaatgacgagttaacgggtgcagcacaccaacatggcacatgtatacatatgtaacaaacctgcacattgtgcgcatgtaccctagaacttaaagtataataataatagaaaaaaaaagccagtggaattgggcagtagaataaaggaaacacagaaagtcagatgagaaggtgaaagaagagaaatggtatttaatataaaggagaggttagctggtaaaacatttaaatacccttcaagggagaagatggttaagtaaaacagataaaaagccaaagataaatgataaagtgattgatagtctttaggcagtatacatatatcttccccaattaggataattttctcagatcaaggtttgggtttgatgaaggtaggtaatatattgagagactgatatattgagctctacatcaggccaacgcacttggctgaaaccttgaaatctgatgaatgtattcatttactaagcatcacctctaacaagatgaagcataaatattgatatagaagaaagtgtagatgaatgtattcaaataataggaggtattttatgtcaactgattagcaaggaagagaaagcacaaagtatctggttttcagacacctggcttacaagtaatctatgcatatagatagtttccctagctccttcctgtctattttcttctcaaccctctactaaaatacaacgggtgaaaaatgcaacaaaacttataggtttgaacaaatattgtggaatcagaagtggagaaagggaataagctggaaaatatctgtttattttggagcagtgatttccaaactttagttttgtgtcctttagtcaaattagttttactgggaagggttagagaactaaaataaatttaaaacagaagaagagtggcccagggtcctttatgttcagtctccattattctccttacccttacccacactggagatgctgaaggaagcagagtttgggaatgattggaatatgagttgcatagaaggagattgctaagaagattcggcattttatgtggcattcccaccccttcctaacccctctgacctgtatttccccttgactttgtcatactgccttgacccccaatcagtcattcctttggatcaatatgtgtcctctgctgaaagtacaagcacattatgaggtcaaagagccatcagtcccacatacatgagtgtgaacttaataatgccactagcctccagattcctaggtgagttcgtttgtggtgaggaaatggagctgcaggacgtgggagacgggtaatgctggggaaggatgatggggaagtcctgttagtgtgtctctagggattttgggggtaccctgggagcaatgctgcagaagagggaacaggttctgaaaagaaacattgcctattattttttattttctggaatcaatcctgtcccgaggaagggggtggcaatctctttcttcttcctaccacatttcttggtttcttgttcccagtgtctttatagcaaatgagacttttgcttaattatttacattgcttgatgagaaaattgattccggtttgtaaatagatccctggatcacagcccatttataagctgatgacttcctaaaatgcacaattgactgttttgtgtggaagagattacctctaaaaaaactgttaatgagaaatgtgtacgtttgaacacttaaaacatgcttaaagaacattaaatatttatccaaatgtggcacctctgaggactatgaggagtttatggcttctgtgattttaacttagttgctaccacggagaggaccccagagcagtggttcttaactcttgagagttattgataccttggggaatctgaggactgtattcatcttcctatgatatgcaagcacactccaaatcttgcatgcattttcagaggtttcacagaactccctaaagacttttgagttttcagggtctttgagctaagaattgttactcaattgactggaggagtaacactggcctgtgtatatgagaaaaatccctatttgggaataggttgtcacttaggataagagagtctatccctatcctatagggtctactgtatttaacaactgaaaaaggagtcaagggcttgtatatctcccaaacaaatacattggggagtctgtgttctgccccttatacctgggaaattcaccaagaatctatagtgctataaagattgaagatgggacatccctacaatattctttcctaatggaggatttaggaaagacttatttattctcattcattcttactacatctattgaacaccaattttgtggaaagtcactgtgctaggtgtagtaaggggacacaaaaatgtataaggcctgctctttttttaagttgcatgccattttgtagcagacataaactttgtatcctaatagtatagggctcaggagagcatgctctgaaacttactgtccctttcagctgtgttccttggggatgttactgtgccttggtttcctcatctgtaaaatgcagataatagcaggatgaccatataatttataatttaagtcaggatacctttgtaagtggagggctgctattaatagttacgctgggccacaagcacaaactgggctatctcaggaaaatgaggaccatgatcactctagtgtggaaagattatcctagggattgaagaaggcaatgcataggacattatcacatcatgtctgtggctgggcaaatgttatctgctgtgattggtgttatgggtacctaaaagaaaaagtgatatttgaatttataggggagacggatgattatttcttaagaccaacatttattatatactctttatgggctattggctcaaaccagtgaaagaaaacaataaaattagaactccttctgcaaaacagtcctttcatgggcatgataagtatctccactagctgcaacatgtttctattctggtcctgctttcctgtgcattacagtcccatccctttacctgtctatcaaaagttttcttcagttcctcatagtgatctttgattcaatatatatctgactgaaacaaatggtggataggaggcaggacaaacttgcagctcctgtcagacagatagagaagtgtgtggagactcacactgtgagcttttgctccaagaactaccacaaaaacacatcaggaaagctgacagcatccacagaccctttgaaggaagcagattgctgctgcaggcccatagagacagctgaaaaactcgaagacaaagggcataatctcttgggaactctatgggcctgcccaccacctgatcttacctatactaccgcagctgatgctctcttgaaagcaccacctcctggctggaggccaaccaacacaaaactagcacaataaacaaaactacagccaaggaccctcacagagtttacttcactccgttgccaccccacctggagcaggtgctggtatccatgaccaagagatctgaagacggtttacatcacaggactctgtgcaaacactccccagtacctgaagccccatagctctgctgggcggctagatccagaagagaaataacaatgactgcagttaagttctctggaagcccctttcctagaggaagggagagaatactatatcacgggagcacgctgcgggacaaaagaatctgaacagcagcccttgagccccagatcttccctctgcaatagtctacccaaatgagaaggaacaagaaaaacaattgtggtaatatgacaaaacaaaacaagttcattaacacccccaaaagatcagcaatggatccaaaccgagaagaaatctgaattgccagaaagagaattcaaaaatgtcaattattatgctaatcaggtagtcaccagagaaaggtaaagtccaactcaaagaaatttgaaaaatgatataagatgtgaagggaaaactcttcagtgaaatagatagcataaataaaaaacaaaagcaacttctggaaaggaaggacacacttagagaaatgcaaaatgcactggaaagtctcagcaacagaatcaaacaagtagaagaaagaacttcagagctcaaagacaggctatcgaattaccttagtccattcaaagacaaagaggaaagaatttttaaaaaatgaacaaagcctccaagaagtttgggattatgttaaatgacgaaacctaagaataattggcgttcctgaggaaaacgagaaatctgaaagtttggaaatcacattggaggaaataattgaggaaaacatctccagctttgctagagatctagacatccaaatataagaagttcaaagaacacatgaaaaattaatcacaagaagatcatcacctaggcacatcgtcatcaggttatctaaagtcaagatgcaggaaataatcttatgagctgtgaggcaaaagcatcaggtaacctataaaggaaaacctatcagattaacagcagatctctcagcagaaatcctgcaagctagaagaaattggggccctatatctagcctccttaaataaaataattatcagctaagaattttgcatctagcgaaactaagattcataaatgaaggaaagatacagtcttttccagacaaacaaatgctgagagaactcaccactaccaagccagcactgcaagaacagctaaaaggagctctaaatcttgaaacaaattctggaaaatacaccaaaagagaactcctttaaagcataaatctcaaaggacctataaaacaaaaacacactgaaaacaacaagaacaacaataacaacaacaaggtattcaggcaacaaacagcatgatgaatataatagtacctcacatctcaatactaatgttgaatgtaaatggtctaaatgctccaattaaaagacacagaatggataagaattcaccaaccaagtatttgttatcttcaagagactcacctaacacataaggactcacataaacttaaggtaaaggagtggaaaaaaatattccatgcaaatggacaccaaaagcgacaaggaatagctattcttatatcagacaaaacaaactttaaagcaacagcagttaaaaaattcaaagagggacattaaataacgttaaaaggactagtccaataggaaaatatcacaattctaaatatatatgcacctaccattggagctctcaaatttataaaacaattactactagacctaagaaatgagatagacagcaacacaataatagtgatggacattaatgctccactgacagcaccagacaggtcatcaagacagaaaggcaacaaagaaacgatggatttaaactatgtcttagaacaaatggacttaacagatatttacagaacattctacccaacaaaggcagactatacgttctattcatcagcacatggaacattctccaagatagaccatatgataggccacaaaacaagtctcataaatttaagaaaattgaaattatatcaactactctctcagaccacagtggaataaaattggaaatcaactccaaaggaacccacaaaaccatgcatgtacatggaaattaaataaccagcccctgaatgattattgggtgaaccataaaatcaagatggacccaccaactcatgggtgcagcgcaccagcatgtcacatgtatacatatgtaactaacctgcacattgtgcacatgtaccctaaaacttaaagtataataataaaaaaaaatcaagatggaaatgtaaaaattctttaaagtgaataatagtgacacaacctatcaaaacctctggaatacagcaaaggcagtgctaagaagaaacttcatagcattaaagcctagatcaaaaagtcagaaagagcacagacaatctaaggtcacacatcaagaaactagagaaacaagaacaaaccaaacccaaactcggcagaagaaaagaaataacaaagatcagggcagagctgaatgaaattgaaacaaacaaaatatgaaagatcaatgaaacaaaaagctagttctttgaaaagataaacaaaattgacatactatcagtgagattaaccaagaacagtgaggattcaaataagctcaattagaaatgaaactggagatattacgactgatatcacagaaatacaaaagatcattcaaggctacatgaacacctttatgtgcataagctagaaaacgtggaggagatggataaatttctgaaaatatacagcactccctagattaaaccaggaagatatagaaactatgaacagaccaataacaagcagcaagattgaaatggtaataaaaaaaaaattgccaaccaagaaaacttccaggaccagatggatttacagctgaattctatcagatatttaaagaagaatgggtaccaatcctattgatattatttcaaaagataaagagggaatcttctctgtattattctgtgaagccagtatcaccctaataccaaaaccaggaaatgacataacaaaaaaggaaaactacagaccgatatccctgatgagcacagatgcaaaaatccttaagaaaatactagctaaccaaatgcaacagcatatcaaaaagataatacatcatgatcaagtagatttgataacagggatgcaaggatggtacaacatatgcaagtcgataaatgtgatacaccacatcaacagaattaaaaacagaaatcacatgatcatctcaatagatgcagaagaagtatttgacaaaatccagcatcactttatgattagaactctcagcaaaattggcacacaaggaacatacctcagtgtaacataagccatctatgacaaacacacagccaacataatactgaatgaggaaaagttgaaagcattcccctgagaactggaacaagacaaggatgcccacttttttattatttatttttttttttgagtcaaggtctcactctgttgcccaggctggagtgcagtggcaccatctcaattcactgcaaccatctcaattcactgcaacttctgccttccaggttcaagtgattctcctgcctcaggagggattctcctgattaggtgggattagaggcacctgccaccatgtctggtaaatttttgtatttttagtagaggtggaatttcaccatgttggctaggctggtctcgaactactggcctcaagtgatctgcccgtcttggcctcccaaagtgctgggattacaggcatgagcaccaggcccagctggatgcccactcttaccacttctattcaacatagcactggaaagccctagccagaacaatcagacaagagaaggaaataaagggcatccaaatcggtaaacaggaagtcaaactgttgccatttgctgatgatatgatcatatacctagaaaactctacagattcctccaaaaagctctcagaactggtaaatgaattaagcaaagtttcaagatacaaaattaatgtacacaaatcagtagctctgccatacaccatcaacgaccaagctgagaataaaatcaagtgctcaacccttttcacaatggctgtcaaaaaaataaaatacttaggaatatacctaatcaaggaagtgaaagacttctacaacaaaactacaaaacaccgctgaaagaaatcatagatgacacaaaaacataggaacacatcctatgcttataaataggtagaatcaatattgtgaaaatgaacatactgccaaaagcagtctaaagcagcctaaaaattcaatgcaattcccattgcataccaccatcattcttcacagacctagaaaaaacaatcttaaaattcatgtggaatgaaaaaagagcttgcatagccaaggcaagactaagcaaaaagaacaaatctggaggcatcacattacctgacttcaaactatactctaatgccatagtcaccaaaacagcatggtactggcataaaaatggcacataaaccaatggaacatgatagagaacccagaaataaagccaattgatctttaacaaagcaaacaaaagcataaaatggggaaaggacattctattcaacaaatgatgatgggataattggcaatcacatgtagaagaatgaaactggattctcatctcttaccttatacaaaaatcaactcaagatgaatcaaggacttaaatctcagacctgaaaccacaacagttctaggagataacatcggaaaaacccttctagacattggctcaggcaaagacttcacgacaagaacacgaaagcaaatgcaacaaaaacaaagatgaatagatgggacttaaactaaaaagcttttgcacagcaaaacaaacaatcagcagagtaaacagacaacccacacagtgggagaaaatctttgcagtttatacatctgacaaaggactaatatccagaatctacaagaaactcaaacaaatcagcaaggaaaaaacaaacaatcccatcaaaaagtggactatggacatgaatatacaattctcgaaagaagatatacaaatgaccaccaacacatatgaaaaaatgctcagcatcactaattaaaagggaaatgcaaatcaaaaccacaatgcaataccaccttactcctgccagaatggccaaaatcaagattttaaaaaaatagattttgacagggatgtggtgaaaacagaacactcttaacactgttttaacactgttggtgggaatgtaatctagtacaaccactatgaaaaacactgtggatattccttaaagaactaaaagtagaactactatttgatccaggaatcacactactgggtatctacccagatgaaaagtcattatacaaaaaaagatacctgcacatgcatctttttagcagcacaatttgcaattgtgaaaatattgaaccagcccaaatgtccatcaatcaacaagtggacaaagaaatcgtggtatatgtatatatatcacagaacgctactcagccatagaaaggaatggaatgatggcattcatagcaacctgtatggaattggagaccattattctaagtgaagtaactcaggaatggaaaacaaaacatcttacattctctctcataactgggagctaagctgtgaggatgcaaaaacgtaagaatgatacaacggactttgggtacttggggaaagggtgggaagggggtgagggataaaaggctatacattggatacagtgtacactgcccgggtgatgggtgcaccaaaatctcacaaatcaccactaaagaacatattcatgtaaccaaacaccatctgttcccccaaaaacctattgaaataagaaagaaaacaacaacaaaaatatatgtggcttaagcctgcacctgactttccttttgttttttaaagttttttaattttttaaaataaataaatttctgaaaagttatgacctattacttgttcattaagaccacattttaatgacataggaacataattatgtatgttattaagtgaaaaattcaggatataaacatatatgtaaacaatatctcaattatatacaaattagtatagaaaaaatggaaaatgcaccaaagttataatcatgattatttacctttctcatgtgtttatttattttctatatttctacaatgaaaatttttttaaaaatagatatataactacatatttatgggatacataatgatgttttgatatatataatgtatagtgatcagatcagggtaattagcatatccatcacatcaaatatttatcattgctctgtgttgggaacattcaatgtcctccttctagctgtttgaactatgtgttattaaccagttatcctccagcggtatagaacactagaacttattccccctacctaactgtgattttgtatcctttaacaaatctctctctatccttcccttaaaacatttttataattagaaaaataatgcaattattattagtattaatttaaggaaggttaaggcttatgttctatttttgctgtctggagctgtgtagacttagacaaatctcacagcatctttgagtttgaggtcaccacaaataacacatacatagtaacagttgtcctgcctaccatgagaggttattttgatgatgaaatctgagagataatagacttgatgaggctttatcagttgtagtcattccacacatgtattataatcttcttcctaaatcaagttccattcctgggcttccctgtattgctcagtggaactatcattcttgaccactatctttccttagccaccacaatcaatcaccaattcctttgagagaaactatttttcattgtggatttctgggaagagatcatgaatgaggcagccttcacactatatctggagggtggatagagatggagaattatagggagaggacattttgacacagagaacactatgaacaaagtcacacaggtgggatattcacagatttttcaaaaagtacatttggttagactagagtacaagtagtacttcgagttgtggctggaaggatagactaagtctggatcacggagggtcttgaatgtctggctaaggaactgaaacttaattctgaaggctagtatgttccaacctacagtcatgcttgtataatcttcacctttttgtcatattgatataccaacactacaagtagatatttttcttcaaattaattcccctttgaaacttttatttatttaggtctaatacccttggctttgtgttttattataattatttcatatatatgcaaatgaaaacatatctcggaaaacaaaaagatgaatttacattccacctaaaatgatctcctatgcaatcagtgatagccattccttaccttgggaagcacagcgagggtaatgtgggtttccgattgggtgggaggttacattatgagagttgctccttaatgggagtcatccagctgtcctgtttcaactggaatggagagactagggggcactgaggtcagccagggatgggtagtttaggcaggcctggtgagattctgcctagggatgcagagtggaaatgcagagtaggtgtgagatgtactcctccagtctctaggaagaccttcctagagttagaactcaaactaccaattgtcatgcaaattatttagtaagtaagctattaaaaggaataaaataatacaataatattttatttttatttaattgattgtattactttcattaatttttctcagtaaaagagagtagttatatttttccactgcctctaatctaccaatattttttgaggaatatggctgaaaaaggccagaggtattaaaattctatgtgtgttcattggttatgagagagaatttgaggcttggctagtgggattgaaaatcaaatggggccgggcacagtggctcacgtaatcccagctctttgggaggccaaggtgggtgaatcacccgaggtcaggagttcgagaccagcctggacaacatggtgaaaccccgtctctactaaaaatacaaaaatgagctgggcatggtggtgggtgcctgtaattccagctacttgggaggctgaggcagaagaatcacttgaacctgggaggcagaggtggcagtgagctgagatcatgccactgcacctcagcctgggtgacaagagcaaaatctctgtctcaaaaaaaaaaaagtaaaaagaaaaaagagaaagaaaaagaaaatcaaatggatatttgctcttcatttgtatagtcttccccaatctgtttcattgttctgatgagctagcataattcttgtctcattgttatgcagctcaaatgacacaaggaatggaacagagctttatacactataagcattattacacatcagtagatgaaaggtgttattattattattattggctgttttggaatggaattgtgtaaattacattttcttgatatttgtttttcacgtcaatgaatattttgtgagactacagggtggtctggacactgtgccttcattttccttgtaaatataatgactggtatataggggcagaaggtattccaagaataccagccaacaaaatggtcttttctttccatgtgaatctcacagtttaatattcattcagattgttctgggaataaagagaaaatgggctcctactttaccgtcattttaacttgatcatacttaataattagaatattgaatcagatgaaaaaaggtagaaagagcccaggatttgcagaaagatgctcttggtttaagtacaaagttgctactaactaaacaagcttgaacttgtaacttattgtctttgagtcttggtttctctctgtaaaatggagatactaataccgacctcagcaaggttgatttttgtatcaaacaagataacatgaaaatgatctgtgctaaacataaagtgctatatagacatcatcatcaccattgttacaataaaaatatttattgagtgcttattgttttttgcatatgttaactcatttaatccttataagtaatgacataatattggtattattattatctaaattttctggaggtgaaaactaagacatacggaggttaaataacttgcccagtattgtatattaaatggcagatctgggatttgaatcaggcaaattgactataaagactgcatcaaccttatttctaaaataatgatattctaataatttaaaagagtttcagaacctcaaaaatttatcagtgacccactgtatgttgaaaactcatacggaaaacattttgagttgaaaaattcttcctctttatcttctttccactattttatttaaaatgtttggacttgaattatgttattaagatgatattcagataacatttaaaaggagttttggtacaattcagtatctatctcaaagaacatttcaatttctccccaaacattatgttggagaaaaaacttttctaaacttgatgcatgactctatgactttgagccatttggtgtaaaaaagtcccttcccatctataaaaggcttgattcctcttatgactataagtaggccaattgagcttgttttgtcattggtgttaaacagggaaggcattggcttgcttctttcttatcatctgggaaattatatatgcttcctcttaattgtaccctgtccactaaaatgatcaagaagggaagatggaacctgaagatgaaatcgaaagtcctgaagtcaaagtatgccctactgacaattttaactaagactggataaaatatgagaggaacaagaaacatctgtgtttataatctaatgagtccctgtagttatatgtagaataattgtagttacagttaacaattactgagtgcttcctaggagccacacactgtgccaacattctttacacatcagagttaaatacttagctctcccagcaacagggtgttgggtactgacaattctgaggagtaaatcctatgtggtgctgacaccctgacctgacaagtaacactgaccatctcctgcttatggtagtaagagactaccatttttctaagcaagaaacatcttcgactttttgttcctttctcagatacagacaggatgcccatttgaaaaacaaaaacagagagagagagagagagagagagatgaaacttatttaaaaatcatgcttgcttggtttttatgagtctattaaggggtaggtagatagttggccttcagtttcctaaatgtggaaagagagttgtcattggatgccaacatcagcttcacacatactctcataaacataataaatctccttgtactgggaggtagtggagttggcctccagagacttatctgtaaggcacagacaatagccctctgctgtcttctccagtgtctaagggaaagtcgtcagctctgtagcctgagggcctgcagagaatgggaagccatgtaacattgggatacttcttggccttgcaattggtaggggatacagggcatgtgcaacccttggatcaaaatcttctggtataactatatttatcacattggggtaaaaaaaaatcaaaccattgtttcaaccaaaaggaggaagccccaagtatgatagattccagaacacatgggaattatcactctattttaaagctgaggatcccagggctcaatgcaggttaagctacttgagtgatgaaggcagagttggaatccaggtttgtctgcttctagtacttggttacaattgccacattagattgcttcccatgggttgcacaatttaagtggatgggcctggatcaaatccaagcccataaaccaaatttatgactccctaaggagctgtgcctctgtgttagtagagattttaacaaaatttatagatactgaatatgtatcagccccattaatgtatatacatctgaattcattcattcattcactcacttatttgttaaagatttattgagtgtctgctatatatatgctatgatattaagcacaactaggcaaaagtgagtacaagagaaacatagaataatgaatcagacagattctgctcttaagagcttgcatgggaagttagagatatacataaataaagtataaatgacaagcacaagaaagttacaaataaaggaggcaaatggattccaggtgtgtgtgtgtgtgtacacatgcaaatgcagacatgtgcacgggtttggtaattgaatatgactaaagagagtgctctaagcttgaacaatatcagggaaatagaaaatttaaaaatgactgtaaggagatctgtttggttagtgtgatgaatccataaagaagcaatggaattttggactgaaactgcaggcaaaacattctactttacgttcaaaagagtgatatgattggttctgtgcttcaacaagggctatcaggcatttctatggcaaggggccagcaaaccactgcctgtgggtcaaatttgttttatggtctgtttttctgtgaccagtaacctgagaatgatttttacattttaaagggttgttcaaaaacaagaaagcaaacaaagaacagtatgtgacagagactgtatctggtatgcaaaacttgaaatacttactatctgccactttacagaaaagtttgccaacccctgcagtgtgtaggatgcattgttagggggatattggactaggcgaccaagttcatagggaatagcaatagtctaggcaaggaagaatgagggtatgagtgagagtggaacttggaaatgcaggagccaggggaaagcaaggctagatatttgtgcatttgggaattatcttgattaaaatggtaattgaagtcacaatagtgaatgaaagggaaaagagccaataattgatcatagttaaacatttatttttagagtggtgaggaagaagaggatctaacaatggaaaaagaaaacaaatggtaacagaagtgttaaagaaacagaaaattgagagtctaacatgaaattcacaggaaagtaactttaagaagaaagaggaagttgatagcctcaaatgctatagaaaatttactaaaaaggttgcaaaagttatggcctaatatctttgcttccatttattccattagcacaatttgtaagtccttggcttttgcttgccttatgctgccctgcccaagagagaatgtggtgttaatgaggtattagagccatagctgccagggtacaacagtgacctagcccttaagtttagcttctcatgttgtatgtctattatgttctaaataaaggtagatgccaagtctcttctaactctcctcaaagtacttcttctccatgtcaactggtggatatgtgattgctaggatttgaatatttgtgtctccttcaaattcatattgactcttaatcaccaagatgatagtattaggaggtggggcctttgagaagtgattaggtcctgaggtctttgccctgatgaatgggattagtgcccttacgaaaaaggcctgaggaagcttgcttgccccctccaccacatgaagatgcagcaagaatgtaccatttacgagaaagtgggccctaaccagatactgaatctgccagagtcttgatcttggactgtccagcctccagaactgtgaacaataaatctctgttgtttataaactacctagattatggtatttcattatagcagcctgaacagactaaaacaatggtccctggagacttcttgactgacgagggttaagaaaaaattagtttattttgttttttatttttttgagacagggtcttgctctgtcccctgggctggagtgcagtggtgtgatctcagctcactgcagccccaaactcccaggcttaagagatttagctagaactccggttgcatgccaacacaaccagttcatttctgtattttttttgtggagatagggttttgctatgttgcctaggctggtctcaaactcctgggctcaagtgatccacacttctcagcctcccattactaatatacagtcccaatgtcctgggactatgggcatgagccactgtgtccagacaaaagttggtttattttcattcttgtgtatcctgaattgatgtactgaataaacagacttagtactctagtatgcaatgtttgcttcttgattttagaatcattattgcaaatgagaaccagctgtagggaagtaggaagtccatgttaccatactataaagtctgcgaggtacattacaaaaacccccaagatatagtctaggaattaagacgttaaagtaattttaccacttaaattatgattagaaagctattttttttctttttacattcaggccatgagtgcaccaataaatactcaataactagcacaaatccaaaataagccattggacaactatcttattttggaaactatagggcagagttaagaaatagtaaataacatcctgcttattaaaattgttaaagcaatttaccaaaaactgtgtagtaataaagtcagaaaactgaaatgtgctctaggttctgagataagaagaataaaagtcagattatttcctatatttcataaacaagtagtactaaaatgaagtcatcctggagaaggcaacaaattggtataaagttattcgtgctttatttaatttttatcttctaacataattaaatatgagctaacatttcacctttatggaaaaagaagtctggcatatgaatatttcatttggtaagagaagcataatggataaagtccatttgacccagatgtagattcaatggctaattattgaaatctctcttcctttctctttcttgacagtcactgcatgtatctcatttaaaataattactatttaatctgggttgtgataaccaactaattctagcagaggttacgcacatcataaatagtgtcagggtccctacagaagcaacgatatataacagctttcaccaacacgcagcttagacataggctactaggctgtactgtaagattgtactatgcatttttctgttgaaaatcagagtaagcagttgtgagatgtcatagctggatgctcgcagtttcatgtgatcatggaagtggaaatggcagcagaagagaatcttttcccagatgaaagaaagtatgggagtttggaaagcctaaattataggctgggaaacagggtggtaaaaagaagtaattgaagtgtggggattcatccagactgcattcagactgtggagggcctcaaagccacattaaatagtttggacacttgttagtagcaaaagcaagtccttgaaactatctgagcaaataagttaacaagtcaggcctgggcctcaagcatcaagcctggaggagtgtttggaatagcttggaggacagacaacaaggtttcctttctgggactaggtaggaacacagagtaatggccctggtgaagaaaactgaggctcagaatgaggatgatggcactggaatcgaagtagagcaggcagatgtgagagacactgccgaaagaaactcagaataacttggccacaattggctggtggcggtggcaatgaggataggggaactgaagctttcaagactgagaaaatgaaacgagaattggaaggggaaacattgtggagatgtagggctgggaagcactggaggatgttggataggctgattttgtttctggacatgtagaacttgaagtaatgacgagacaaccaggtgagacatccaagcgcaagctgtaagtatggttggagagattgagagagcaaggttaaggccagaaatagttttgtgaataatctccaatgaggttgttggtgaagccaacaggagatgtatgatattaccaagaaaaaaaaaaaaggtcttataaggaaatacctaaatgagacttagcaattgagactatcttactgaataaatgaatgaaatttaaaatgtattcagggtaattagcacagaatacatgcaattagactaatttaccactaaaaatagagcatctaatatgacgttaaaaacaaaagctatatataatttttaagaaactcatctaacatatagggtgcagaaaagctgaaaataaaaggagaaaaagcatgaaaatgtcctatattgggaaagtacgaactaaaagaagttgatgtaagtggattaatatcagatgaaatgaaatgcaagacaaagcattgtcaggaataaacaaagtctctgaataatgatagaaaaatatttcaccaggaaatatagctagtctaaaaacttataagcctaacaacatcatctcaaaatacataaagcaaaaatttgacagaattttaaagagaaattgacacaatctcccatgataggagacttaaaattacttcttcaaaaaatgacacaaagaacaaaaggactgagaaaaaagaagtttcaggtaatgtccacattatggatgaaagtaatgagaaacgtaaggaaaagaggaggagaaacagaaaagttggaggactagcagaaaagtacaatgtcattgaaattttaggaaggtagaaaagacagaagtagaacccaatgcagagggagtaatagagttactgttcaagaaatgtacattttctagagaaaaaattatggaggaaatgcaaagtgatgggatgtgttgcctgtttagagaatgactgtagagaagaagaggggcactacttcctctgatactacatagaaaaaaaaggcatggctcaagatatagtcacactgggataaaggagaagaaagtagaggagcttacatttatgacctttgatttcctttaaggaggagtcttctgttgagcatgaggagaatgaatctttaatttcaatgcagtttcaatccacatctcaacagtgtgtgtgtgtgtgtgtgtgtgtgtgtgtgtgtgtgtgtgtgtgtgtgtgcgcgcgcgcgcgcatacacatgtacatgcaacctgaaaggctgagtttaaaatttatctataagagcaaagggctaaaatagttggcaactctggagaagtgtcacaaggagtgtgacttgccctatcatacatcagggcttattataaagttacactgattagaaaaatagggcaccagggaaggactagacaagtagggaagccagaaaggctcatgtataggtggaaacctgctttatgaaagagctggcattatgcgacataaggatggaccattaaataaatgacgcaaggtcagctagtcatctacatggatctccacttcatatcatacacaaaaaaaatcagttatggatgggttacaggtttaatgttgaaggtgaaactagacacattttagtagaatatatagaagaatatctttttgatattttggtaaagaagagtttattaaacatgaggcaaaaagcacaaaacataaaaaaggctgatacatttagctgcagtcataggctgcataatgacgtttcagtcaatgatgtattgtgtatgtgacagtggtgccatgagattataatattgtatttttattgtatctttttatctttagatatgtttagatacacaaatacctaacattgtgttacagttgcctacagtattcagaactgtaatatgccattcaaatttgtagcctagggacaaataggctataccatagaacctaggtgtgtagtaggctatgttgtctaggtttttagaattacactctatgggctgggagtggtggctcatgcctgtactctcagcactttggcaggccgaggtgggcagatcacctgaggtcaggagttcaagaccagcctggccaacatggtgaaaccccatctctactaaaagtacaaaaattagctgagtgtggtggttggcactcccaaaagctacttgggaggctgaggcaggagaattgcttgaacttgggaggtggaggttgcagtgagccgacatcacaccactgcactccatcctgggcgacagagcaagactctgtctcaaaaaaaagaaaagaaatacactatgatgttcacacaacaatgaaatagcctaatgacacatttctcaggatatatccccattgttaagtaatgcctgactgtacattaaatttgagaatttctatttatcaaagtacatcaaaaaaagtgaaaaaacaagccccaaactgagaaaatgtatctgtaacacaaccaacaaaagattagtatttaacatatataaaaagaataagaggaagtggctgtggtttgaaacttggaaagaatataaaagatttagaacaatgattgtagggaataggagagcctattgactagagataaatacgaggattggctggtgttattgaaagcctaatccaattagactgaatgactcagctttgggagtggtacgagaagcatcaggcacatagaatagagtaattgacaggtgagggaacccagatgggagcagggagggtggaaagacatagtgcaaactctcaacaaggcacaaggtaaagaaaactattttgaacatgtttttacacagattgcttgaggcgtttgatctcaggctcgtgaacagagaagcctggcatccaggttcaggttcaatatgaatgaagtggtgggaggggggaggtagggcagttatctttggagtggggagtagattttaaagtcttagattttggagcagcaaggctttgagtggaggcatgattcccaggtgtgactgggaagaaatggaaagatgaactgattggacgctaggaggtctggccgctgtcaggggagtagagtgaatgataggactcaccagtgtggaagcagaaggtggtgaactaggagcagggctggtgttgtcatcaccatgacttgtttagggccacacaaccatggggcttacaatgccaagtctaagtggtcctcctacactccagggtatcaaaagcaaatgtactgccccagtctggggttggtggtttggcagtggcgatagaggaaggcttctgcaggagctcagaggacagacaggagctccaggaggcagcagcagaaaaggagctggcactgccctctggaacataaggctcttggtttctatgcacataatcagcctcactgtgtgcatggtcacctgtgtccccttttcctggtcttgatattctttatgaccaaacccctcttgaggaggaagataatagagagacatctgatctgtgacatctgttccccaatgaatatgttgcagatagtctttatctctttaatttctattctttacctgaaaacaatgatagaacttaggttataggttgatttctagaaggacctatcttttttaaaggggacaggttttgagtaagcagaggagtgaattacttcaagatctatatgaaatgagcagaaagtacagcagtatctgtgtgaagatgtcgtgaggggctgccccacctagcttgaaattgcaggcccagggaatatttttcatgaggccacagcacccagaggcccatccatagtgcaggctttattatgtaagtcagttaagtgctgggatgagaaagatatcacatcaactctagaaccaaatagcttagccaaacttggcaacggttagactggcctcataatattataccccatatagtttgtaaggggaatcaaaagaaacttgaaggatacaagagaaaagagaaactctatgacgatgcaatgcctccttgttttgtgtgctatgctatggagcctaatgagtagaaaacacggggtctgcagcaagacagtcctagcttggctcttcctggctctgtacatctccccacctctcttagcctcagttcctttccttgtctctgcaagaggagaaaacaatgcctactttgtgtctaccttattttcaaggcatctggtaccgtccatgtacataagtagtccctcaaaatttgaaattatagttatactgtaattttgatttaaaaatttctaacttatttttgcccggatgtggagataaattgttgcttcttaagaacacacaggccaacattcaaatttaggaaatacagagaacaccacaaagatactcctcaagaagagcaaccacaagacacataattgtcagattcaccaaggttgaaatgaaggaaaaaatgttaagggcagccagaaagaaaggtcaggttacccacaaagggaagcccatcagactaacagaagatctctccgcagaaaccctacaagtcagaagagaatgggggccaatattcaacattcttttttttttttttggagatggagtttcgctcttgttgcccaggctggagtgcaatggcatgatcttggctcactgcaacctctgcctcccaggttcaagcaattctcctgcctcagcctcctgagtagctgggattacaggcatgcaccaccatgcccggctaattttgtatttttagtagagacggggtttcttcatgttgaggctggtctcgaactcctgacctcaggtgatccgcctgcctcggcctcccaaagtgctgggattacaggtgtgagccaccagacccggccatcgacattcttaaagaaaagaattttcaacccagaatttcatatccagccaaactaagcttcacaagtgaagaagaaataaaatcttttacagacaagcaaatgctgggagattttgtcaccaccaggcctgcctcaccagagctcctgaaggaggcgctaaatatggaaaggaaaaaccagtactagccactgcaaaaacataccaaattgtaaagacctattgacactatgaagaaactgcattaactaacgggcaaaataaccagctagcatcataataacaggatcaaattcacatatagcaacattaaccttaaatgtaaacaggctaaatgccccaattaaaagacacaaactttgagactcatcggtatgctgtattctggagacctatctcacatgcaaagacacacataggctcaaaataaagggatggaggaatatttaccaagcaaatggaaagcaaacaaaacaaaacaaaacaaaaacaaacaaaaaaaacaaaaaagcagggtttataatcctaatctctgataaaacagactttaaaccaaccgagaccgaaaaaacaaagaagggcattacataatggtaaagggatcaatgcaacaagacaagctaactatcctaaatatatatgcacccaatacaggagcacccagattcataaagcaagttcttagagacctacaaagagacttagactcccacacaataatagtgggagattttaacacccccattgtcaatattagacagatcaatgagataaaaaaataacaaggatattcatgacttgaactcacctctggaccaagcagacctaatagacatctacagaactttccaccccaaatcaacagaatgtacattcttctcagcaccgcatcacacttattctaaaattggccacataattggaaataaaacactcctcaggaaactcaaaagaacggaaaccaacagtctctcagaccacagtgcagtcaaattagaactcaggattaaagaactcactcaaaccatacaactacatggaaactgaacaacctgctcctgaacgactactgggtaaataatgaaattaaggcagaaataaacaagttctttgaaaccagtaagaacaaagacacaacgtaccagaatctctgggacacagctaaagcagtgtttagaggtaaatatgtagcactaaatgcccacaggagaaagtggaaaagatctaaaatcgacaccctaacatcgcaattaaaagaaccagagaagcaagagcaaacaaattcaaaagctagcagaagacaagaaataactaagatcagagcagaactgaaggagatagagacacgaaaaacacttcaaaaaaatcaatgaatccaggaggtggtttttctgaaatgatcaacaaaatagactgctagacagactaataaagaagaaaagagagaagaatcgaatagacacaataaaaatgataaaggggatatcaccactgatcccacagatgtacaaactaccatcagagaatactataaacacatctatgcaaataaactagaaaatatagaagaaatggataaattcctggacacatacgccctcccaagactaaaccaggaagaagtcaaatccctgaatagaccaaaaacaagttctgaaattgaggcagtaattaatagcctaccaaccaataaaagcccagggccagatgaattcacagccaaattctaccagaggtacaaagaggagctggtaccattccttctgaatctattccaaaaaatagaaaaagagggactcctctataactcgttttatgaagccagcatcatcctgataccaaaacctggcagagacacaacaacaaaaaaggaaaatttcaggccaatatccctgatgaacatcagtgagaaaatcctcaataaaatactggcaaatcaaatccagcagcacatcagaaagcttatccaccacgataaagtcagcttcatccctggtctggttcaacatatgcatatcaataaacataatccaacacataaacagaaccaatgacaaaaaccacatgattatctcaatagatgcagaaaagggctttgataaaatttaacaccccttcatgctaaaaactctcagtaaactaggtattgatagaatgtatctcaaaataataaaagctatttatgacaaacccacagccaatatcatactgaatgtgcaaaagctggaagcattccctttgagaactggcacaagacagggatgccctctctcaccactcctattcaacatagtattggaagttctggccaggtcaattgggcaagagaaagaaataaagcgtattcaaataggaagagaggaagtcaaattgtctgtgtttgtacatgacatgattgtatgtttagaaaaccccatcgtctcagcccaaaatctccttaagctgataagcaacttcagcaaagtctcaggattcaaaatcaatgtgcaaaaatcacaagcatccctatataacaataacagacaaacagagagccaaatcatgagtgaactcctattcacaattgctacaaagagaataaaatacctaggaatccaacttacaagggatgtgaaggacctattcaaggagaactacaaaccactactcaaggaaataagaaaggacacaaacaaatggaaaaacattccatgctcatggataggaagaatcaatattgtgaaaatagtcatactgccaaaagtaatttatagatttaatgctatccccatcaagctaccattgactttcttcacagaattaggaaaaactacttttaatttcatatggaaccaaaaaagagcccacatagccaagacaatcctaagcaaaaagaacaaagctggaggcatcacgctacctggcttcaaactatactgggaggctacagtaaccataacagcatggtagtggtgccaaaacagatatatacaccactggaacagaacagaggcctcagaaataatgccacaaatctacaacgatctgatctttgacaaacctgacaaaaacaagcaatggggaaaggattccctatttaataaatggtgttgggaaaactggatagccatatgcagaaaactgaaactgaaccccttccttacaccttatacaaaaatcaattcaagatggattaaagacttaaatgttggacctaaaaccataaaaaccctagaagaaaacctaggcaataccattcaggacataggcatgggcaaggacttcatgactaaaacatcaaaagcaatggcaacacaagccaaaattgacaaatgggatctaatcaaactaaagagcttctgcatagcaaaagaaactatcatcagaatgaacagacaacctacagaatgagataaaatttttgcaatctatccatctgacaaagggctaatatccagaatctatacaaaacttaaacacgtttacaagaaaaaaacaaacaaccccgtcaaaaagtgggcaaaggatatgaacagacaatcctcaaaagaagacacttaacgcagctaacaaacatatggaaaaaagctcatcatcactggtcattagagaaatgcaaatcaaaactacaatgagatagcatctcactccagttagaatggcaatcattaaaaagtcaggaaacaacagatgctggagaggatgtggagaaatagaaacacttttacactgttggtgggagtgtatattagttcaatcattctggaagacagtgtggcatttcctcaaggatctagaaccagaaataccatttgaaccagcaatcccattactgggtatgtacccaaaggattataaatcattctactataaagacacttgcacaagtatttttattgcagcactgttcacgatagcaaagacttggaaccaacccaaatgcccatcagtgatagactggataaataaattgtggcacatatacaccatggaatactatgcagccataaaaaaggatgagttcatgtcttttgcagggacatggatgaagctggaaaccatcattctcagcaaacaaacacaagaacagaaaacaaaataccacatgttctcactcataagctggagctgaacagtaagaacacatggacacagggagggtaacatcgcacaccagggcctctcagggggtggggggctaggggagggatagcattaggagaaatatctaatgtagatgatgggttgattggtgcagcacatgtatacctatttaacaaacctgaatgttctacacaagtatcccagaacttaaagtataattttaaaaaataatttttttaaagaagaactcatttcctgagcctggagctaggaatacctcacatttcttataacaaataacttgcataaaatgcagttaactttttcagcagagaccacgattaaacaacatgaaatttaggcagaattctgcaaaaacagtcccatgaaatacctagaaaagttcattcagcctcatttggttttatgacttcccactggttcctagaattttgctcctagctgcctttctagcaaatttgcaggactgctgaaatgtatagtcctggtaaggtttgtcagttagaattggcctcagcattggaaaagcatcagtactcagaagataatccctactgtggcatgtagaagctcagggcttcagtgcctccctggatagaggaagtattcgagctgcaacaccatgagctaacgacatccgagatgggaggatgtcacatgtgggtggtaccttcgtgcgtagtagagttctcctggaatgacagcagccatgaccgtgtgccccacccgctcgctggcttctatatatggggcagccagactgtgtacctaggtattgtcctattcttctcatcttcactcatctcatcccaaacctggaagctgctgaaaggtttctcacaaaggctgtgtggatgctttttggagatgggtcttgcccactctaatcaattccttttttttttttttctaaacattttgctatctctctcagcagttgggtttaactgacctttgagaatagtctctctggctgaggcctgggggcatctacccagagtgggtgatccactgcattggcttcagtgagacactttctgaataaaaatactccatacagaggttaaacatcactggttttgagtcttagctcctcatttactaatcaaatgagccgggtttcctcatctgtaagatgagggtaataattgtacctctctcatcaggacagttgcaaaggtcatatgagtttatatgcataaagatcttgctccctgcttggcagatagcaagttcttgttaaatgtttgagtaagcagagaacaaaatcacatgattttgttcaccctagcagggtctctgatcataccacatttgtaagacattttgctctgattttagaaacacattttgctctgattttagattcctccaggatttcttatgtttctccgttttctacctgtacagattagtgtaacagcctggaccctttgtcattaaagctatttgacagaaagcacctcagtggttcatgacttccaagcaaaatgaaatccgaaacctaagaagatcaagctgaagcgttctccaggaggggaccaattttatcacttcaactcattttgttgaggcagtcagagcgtttggatgagctccaaaaggaaatgatgctaaaactctgctgcacacaccttattaactcgaaggcagtaaaagcagtgtcttagttacttaggagaggaagctactggagccaatggagcctgaggagagctgtaagctcggccagaaagagagaatgttgcatgatttgagaaaatgttgtgtgattcaagaaaatgactgaaaatgtggagacagctggccacccatgcggaattacctaccaattccttcttcttcatgcactccatgaggatgatgaacagatgctgagcttgggttcgagtgtatgtgaaagtcttctgtatagtcaccaacagctggtccctcaaagattcatttatcagtctgcaagtaaaaacaatgtcaaaagcaggtcaaccaactcctattcagcaagtatttctgagaaatacagagctcaagaggaaataatgagggtttactttagataggagttatttctgtatttttctcacaaaaggtatcccgcctgtgataatttaaaaagcaaggcatttaaaaataaatcaattttactctctcagaaaccaacagtcgaaagattgatttacatattttaattttatttttctgtttttcatatggcatgtgtctaatgcccttttcctcaagtttgcttatcaaaaattaccttcaattaaccatctgcatcttcttgttaagaatttgctatagtactgttcttaacagtactatataaatctcctaacagtactgcaggagatttaaattgcagcgtcatgtctaattgtggaaataaagacagtatttcattaataagtttttgaacatccataagcagaaataggaattatgttttcccaaaaatcatttcatgtaggcagcagcctgtctggcctatgatttaggtattcattatttacgtcaagcttttgttctgttacagtgaacagtaagacagtatagtattagctgcctgattaaaagatacttttatgctatagaagaataaatgaaaacaggaaagaggcatcatatctaatcaatgctcaattatgtcttaaatatgaatcaatcacaactaatttttaacttctttctcattaccctggtgagaacagggctttctctactagccattaaatggcagggatggaaaactcactttattaataacagatactatttaaattcaggaagacaaaactgctctcaaggaccagtggcaaaattaccataatttacctagtattttacagattacaaattgctttcataattaaagtatcagcaactcctaaataaaatagtaaaataaattatctcagttgctgattacaggaactctatagacaagggatttgttctatttcacaggcaggacattttagccagaaagagcccaatgtttaagttcacgcaacaaataagtgacagagttatcagaatcagaacctagttcttctgaatatttgtccagggctctttccaccacaccatgttgcctctgtttacaccaagtggatcacaccactgcctctcttcatcactgtggctatttgagcaggcagttgtggagtttccttcaacatgaaagcaagaaaaactttattgcttaaaagaaggcaagatggggagccagaagatgtcttcttatcagtgacctgctgtgctccagtttatgtgaggttcatctgaactcactaggttggatattatgatggccctgctttgaggagggtggcattcctcatgacaggactataccaacgatcctggaaggtcactcagctggatgaaggactgggtcaccccttcccccactcctacaaagtgtatattctatatcaagaatatacacatttaggctgggcactgtggctcccacctgtaatcctaggactttgggaagctgaggcaggtggatcacctgagcccaggagttcgagatcagccttggcaatacagtgagactttgtctctacaaaaaatttaaaaagttagttgggcatggtggtgcatgcctgtagtcccagctacttgagatgctgaggtgggaggaccacttcagccagggaggcagtgagccaagatcacaccactgcactccagcctgggtgacagggccagaacctgtctaaaaaaaatttatatttagaaaaagaggatggttgaaaaaaataatgccaaatcctctcttaagattatcttaattattctgaatgattctgtggtcttagctgtggaccagattgaaatcatttattcattcattcatttgtttagtcattcaacaaatgcatagtgaatgtctacttagtgccacacactaggatgtgccaggaacagaggagctatatatgcactcccagccttcaatgagcttatgcaccagtggagtagaaagatgtgaatcagcaattcaaccatgattgtcagtggaaaagaagtaaagaaacttgtggcaaatgaatttaatctaatctaaggggttcagggaagactcttctgaggaagtgctgttttatctgagacatgaatgaatgagcatcggcatagttggggttggtagggttgggtaagagaattaacagcagacgaaatggcatgaatgggcccagtttggaaaaaataaaaggtcagtatggctggagctgagaaagcaaattaaagagtggaacaaaatagggctgcagagggagtgagcaggaacaagatcaatggggacttcgaaggtgacgttatagagattttaggttttatcccccagacaatgaaaagccattgaaagatttaagcagaaggatggcatgatcacatttgtgttgccaattaattttcttgaaaagtaaagacatgcacactcagacctaggcatgtgtctacctgacaggtaacccaagtggatgagtctatagagctcttcagtatcaagcatccattgatgttgtacatgattaacaacagaaaggattctcctgattagccacttgatagatgtaatcattcatctgcaggtgtttaattttgataacaactcaaaatttgttttctactaccaaccatctgtaatgaaatcccagctccccaaggtcattatctgcatgagggatctgtctgacacttgtatccaatctgtcactttctaaaaattgaggaatgatgtgcaatttagctgattatgggtttcagtggttaggaagctgaaagacagtaagaatcttatcctttgagcccaatttcccagttgctgaagttgtggctttggctagatcatttagtgacaagaaccatagaattctagaagtggaaggattctctaaggtgttttccaaagtgtgggatacctattacaggtggaacaaaggtgatttgatccattcaaagcataaagttaaagaaattaaaattaaataactgccctttctgattcagttctttttccatccttctgattgcaacaagaagaaaatctgatttttagtgctttcctgcctttaacagctccccaacacttgtagatctccccttttaatgaagaaaagatattaggtctcatgcctttggcaaaaagagtttaataacattgttttaaataagatcccacaaaacatttgatgtgtctgtagcacgtcatggtttaacatacacaatggacttcacagataatctcataacaatctatgaggcaagtgggattaatttcattttgcagaagagaaaactatgccctaaggaggttaaatgatttgtgctaagtcatactgcttgattacctcactgtttgagttgagcctattgacttcagccttgccccatggtgttgctcttcctgattatattctaagtctttcatagtttcctaatccgtatcagggatgataagggggaacactaaatgaagataatcacaaagtgcattaagtagtttgaagggtatatttgcgggccgggtttggtggcttatgcctgtaatcccagcactttggaagccagaggcgggtggatcacttgaggtcaggagttcaaggccagcctggccaacatattgaaaccccacctctactaaaaattcaaaaattagccaggcatggtggcatgtgcctgtaatcccagctactcagaggctgaggtgtggggattgcttgagcctaggaggcagaagttgaagtgaactgagatcacgcatcactgcactccagcctgggcagcaaagcacgactccatctcaaaaaacaaaaacaaaaaacaaaaaacaagtatatttacttctaatttttcataagtatttgctctgctgaactagatttcttctgtttgggtacaaaggcttactctatcttctctgaagatcctttcttattttgtaaccatgttccttaggatatatggaagcctgctttcttaaaattattattgtctagttcttcccatctttttctgtgcaacattggagtgatttaaaattttttactgtaatagttaatcatcataaaaattagagatgagcctattttagatttctttttatggcactagaatattgattgaaaatttcttgacatcaaaatacggtcatagtattatgtgaaatttttattttagaactgagccttgacaaagtcatcttatttatggaaactgttaatttgtggctttgtatctacccatgttatttttggtacatctcaaattagagggttttgtgataggaggtgtagtcattgaagtgaggcagatctctatactatggcatttgtgtctccatttaaatgctgtacttatgatctggagctttgtagatgagtcacagagtaatttaaaataggccaatgttcagccagtgctcagggtaaccatcaaaacgccccacagtttgctattagtattctgttcaaatgctctcaatataacccacacatacaaatatatttctcagaatgaatttaattacctgcaaattacctgcaatattagagttttgttcctagatttaaaaattaggaaatgcatttagaattcaatgggaatctaagagctaaccttaggttaatgactttcaaggaagagcccttcctgtgacccccatagatattttctattagtttattcagacacagtatgagaaaattttagctatataaaaaaacttgttaataacaccacaatttggcacttaaaagacacaatcacccacagaatatctaattctctaaagaaaaatgaaattttatcatttgctagaagccaaagcaaattactaaatgttatattaagagcacataaagttgcatgtcttgcctgaggtcacagagaatggcatatttttctcctgctttttttgtaaaagttgccacttcctccccaaatgtcatgactctggtaacatgacaagtaacaccatgattcttcccagagaggcaggaagcattgttaacaacagcattatggccaccagggccaggctgtctggatttaagctgttacctgttggctgtgtgatcttttgtaagttagtgttgatgttctatttttcatatatgtaaaatgggaactataatagtacttatctcataggcttgtgaatattaaatgagttaagctttgtaaaaggcttagaaaagtgcctgacacatagcaagtcctgcacaagcgtatgcattattcagagagtcctacgatgctttttaggaaagagtcactgacgtattccttctcacgaagtagcacaactagtgggccagggcctctatgtacaatgcagagttctctcctggcgttaacagtgctctgcacatctggtgagtccggtggtgtaaggctggagaaataactttcccactttagagaggtcagagaccaccagttctttcctatgtttgggaaatggagatacttagcagctttaggaggcttaattatagtagagtcttgcaaacactccatgcagacatctgcttgctcattcattcattcattcaacaaacaatattcatgccttctgtgtgccaggcactaagttaaatatagagatataaataatattcagttctagcctcaaggaactgaaaaagttgtatgccatgtattctgtaattgatgggtattaccctccaaaatttatttatgtaaaacagcacttatttgttgtgttgataattttgtgggtcaagaatttaggcaggcacaatggggatggctcatttttctccagcatacctagggcctcaactggaatagctggaatggctgatgaagactacaatagctcaactgtggccatatgtttggggcctcaattctgttccatgtggcatctgttgaggctagaatatccaagatggctttcttacttccaagtctggtacctggcctggtctggctaaaagagctgagggttggcttgcattgctctttccctgctggttgcagggtagatggacttcttacacggaagctggcttctcttaaaatgagggttccaagagagagcattcaaagcgactcaggcagaaactacaaggcttgttgggacttaacctcagaagtcctagcatgtcactttcttgtacttgattattgtaacaagtcactaaaagtagcccagaatcaagaagatggaaggaatagacttcacctcttgatgacagcataaatatacactgaaggaatatattaatggtgatcatcttggagacaagcaatgatatcaagtgattctgttcagatgaggcataaactgctcttttccatattttggtgataaacagcctcaattgccttactttgaattttctcttctaacagatcattataatgagaaccaccatttcctttaaagtaatactccaactattcataaatatttctaaaatattattactgatttgtgcatagaacctacaaatagtttctccttttgatccagctgcctatttacatttatttggcatttagtgtgtaccaggtatttcttttaggccttggtgcctggccagagacttttttttccatggatactatcatcacattttgtgcctgttaaatgctgcatataagggacatcttcagtaatatgtgtgtatgcttgggtcagcccttaaggcccagtttaagtcaccaccaaaaacagttttttttttcttgatgtcttaatttcactttggggtctgtttggagagataaagcaacagcagcacctgttgatgttgccaatttctgctagaaactatcttttctttttttttttaaactcaaagaatgtttggaaatgattgggccaggtgtggtggctcacatcgataatcccagtgctttgggagcctgaggcagcaggattgcttgaggccaggagcaagaagtgaattggccacccaactcaaaaacgtatatttgattctgtttctggatactactttattccccctttgaattgctttatttactagtgagggacctgagacaggttatttgatctctttaaggcttcatcttctcatctgttaaataagggtagtgtatgtctttttaggtccatgtattttggaaaaagagatcatgcatggaaagcacaaaatttgacttcctaaaatatttttccagttttcctcattctctatctactttggttttcatcctcatcatatcttattcagatgataccaacagactgctaattggtttcttctctatcctcctccagtccatttcccagtgttaattaaatggttctacagagcagacatgattctattgcatccttcttaaacccctgcaatagctttccatcacaagcaagataacatctctacttgcatacagaatttaagatttgtctatggtcttgctccacagctaggctcatctcctgccactctgtcacacatatcccataaatactgaatctcccaagcccaccagactcttgcatgcctctatatcttcagcttgctatatctgctacttggactattctgtagtcctgacctcatcactcaaaactcatcatttaaaactcagctcaaacttcacctcctttttcttttttcatcttttattttagaatcagggggtacacatggaggtttgttacaagggtatattgcacgtttctgagctttggagtacggatgatcaagattcagttgtaagactattaagctttagtgaagacatgctaaaaaattcacttgatttaatcatcccacaatgtaaacatatatcaagacattgcagtgtatcccatgttatttgtcaattaaaaataaaatttaagaaaattaaaaaaaatcaccctcatctcctatgtgaaaggctctgattactgctcccttggtgctctcaaaccacttgatatatatttctatgattattttattgcatggaaattatttgtttgtcttactctagtagatgatgaactttttgaagcagtgattgtttctttattctgcatgtgccttaagttctagaagagtgcttggttcaatgttagctatagaagaatctttgtggattgagactgagtagctgcttgctttaggtgggtgaccaggcggtctcccccatgcctctttgtcctcatggtgggatgtacttcaagcctatttgggagaatgggagatatggcataaagttttacaatccagcaatttggttttcttgatccttttccttttaatcagattatctctaagaaatattattggtctctatctttatctttctcttgttgtttaaactcaaagggtgtttagaaatgattgggccagtggtggctcacacctataatcccagcactttgggaggctgaggtggcaggattgcttgaggccaggaattcaagaagtgaactggctgcccaactcaaaaacatatatttggttctatttctggatactacctcatccctcctttgaattgctttgtagctcttgtcaggaacagacagattcttattcatttgcatctcccccataatgcttagggcaacatcttgcccatagaagttctcaatagctgtttggggatgttaagagtttcaatgatatcaaggtaatttccctcacttagatgttggtggttttgacaacacaaagtaattatatcacataaaaaccaacacaacatacatctacattttttcaactagttccaagtcatacattgaagtggtgaggccagtttcacaatctgctataggagatggaatgacatagttaagatgctatggtatggtgcctttggctgtaatacagctcctttatttaccagtgagggatctgagacaggttatttgatctctttaagccaatatctcctcatctgttaaataagggtagtatatgtctttttaggttgatgtatttgggaaaaaaagagatcatgtatggaaagcacctggcactgttcctggcacataggtgttaaataattggcagttgttattattaagaacattaggggcttttgcacctacaggaaatcccaatgatgcctagctcagagctgaagcaaggtaaccggcatgcatattagctggaggagtccatccctatgggggagatagatttcagtaattctatgaaattcggatgaagtaggcctgtgaataggatgggaaaggccacatttcaaagccacttagctggggtatcagtgcggacagctcattagctcttggatcatattcatcaaaagtcatgcaaactagggttgctaagatgccttgaaaccattacgctcagataattttatgccatcctgaactcaaacgggtgttaggataagaattcatacttggctgcaacctcctactttaatatttttgaagtctgtatgttctagagaaggcacaaatcagcaaattctactgagagatttgatatttaggataaaagaatgatacggttttagagcaaccattctatggatgaaggatccaaggtctgtgaaggtgaactgatttgcttaagatgatatagctggtaagcattagagctggatttagaagccaagagaatcaggcttctcttgtttgttattttttcttcattctcttcattcttttccttctttctttccttccttctttacttcccttttccttctctccttcccttccctcttctttccttgttctcaccttagactcctgagccagctatggtaaaacagaaggctctgatacatatcaaaaaggaaactgaaggtgggtggtgtggtgggggtgaaagtggtaagaaaggtatttagtcccttctataagacaagctttgtgctgtgcattttacacatggcatttcatcagacagattaagaaaatcctcaccaggctgtaaatccttggatacctggactgtgcatataatctcttctcccctcccctcagtgctaatcaaggtgcagaagacagaggcttttctgccaccgcttatcttgatctcccttactctgctttcttaccccatagcatatatcttctaaaatattatataatgtgtttatggattgtgtttattacttttgtctatctaaccctgctaaaataaaggctccacaaaggcagggatttttgtctatttggtttactagtgtatttttgccagtgcctagaatagtgcctggaacatagtaggtgttcaaaaaatatctatcgaatgactaaatacataatgctgactggaggaaagaatataattaaaaacagggaaaatgtcaaataatatttgagatctatcagacattcaaggcttctcagtttggtggaaaccaactgcagaaatgctagagctctgttatccaatatggtagctgttactcacatgtggctatttaattataatacaatgaaatgaaatttaaaattcatttcctttgtcacactagccacaggtcaagcactcagggagtctctggttggatatcacagatatggaagatctctgtcatcacagagagtatttttttttttttgaagcaggaccttgctctgttgcccaggctggagtacagtggtgcaatcacagctcattgcagcatcaacctcctgggctcaggtgatcctcccacctcagcctcccaagtagctgggacttggcctcctgagatgccaccacacctggctaatttttcatattttttgtagagacagggtttcgccatgttgcccaggctggtctcgaactcctgagctcaagggatccacctgcctcggcatcccgatgtgctaggattacaagcgtgagccaccacacccagccatatcatcagagaattctgttgggcagtgctgctctggagacaggcagggctgccaaactctccatcttaggcagggacaagtgggacatttagatgaaaaatcctgaacaatgttggctgtgtctctgtcatgtctcttctttcctttgcctttggttatgaatgtgcacaacagtagaagtgaagtgctgccaaaggatacagggactgccacatgtcaggtggattctctgctgccaacattggaaggaaatcacactctctgagttcattccaagtgcaatcccatcagcgaatattgccatagcccaggcaagaggaaaagtcaaattttttttattgttttaggacccatataaaagacagaatccgagctggactgaatttttggggcctccaggcagactacaacactggcctcctgcaattgactggtcttacacattggtgcaacacttactcacaggagaagttacccagcatatgagagaagggagagaagatggaatctgggtgccacttcctctgctgtctggaaagctcagctctggggcaagcaaaataaacctcctgcagttactgggtcccaccttcttagaggacaacatggtatagctgctaagggcctaagctccagctccagtcagtctgggctgaccactctctagctttgagatatttagcaaattacctaacctttctgtcctcaatttcctcatttataaaatagggataataattatagccacctcatgatgtttatgaaataaagtgcctagatcaggctgatgcatgtagaagctctaaaaaatattaatttcaaatttttgagcatgctgctggggagagggtcagaggtgtgggaaaaggggagggataagtttaaattctctttcaaagtaatttctcaaaatattccttttattcttctctatgaaacactgggacaaatataagtgtctctatttttgttacatgtttatgatagatttctagtttttcaaaaaaatttctcaagcatttttcataggcaattgctcaattagcttgtctctcagtccagatccaagcagtaacctacactaaagcatttctcgttcttcatctcctgtgtattatgtctgtgtggaaaggctcatatgatggataacttaaacactgttgtgccttgcagagtcgacgaaaaaatggaccatttcctttgttctatcttccagacagctggatgtcttatttttcctgttggtttcatgattcgatgcactacgtgatgattgcctggtagtcttatagctacaggggtatctataagattttggctttatttcagttcatgaaataacaaataaattcatggcatgttgactccaaattcctatctttgcctcagcagacattgttaatctatcacagtacgctttcttctgcactgagatgcaatcttagaatcatattaatacatcattccaggaagcctctaccaatttattggagttgacactcagatttaaactacagtttacccttgaacaacaggggtttgaactgtgcgggttcacttacactctaattttttttcttcctctgccacccctgagatagcaagaccaacccctcctcttcttcctcctcctcttcagcctattcaatatgaaaacgacaatgatgaagacctttatgatgatctcttccacttaatgaatagtaaatatattttctcttccttatggttttctcaatattttcttttctctagcttactttattgtaaaaatatattatacatgtaacatacaaaatgtatgttgatatgttactagtaaggcttttggccaatgatgaactattagtagttacgtttttgggaagtcaaaagttatacatggatttttgaccacatggggggttggcaactctaacctcatgtcattcaagggtcaactgtatttgtcatcaatgcattagagataataaaatctcaaatttactatcaaatggcaaaaaccaaggagatgataggcttaaacaactccaaattttaagtttgtctccaagacactgaatcatggttctatggatttagaggaatggattatttactgcttactcaagacttttagaggtttatgctcatgaatggacacttgctttgcatggaatatcccaagaaaacataataaatatgtacatcgactctaagagagttgtccaacaattaggatagtgcaaaaagatgttattgaaactgaatggagacttttctagacaacagtagtgcagacttgagttaatcttgaaatcctactttaatgcatttttagtgtttctctgactgaagaagcttttatagcatgtgttcactgctctatatagttttcataaatcctgtggtccgtgaccaacatctgagaattgcatgaggaatctggagaaaatccattaaaaacatcccaaacattatttattattaataataccactaggtaaggcattaatccactgtatccctagcagctgtagatcctaatgtcagccaggttgattcagaatctatttcctctaaaggaaaggaatgaaacaccagtacattttattatttgcacctcactcagataaatttgtgggttttaaagcccttactacatctttttgtgagagaggctagtttgtgaaacttcagagaaaaatttactagaaattaaatgggtaaagaaatgcatttgtgcatctcatggtaaggcagagaagccttgtgacagcaggaagtgcttggagaacagtggggaggacagctccattgggttgtagggtgaatggaaggtttgttgagtgagagctggctctagagaaaagctggggccaggatacagtggatcttgagtccaagcaaaggaatgtgatcttgacctgtaggtcaggggtcttcaatggagtttcacaaagaagcccccggaattttgaggaggagctccacagctgcctcagagctgcctttgtaggtgagagccaggcagaaaggaggccctaggaaaatagttctgaaagtatcgtctctggaccaaaagcatagcatcgcctaagtattcctttgaaatgcaaattacctgacctcaaccagatttattgaattagaaaatctgggggtggagccagcaattgtgagatttttttttttgtagttttttcctcttattttaaaaaatgcatatctaattgacaaaaattgtatgtatttatggtatttatggtatgttttgatatgtgtatacactgtggaatggctagatcaagctaattaacatatgcattaactcacatactttcattttattatggtgagaaaacttgaaatctattctcagcaattttcaagtatacaatatattgttattgactatagtccccatgatgtacgatacatctcctcaactcgttcctcctgtatagccatttattttcacaagccctctgggtgattctgatgcagaataaaatttgagaatcatggtctaggcctcctatcccagctttgacagagtaaacccgcaccttgtctgtattacatattgcacctctacctgagatttcacttgaggaagaattcaaggactttaaaaaagtaaaaatcaatcaagacaagtgggaggttaggactctttaaaggctgttcattccaactgtaaagtcgaaggaagctggggtaggacactgcagatgctgagcttccaatgctggcccctggaaccctgcctctcagctgagaggaccgtcattcgccatcaactagcaccatttcacttctaaatacctttgctttcctcttccttttttctttctctttttagattggttatatattttgagctagtcaaaaaatgatttgcaaaagaaacaaggaaataagtaaactgaatgcccttaaaaactccatgtaaataaaaatactaagcaataaatctgtcagtcctgtcaaaatgagtatttttatggcacagcttgcttttcagggaagaatgttcaagtctgatagacgtttggaacaaagtacagctgtgggaaagagagaaatgtggtgattgatggtaaatatgtttttcaagtcaactgggtttcaaagacaaaatttggcagaaggtacagagggcttgtggtaacaacgcagtgacttgtgaggagaatgcaggtgaggcccagaaaccaaggaaggtatttttgaaaacatcagagaagtgtggaccataggccactctcaatggaatcacctggggtttgggtttcatatacagtttcgtgggccccaccccacgtgcatcaaagtcaggatatttagggggagctggatctcccaaagctctctaggtgattctcagacatgctgaagtttgataaccacgtttatttggatttttgttgttgttgttgttgttgttaaacaagtagccaagagttagctaaggaaatctcagaggaatgtaatcaatagagagctttgaaatcatcacttggcattgatgcactttctgaaagttgtagatgatggttctttagaagggatttctctatcataaagaattatgcaactatgttttctccgacatttgctctttatgttcaaggacactctttcctaaagagttttgctcaactctttagaaaatagtgtggagctgagcaattataaagcaaatttagtccatgtagggcactgatgagccaatttagatcaatgaaacttttcctctccgtggtgctttcttccctgaagaagaaactctggataattttttttaaagtcaatgcttcattcttcccatgttgacacaacatgagggataaaatagggaactctaagacaaacgtatttattttatttcacactttcttaaatacatggagctactctagccttatagagcttggatacaataacacaggtggcaatatatctatgtctttatatatactacagaggcaaaaactgccgtggtattttctccatgacactttctccatttactccaacctatgcttccttctgccttcccagaattcaataataacatctaattgaaaaattatttgttagtatactagttcaaataagattatgtgtacatctcttgaggaaagttatactacttttcatagcacccatagtacctaaaacaagcattcaaaaaatacctaagtgattgattgatttgaaaagttatattatcagttctatctttaagtcttcacttaaattttaagcatatatatacacacagataattatagggattagggattaatatatatacttatgtatacgtaaagtaatcttattggattaattttattagtgtatataaatttaacagacacagacacacacacacacacacacaaaacactgccacactgtttcaatgaatttgtcccttttaccaattttcttcaatcttatttagattaattctttgtctgagttgagttatataagggagggtcaaatattagctcctctcagtcatccaggctgaccctcagcttagatccagtttttgatggaaaaggggaagaggaaaaatagagtcattctattgccatttttgtggatattaacatacactgttccattgataggattctcgtgaagaatgcgccacgcatttattttaccctctgtgctcttgtgaccttttgtgcctttatcaaagcacacatgaccttctagttatctgcacttgtgtctatgttttagtcctcattataaagttcttgatagctagggccctgccttattcatcttccaacaggcccatgcatatagtaggcactcaataaatgttaacttggaaaacagtttacaaaaataaccctttttatagataaaaccaccagcgttctttgtctgtacaaggtgtttccaaggtttcccttctgagaaagttataaaaaagaatcaagttttgacatgatttctcatagaaaattttagaaaagagacaaggtaagatgaaatttacaaaaactataatggatacatgaagccagcatgcttgatatgtcttttttctcacttgacattccaattatgtctaaatcatgctggaatacaaaccactgagatcaattacgttcttttggcaggtcttatagagacaaatgataagggtttgacacccttcagctttagatggaaatctctggagcagcaggagaaaacaatagtgaccactgcacagaatgacaggccctagggattacagactacacttcggtttctaaaatgtctaggtttctggtgactttctcatacctttggtcattttgatgtatatttgcagagaaacacgcttttgccacatctctactaggaatatatagttacataatttgaagccatacaacattttttttttcatctgcagttagcattcatttatgcctttgcctcagctaatcaagtaatgtagggacccttattaaacatcctttaaacaggaaagtcaaatttttattagaaatctattatctattctcctgctcccaagccattgctcatttattcttcacaatatccaatacaaattccactgacacacaaaaacgtgaacagtctcttggtattttccccattgataacttcccaaaagttagtaacagatgactaaaaaacttgaaggctttctgctaccagaaagctctgctttttgtcctaaagtatctaaaaatggtaaatacagatgattatctctggaatgaagatgccaaaataaacataaaaatccgtaataaaatttggatgaacgaggagcaccattttggaacacaaacgcatttggatgcctttttcacactgactttttttatgggtgaagtacttgctcactgattgacaagtgacaggctagacaacatttctctgcagtctgacacttcggttgagcattatcaggcaaagtaatctctgatttcaatgtcaggagtctacatcctgaaaggtatggtatccccaactatgagtactacagttcatattgctcaaacacaaaaagtagaatcctagtattaaaaaacttaggtgatttaattactatttgggtagcatgaatctctttaactttgtcatgtttagtcattcatgatttagaaataaaatttgataatatttctaaagcaacaaaattaattacggaaagtgacaattttcattaattagtgactcattctaaactatgacagatgagaaacagaaaatccattatgccaatgagaaaaaaaatgggagtttgaccatttcttccaggtactatatgccatagagcagagatagggagaaagagactcaaacaagaatttaactgcaattatctcttagtttatccaaacccatttggattgtgatagatgcagtctgtctttttctatcctaagtaatctcaactacaaaaactaatcagttttgtcaattacaaattacttccaaagtgattgtcttttaaattcacattctagaagggaattcaaagataaaacataaagttcacacaggttaaaatgtaaggcttttttttactcctttaagattataaaatggaagtctctatagctgaatagttcttggatctgtattatttaagaatctttaaattaacttaaaacatttttaatcatatttaagttaccaaagtaattgaaaagatactgatgcagccctgaagtaaaggtttcataaacaggatgtatgtgttctctatatccaattctatttgtacaatggtgcacatttatatagatttgtttatatgatcacatagttgtagatttacatttatttgtagtgaaacatttccaacactgttggactttattagaaatcaaagaagaaatccttcctggtgaataaggtctaggtgggccattttttttttctcttaacataaagcacactactgcaagataatgttatttggaaatgatttttaaaattggctgcacatgtgtggctagacaatttcttatcaagctaaataaacatgattaaattcttgaagttattcaggtggcacagagaaacattctgccttcattttatcatgatgaatttataattgctttcctggagcaagagcacacttttatcataacactacatataaaatacaaaacttctctttagacttctattttcttaaccatttctaaatatttcttaaaatttttaaagttttaattttaaaacgtcttaagatcaaaaattatacttaattctttacctctgcactagttatgtgcataaactcatattctttgataatcagccattgttcacagttggtgtagatcccatatagattgtgcttttgcatattttgactataaaaaattacaacaaaaactgctaattaaagttaaaagaggatgatatttttggctgagcgtggtggctcacacctgtaatcccagcactttgggaggccagggtgggaggatcacgaggttaggagatcgagaccatcctggctaacacagtgaaaccctgtctctactaaaaatacaaaaaattagccaggggtggtggcaggtgcctgtagtcccagctacttgggaggcggaggaaggagaatggggtaaacccaggaggtggagcttacagtgagctgagattgcatcactgcactccagcctgggggacagcatgagattccatttcataaaaaaaaaaaaaaaaaaaaaaagaaaacatgatatttttgactcttaattttggggttgttgtataatggcctaggtaggaaaagggaaagaatccccatgacacggggttgatcagcttggacactggtttacaaccaggaatgcattgcttttgatttctttggaataccaatagtaataataataatactaaagtataatgaaaagaggaagctgaagacaactgaagtgcatttgaatatttacaaaacaatatcactgaagtactatatgaggaacactacagcacataccataaaacacatttcagtacatgttcatgatataccagcagggattctggcctgggatcttgggctgtgtggctttggacaaagcgcttaatttaaataatcttaatttaaataataatttaatttaaataatctaggtcccacccagttctaaaatacataacctttcctccatattaaagcaggaagggcaatctaagtattttaacgtatttatatttaacttattaaatattttaacattttcaaggtagacaatccaagatcatgataaataataggcacttagtcctggctttcattgtgtatacacctgagaaacctgaaatgctgaggtgaacagtgtacttttccatgagttttctgaaaaaacaaacaaacaaacaaaaaaacccagaaaaacaaaaggtgcattctgaatgcaaatttgtatctactttgtaggaataccataaaataatttgcaaactaaaaagtaagaaaaaagccaaagctaaaatctgtattaaaattattaagtttatttctgaaaaatagaacaaattgctagacttagagaaaggagaaccttggttaattttttttttcttttttttttttaagacagagtttcgctcttgttgcctaggctggagtacaatggcacaatcttggctcactgcaactgcaacctctgcctcctgggttcaagcgattatcctgcctcagcctcccaagtagctgggattacaggcacatgccaccacacctggctaatttttgtatttttagtagagatggggtttcgccatgttggtcaggctggtcttgaactcctgaactcaagtgatccacccgccttggcctcccaaagtgctgggattataggcatgagcctctgtgcctgacccttggttaaatttttaacaaaacaaagcacaattcagaatcttaaactctgggttggttgtaaacatagagaagtttgggtacatattctctttttaggttctgagctataaagtggaccaatatttactataaaatataatagtaatttaactaaatttaaatagttctgagctataaaatggaccaatatttactatcaaaatataatagtaatttaactaaatttgccagtaaactccaacttagagtttataaaaattattattattattattattattttttggtttcagagctttcgggtttgcagtgttaagctggaggctcaatgcctcttgttattcctcatttcacaaacataggttcatctactaactaggtaggcgtactgttttaatggcttatgtggagtactgggctgctgtcaaagatgaggaaggggatagggagagacgggatggtactgacttgccatgctcagtctctatttaaataaagcaggctgggtacaagagggatgggtacgagagggatggaggagggagcatcctgctgtaggtgagctcacttgtatttttgttttgtaatacttgtctacttactagacttactgtgagcatcttgagagtggcaattaattgtacgtttttcttttttacatcttaatgtttggcctagtacatggcacccaggaaacacttaatgtatatttataaaaggcatgaataaaagaccatcatctcatttggggctttcccctccccacaaatttcatgtgttaggggaattgattggattaggaagttccttacttaaaacatcaatggcttccctgggttttaccccctcaatctcactcacaccttaggatggtttattttgatctaataatctgcaagagtgcctggatttcagcatttgctcagtgggaagttggattggaggggagtgctgtgaagggggaatcttttctggggttgggggctttgggctgttgaaagtagcattaagagcctaacagaccaaggaaagggcatgaggggttcaacaggagtttacaaaggaccagagtagttaccattacagagatttgactttcccagcccgtctagagaagcctgatggcacgatctaccacatatcttcacagtggcttcgcaatgctggtgtttggaggccaagcctggaagctgaacaacccagcttctctgaagttaccaacctgaaccatctggtacagactggatgtgcttcatgtgttaaaactcaattcctgcttctccttactgggaggaggagaaggagatacgaagagaagaaaaaggagaccacagcctatgacctcctctcttttcctcaccctttttattatccgtgtagctttcatagaatttcccacttcacaggacatttagaatatgtttctctgttcttcaccacagccctcccatgacagacattttttagacaatttgttcatagcttgttttgatttgaggtcttggttgagctactgaaaacataatccactcataccctcgtttccaaacaggctttagggttcttccatggggcctggaaagttacctacccgccttcttctgagtatttatgcccaaaggccaggatgtccgatgcccgtccactcccatcacagacaaccactggcacgggaggggtgtctcgaaggtactccaaaacaatcgagatcacattgggtcctccttccactatgagtgccaccacaggaacaccttgaccgattcctgcattaaaaaaggaaaagaaaaggaaaaaaagagaaaagaacacaaagccagcaaaccaaagaaacaaaaagagaaacaaaaagcacaaactaaaattactgagcacgggggaggtagcaacatatgaagggatatggtactgagcaaaaatttacagaaaacccttcagccaaattttcccaccagaaagtctatttgactttgccctctcccctcaactctcaggatgctggggtcagtgaaggcacggggttccatactttacaggggagggcctggggtgaggagggagaaaaaggaattagtcaacagacaaagcaccagaccagcaaccaagagcgtggaagctgaacatgatctgaagcaagtcttttatctttccaatgagtctgtttcctatatgaaaagtaggaagttaaaaaatgccacctccctgaagttatcacaggggtaagaaaatccctacatggctctttttattaaacactatcaaaatcagctggggacatattttaacttgttgaatcaactactggctgaattctgggtctgtctttgaccatagatgatcagactgattattaattttttgtttttgagatggagtctcactctgttacccaggctggagtgcagtggcacaatctcagcacactgcaacttctgcttcccaggttcaagcaattctcctgcctcagtctcccaagtagctgggattataggcacgtccaccatgctcagctaatttttgtatgattattgattcttaacagcatgattgtcatgttgaattacccaggagatatggtatctgccatctgccattattgcatctgccactactgagcaaggagctaggcacgtgatgtgagttcagtaaacatttgttggattcagttgaattgtttcccaaaagtatttaagctatttatgctgagccagaagacattgctgttttcaggtgaaaattgctttaattgctgtatgcatcgttcaacctaaccttaaagagaagtaataaaatcaaatgtccatgagagacatgatgacaaagaaaaattcatttttaagtgacatttcaagtatgatttatcattgaataacttccttttgttcaatttggtatcacattgtattttttctctctgctgcctcagaataattaaggaattgagcagtaccataaaagtgagctggtcttagagggcgcacacagcagttatcttaaaaaagaaataatcaaaattctgtactacttccataaatataaactaaaataaaacaactcttggacatctgagttctcccttttacttcttttgctatgcttttatctgatatcaagaaactgcttccccgtaatgagtaatagtttaggatttggtttcttgctcgggtaaaggatatttttgacttatgtgacctgttttacttctaaagcataaatactttagtctcctagggctttatctcctttaacttgatgtttttcctggtgtgattttcatcttaaaagaatgatccaaaatgccagttacacaaaagtgggtgctgttttgcatgtccacttaaaacacgtaaaagaaaatgatgattgttgatcaaggcaagatgccaagatttctttcagttcctagagggaactgggagagacaagtgacctggggacccattcgttttctgtggatggggaggtcttgagaattactctttcaaatccaaggagagggaagtgaaaggccttgctgttctgttttgacccaggagcccttagtgactcaaatgctaggtctccttaaggctctcttcaggtgtctgtaaaggagacagtttccttattgctgcctattatgatgattgagtaaattcctgttgaaaggtactttaaagattaagggctggccaggcacagtggctcatgcctgtaatcccagcactttggaaggccaaggtgggcggatcaccaaaggccaggagtttgagaacagcctggccaacatggtgaaaccctgtcactactaaaaataccaaaaaaaaaaaaaaaaaaaaaaaattagctgggcgtggtggcaggcgcctgtaatcccagctacttgggaggctgaagctggagaattgcttgatcccgggaggcagaggctgtagtgagccaagatcacacgattgtgctccagcctgggcagcaagagtgaaactccatttcaaaaaataaaataaaaacaaaaaaagattaagggctaacttgaaatgttaacacaacatttctctttgggaggagaatttgctctcataaaaatatccaccccatagggatttgtattttataacatgccttcaaaaaggtagcctattttccattgttaaaggttattttatgaagtatttcccaaagtattacgttggtgcaaaagtaattgtgttttttgccatgctatttattttttcccttgatttgctttagcatatgctcctatgtcattgactttgtattaaggaacaataccctatacctgctgttttatatcagatgatatatttagaccccttctaggatcttctaagacatcctagaatttgccaagttctaggactcttggattctgtcggtggaatctttactccaactcacagaccaagtgtgatccactcagtgttctcgtggagggagaagtacttagcatggaccttctaccatgttccagtgatctggcatctacaagacagcaggaaagatggctggaaacctcctctccctttgagagcatacataatgaaaagaccaaatctcataggctgatttgtttgagagtaatacatggtcagtttattctctgtcaatatatttgtcaatgtatcaaaatattataacttctagaagtacagaaagattttcaggataatgatttcctatatttgaactgaaactaattaccaattaaaatgatgaaaacaaacgtattaatccagagctgaacacacacacacacatttagtcaaatttggtgccaaaaattgaacggagcaaactgtcatctttttcataaacattgaatatatctatgcttccaaattctctcttatttttttcagtgataatacacggacatttgttccatggataataaaagcctttatagggtacaaacaaaagcagttttgaatttcttagttatgagaggtagaaaatcaaactatgcctaaaactatcatgcttattgtaagttaaccaagatatgttaacattaaacctttctgtcaggtcacacacacacttacttacacacataaacgtattgtctttatttctggcaaaagaaaatgacatcagataactagtaatgacctgaagtagtctgtagcctattcttagaatatgtttgtgaattttatgaaagctagggaccctttctccagaaaagtaaacatacatgtgggtagacacaaaaatgtttctatgcaatttcagggactttttggattctttttttttttttttttttttttgctttttatttttttattttatttttttaatgttttaaatggtttattgaagaataacatatatacagaaaagtacacacattatctctaacaacaatacatatccacatagtgaacacactcatgtaacctccacccatatcaagaaatagaatattattagaaccctaagagggccccttgtccccgctaccagctactactctctcactatcctgacttttttttttttttttttaatatactttaagttttagggtacatatgcacattgtgcaggttagttacatatgtatacatgtgccatgctggtgcgctgcacccactaactcgtcatctagcattaggtatatctcccaatgctatccctcccccctccccccaccccaccacagtccccagagtgtgatgttccccttcctgtgtccacgtgttctcattgttcaattcccacctttatggattcttgaaacctaccttagctgatcataagcctatgaatactttgttaatggacccttgcaaaaccccaccctaaattaagcacattgatacatctgcaaagggcatctgtttgtgttgttttgtgaaactcactgaggcctctgacacaagttctaggataaattcttgaacaaaattctatgcccaggaggattatatcacattattactgcccagttatattgattggctaaaccttccacagtgaaacactgtgtatagcagtggtctccaacctttttgacaccagggactggtttcatggaagacaatttttccatggacgccggaagggggatggttttgggatggttcaagtgcattgcatttattatgcactttacttctattattattacattgtaatatataataaaataattatacaactcaccataatgtagaatcagtgggagccctgagcttgctttctcatctagggttcccatggtcccatctaggcatgatgggagactgtgacagatcatcaggcattaggttctcataaggagcacgcaacctagataccatatatgcacagttcacaatagggctcacgctcctatgcagctgatctgacaggaggcagagttcaggtgataatgtgagtgatggggagtgactgtaaatacagatgaagcttcgctcacttgccagccgctcacctatggcctggctcctaataggacatggaccggtaccagtctgtggacaggggattggggactcctggttaggatatcacccccactctctctccattctcctctttctttcttgtttttttttctgttcacactttttttctaaattacagctcaaacacaggatatttaaaaaactctagcaagattcacaatcttacaaattagaatctgcaggataagacttcatagaaaagaaacagctttttagaatgtcaagaatgctacattttttatttgtgacataaagaaaacattttgggaatccactgcatatccagctgggctggattcatagggctcactgccattttctttatgctcataaagaaactgatgtaagttcctttgaagagccttacaaatttgtgtctcgctcagctaaacctactggtcattcattgaaaacaaatgaataaaataaaaggttgtttagatttaatttaaaaaatacagtctgtaggaaaaaaaattacctagattctcccaggtcccttttttggtgaatacttgttctttggttttggaatgaagtaagccaattccttagttgattgcagtcatttttcattttctaccatcaccaaagacttgtcatagctctcagaactttccattagaattttatttgagagcaatataaggttgctttaagcaggaataggcaagatgcttgccacactctccagcttttgcaattttggaataggaaacattagagcatacgaaaatgtgagcttgagtaacagatttaacagctctgcgttctacagggttttaggttaccctagggctttctaattacatactgaaccctaagtccttgcataagataacctcttagacttttgtcacattttgtttcaactgctaggcaattcagccggggctcccaataaagctaaaagtgtctaaactgccataagaaaagactgggagaggcattgtgagggagagaggtgtcaggaatgaaagaatgtcttaaaattctaagcagtctttcttcttcttctctttattaacagcaattaactctctctgctgatatgaaaccataatctatgatcagcttagctatttgtgaaaacatttggtgtttaatagtaaaatgcctgggtaaaatttcaatcaaactaaattaactgttaggttttatgtcaaggtcacccacagatgatctaaagtgcgtatgggtctgaaggataatctatttgctgttggaaactggctcatatttacatggagatagagcatagaagatcattctctacctacatcttaatgactataggccacagatcatgattattacagtataggtcacttaaaaaggggatttgcactttaagtgagagataacttcctgaagatcttgaacaattcaatactaagtctatcagtggtggctagatacttgtgtttactagctaaagcatgtcccagtaacatgaacacagttagcaattccttgccttgccagctccagggttatgtgatttttgttgatttaaatgtctgtgtagagaattcatgtactttgacattatgcatccatggagagcaggcaagctattttgcctcattttaatgggtaacaaattaatacctacttgagaaataatggctgaagtttgcacactaccgcagctctttacaaatagtttcagaattcgattcttgatatctttaactaatgcatctcttctgtggtctggaaagtgtgagatgaatttatgaaaactacataaatctgataatcggttgtgcctgaaaacattcaaaagtatttttttttcttagtaagtttaaggtgcttcttacaattaggaagattcccagttgtgaatacatgaatattcaggtacaactgtggaaatattattgtacagacagagaatattttaatacattatatttttgcaaaaggaaatgtgactagaaagctttgagctattgaggagcagagtgagcccaagaaaacatctaggggtgacatttgaaaataaatgcatctcattttaactagaatgtctcttaggtcttctatggaggcaggtattttggatattgccttcacgttatagagttaggataaattattcaagacagcctaactataactggaatgtgtctgaccttacttgtaaatgggtaataaactcagatttcttttattgaaaatccatgaggtacccaattggtgaatgccagacccaatgcaaaccaatcctgtacgctatacatttttttgccattataatcttgcacctaaattgatgctcaggaaagcatttggaaataggaagtaccacacaagttattaaacagtcgacacgcaacaaaatgtttcacttctaaatacttatggttctctagacagaaagaaattccttgaaagatagcttgggtccttccctgaggttggaacttcccaaggcatatgtttccaacccactttgggactaagcaagggtaaaaataacatgaatttcttaaatgtctttttctcttattaccagtttctatggcaactcccttactgatagttaacttaatgaaccccctctatgtacaatcttttcatatttaaagctaataacaatactccagaataacatgcttgtatcttttatcttggcatgtgaaattttagcaaatttggctggagatatggggatgtcaagacactgaaaatatagagtttggattaattagaatgcctccctcacacagtgataaaaaattgaaaactgatggtgcatagtgtatcttttcctagggactgagaatgcagaatatattaaattaatatggcaaactgtatttttttctgtttgttttcaatacagctaaacaaatctattttgtgcattctcagtgctcgaggcattttcacagcaatcctgtattaatgcccatcgactggccttcttttggggcattgccttcttgctttgcttttctatctagtaatcggaggacaaaggacagaagctgggcagtggatgagtagattgaatgggaaatcctttaagctggccaaagaggtcactgtggcatgtgtactgaaaactctcatggtgtccgccctatcccctctcccctgtcagagaacagacccatccactgcatagaaggcgcagccctgcttgacttttttcaaagctggctggacttacatggatgtcagacctgcagtgagccagatttgctttcctgggattgaagtggagatcctgagcccaaggccagtaactgggagatgggcttccagggcatgcatacttggggaatgaagcctctgttagtggtggtcctccagaccaaccatgtgaggaaggtaagccaatgaacaaaaaagccatatgcaggtagaaaacaaaggagcagagggtaccatggaggggagagatcacatggccccaggaagagggaaggaagtggtatgggggaggaaggagagagagaggggagagaaaagagaaagaatctatgaaagagagggaaaaagagggagagagagagaataaaagagaatgaaagaaagcagagagagggcatctgtgaaagagaggaagagagaataaaagagggacagaggaagagagaagggaggggaaacaaagggagacaggagagagagaaagaggtggagagacagaaagacagagagagagagagagagagagagaactgatatagctgggattattggtaacttttcaggcctatttatagtcacttgtccatggttcctgcagagagtcccctattcaccaggggtagatagttttttgcgtaaaggctacatagtaaatattaatattttagacattgtaggccaaagggtaaaatagagaaaattgtgcaggtgcttacataataagagagaaaaaaattctactcaattttgtataattaaaattcaaaatacaactgaatatatatatatgttttaaaatacaggcttactaataaaaatggaatttttgtataaatgctgacgtttgaatttcatttagttttcatgccacaaaatattattcttttatttacaaacatttaaaaatataaaataacttcttagcccatgagctaaataaaaatagggtgggctataatttgccaactcttcctacagacatgtttctgcctccttataaagaatacccatttatggttgggcacaatggcttatgccgtaatcccagctctttgggagaccgaggcgggaggatcatttgagcccaggaattcaggatcagcctgggaaatatagcaagaacctgtctctacaaaaatatttttaaaaattagtggggtttgatgcatgtgcctgtagtcccagctactcaggaccctgaggtaggagaatcacttgagcctgggaagtcgaggctgcagtgagccctgagggtgccattgcaccaaagcctcagtgacagagtgaggctttgtctcaaaaaaaaaaaaaaatatatatatatatatatatataaaacacatatgtatatgtatgcatataaacacatataaacatacatacatatatacatacatatatatacccctttatgtactttgcatgagattatcatgatcaaacattcctcttcccggctgccactctgcttgctctaaggcagtcttcacctgtcttttatcctgaaggtccacatgagctgttttgtaactatgaaaacctggcaggaaaagagtcaagacagtccctcacttagaatgattcaacttgcaatttttcaactttgcagtgatgcaaaagtgatacatatttagtagaaatcatacttctagtactcataccaccattcgtctttcattttcaataaattacatgaaatattcaacactttgttatataatagactttgtgttagatgattgtacccatgtgttggctcatgtaaacgctctgggtacatttaagtaagctaggctgtgctacgatgtttggcaagttgtgtattagctgtgttttcaacttaaaatcgtttgattggacataaccccatcataattggagcagcgtctgtacttggacttgagggtccttcatatgagaatttgggatagcagatttttttttttaagtgggactttaagatgaactattcaggtcaatgctgagtgcagtcccaataccctgtttagtgtcaggaggggcttcctttccagcataactcatgatcgtgtgggaagactgtttactatatgggaagctactctccatctctcacgtaaagagaaaaggagtcacctgtgtggtttatcaagaaacttcaccctgataatgaagggcttaaatcaggtctttccaaaggtctaagacccagggcagagagagcaatcactcctctctgaatatccccagcttctggagagcagcaccaccttctacattccagtgaggcttggccttttgcctgctcccttcctggcaacatggaccccaagacttgcttgattgcagtgggccttcctgaagggctttgcccctcaccactcccatctccatcctgcactctggaagccttggctagtctcactctctcggaggaggcttttccttaggctttgggctgcctgtttgcatctgggcagaatcttctgtattctcattctcagtttctgctttctaggtccatgattgtctttttccccatgtgcctgctggctcccgtcgactcccactttccctgattcactctcagcatgtgctgctctatctattttatctccctgctactgtaaacccccacagccttgctggactttacaaagctaacgacatataagctggagccattcacatcctagaagggcagaaatgcatcttgacatatgttgatacataaaaagtatacagttggccttctgcatccgtgggttctacatctgtggcctcaactaacaaaagatcaaaaatattctgaaaaaaaattattcctatactgaatacatacagacatttttctttgtcctcattccctaaacaataaagcgtaacgactattgatgtagcatttacattatattaggtaccataagtaatctaggggttatttaagatatctggaagggtgtgcatagcctatatgaaaacactattttatacaagggacttgagcatcctcagattttggtatctgtgggagattttggaaccaatcccccatggacattgaggggtgtttgcatattgatattctatacagcatttaatacacagagtaggtatataattcacaaaactgttttgaataatacatgaattattatttataaagcacttagagcctggcacttaagagttttatgcttaaacacaaatataaagatgcttatttatatctattaagcttatacaaagtttctcgtttgaatgtataaatgattcatgaagagaaaagaaaaatgaatgcattttacacatttaaactgaaagaaggctctggcaaacaaataatttgaaatagccctctccaaagtttgaataccctcttatgcagactgataatatgccaaattatccaattcccttctcgtgtgtccaaaaggctaactcttcctgctttgggataggtggccttttgcatcacgccccgaacgtcttcccccaggggcctctccttattcatcaaccagcttgttaagtctttcgagttctgtgggttggaaggagatgtaaatgctaaataacaaaacccataaaccaactccaagtgtattatatacccagacgataacttagctttttacataatcaatgggagctgttattcccttgtggccagatggctctgattgaaatattccgctattaatgtcaatacattaccaggacatccaagcagcattcctctgaataatttcaatagaaaaaggatggccaatcccttgggctgtaagacaagtattattttcataaaagggaaaagccaacattattttctttggagccattgtttgaaggctgaatcttttaatgtaatcgatctaagtctacaagaaaactctcccaaacaaagctctagtcttagtctctgctctgtgcaaaacccacatcaaaagtcagatgttgccttctcagatgtaatcagggtggttttagctcattttactttataatacgctacccatgttcccctgcaaatgttccaggatctaagtccatagcccatacaagttccttggcttcttgacaaaattaataaggagcaaagcagctaagggaattatggatcggaaaatcacagaaaagacctggcccatgtttcagggacgagctaggcaggaaggtggatggttgcagtgagggaaatgttgctggtggtatgcatgttaatttgcttttttcaaattataaaaataatttttgtctttgtacctactgaaagagacagcaattacttctacctgtcccaaatgcaaaaagctccattttctcttcaaggaattttgtttttgatgttgtctctgcgaggaacatattcatccttcaggtcccaggttcaaagacattctcattgtgtgttctcatagcattttctttttaaaagaagcacatgccaatgaacatcctttataaatttgtcaatcaactatgatggtattaaagaaaaacttcttatagtgccttacatatagcttttgaagttttatcacattaattacatgagtaatgacttttgatgtgggttttgaacagagcagagatgtctaggcatctcttttctctattaggtatttatttctgtattaccaacatatcatacaatgctctacatgtcgtagttgctctctgacatttggggtacaaaggaaggcagggggctgggcatggtggctcatgcctgtaatcccagcactttgggaggcctaggcaggaggatcacttgagcccaggagttcaagaccagcctggaaaacatagggagatcttgtctctacaaaaaaatttaaaagttagctgggcatggtggtatatacctttagtcccagctactttggaggctgaggtgggaggattgcttgagcccaggaggtcgaggctgaagtgagctgtgattgtgccactgtgcttcagcctgggtgatagagtgagatcttgtctcttgaaaaaacaaaaaggtagataggttaaatgacaacgtaattatttccacgtaaattttaaaattatttatgataggagtaattttctcctcatcaactgacctgagatgcaaagtagacagatgcaatttaaattctcatgaaatcaggaattataccaaatgcccagcgtctgtgctcattggttttcctgtgggctactgagattacttcctacctgacttccctaatataatgatcttcacttaactgctagctgtcactcacaattacagtctttctgtaaaaatgtagtgggtttttaggaaaggcccattgtttttaggaaaagcccactcctttagtgtgatatacaagactctccttgttctgcacccaaccttcgtctccccatctcttccagagctctctctctacctgatctgagtctcaccagactatcctcaccatcttccatgcaggatgatttttaaactttccttcagccacaccaattttcagatgagtatctttcctcactcctggtttcaagagaaggaatttttcctatgcacacccttggacgttctctgcccctttactcacttggccacccggtgaatttgaaaagactaacggtttgctcagctctgcctggctctgcttcttcttggcatctgcctactttcagagaacctgagatccctcagctcctccaggaacccagaccctgaagatgtgcagtgaggtgagcaggtgaagactcaccgtgggattctgcccaattttggagtgtcattaaacccacttggccaataaaactaaagtcccatctgttcacttgtccactataagtaattttcagtcatatcttgggttccaccaagtacttcttttatttctcaaattggtcagaacttggatgcagaaaaggagtactatttctttctttctttatatcttgagatagggtctcactccatcacccaggttggagtgcagtggcatgatcttggctcactgccgcctcgacttcccaggctcaaccgatcctccaacatcagcctacagagtagctgagaccacaggcaggcaccaccacacccggctaatttctatattttgtgtagagacagagtttcgccatgttgcccaggctggtctagaactcctgggctcaagtgatctgcctgccttgacctctcaaagttttgggattacaggtgtgaaccaccatgcctgggcccctcggggtactatttactttagcccctcagagacccctaagtcaaacttcatagttcaaatattaccagttcctgaggccctttttaacttcctcagcaagtattaattattcattactttatgatcccatttttttaaaagaatgtcttttggtgattattgtattctgccttgctttaaggagagcttcttccacttaactgtaagtaagctcattctgacagactccccagccctctcagataacattctggttcttacagtgcctcacactcaaaaggtagtttaaatacatgcttgtgaagtaaaacaaaaataaaaaggtacaatgcttaggatcataccttaggactagaagagctaaagggacaggaataacgtgataatcattaaggggttgcctgtcatacctcaacactgttggaaggtatcctgctgaaatggagatgacagccatttgggtggcttcatggtgtccttttacaggccttaactacggggcctcagcagtggtcagagacctagagaagaacatgctgagtgccttgggtgggtgtttccatttcacctgtccatctggattacatctgaaagagcccagattcttagggactcgaacagccaatttcagttcagctgtcctgcacttttaaattgaagcctcaaattgaagcctcattgtttctcagaattgaacccagctaaagcgacaaagtatctcggtcaccagggagaaaacattaacaaaggtttacattcttccccttgctggaaggatgtctacaaaactattatttcctccagcggaaatgaacaggaactatatgactgaaatggaaacctaattctgttcccactgaggtgattggtatgttttcacagctcaagtgctgtaagctaggggtgaccttcattcaccaccaaggtcattaaagtaaccattatcatagatgagacaaaggaaaggcaatgattattctggatctagtaatggtatttcatccaatttctgatccacagttgggaaaagtgataaattgttatttgattatctggacatcttttgagaaaaataacttgttaagtctaatctgatcgaatctttcctgtgactaaatcctcagtgagaaatatgggtgacaacactgtggggaaccttctttcctctggaaaaggagctccctccttgtttccatgtgcagggagctccattagaatggcacatctagcctcttgtctttcctttacttctctccacatatagaattgaataacctgatagttggtgactattgtgtttcttgattggatagagctaatcctgcagtaatgggaaaattagcttatttcttcctttccctccagggaccagtgccagtcagtcatcttggtaaaaaatgtctgctacagacccatctttcttctctggtggggtttcttggagctgaggcaggccagcaaatccatttgaccctcacactaagtcattaactccaacaacttcatcattaataaaaatgatattttgatctccacctgcctgactctctagctctcagtcaatttgaagacttgatacttgattgtatccagtcaagagtgggatacagtttactgggtctctccaaactccaataccacgaactgcaatacagtcatttctgtttctgacatttgctttgcagcagcattgaacaaagttgagcctctggttcaacactgaacatgaactatttttttcaagtacaaatatgactttctctgaaagacaattttttcttgatgtccttaatacatgtcttagaaagaaaaaacaactgcaacatggcaacatgttaaaaaaggtcattacaaatggaactaaaacaaagttgcttgtgaatttctgggttgtagtggatgatttaatgtaatgaagtccactgggccagttgaatgtagatagtttatacctgtcatcccagagtaattattctggatgaattaatattattctctctccctaaggggaagtagccattgctgagcacctgccgggtgtcaggcactcagccaggtgggttgcatatcttactcaatctgctcaacaaccttctgatagagatatagttgacccttgaacaacatgggtttgaactgcatggggccacttatatgtagattttcttctacctctgccacttcatgagacagcaagaccaaccctcctcttcttctttcttctcagcctactcggtatgaagatgatgaggatgaagaccttcatgatgacccacttctacttagtgaatagtaatatattttcttttcctcttccttattattttcttaatatgatttcctttagcttactttattgtaagaatacagtatataatatacaaaatatgtgttaattggtggtttatgttatagataagacttctgatcaacagtaggctatcaatagtatttttttttgagaagtcgaaagttacacacgaatttttgactaaccctctaagggcagcattgttcaagggtcaactctatggttatttccattttacagttaagcaaactgaggcataaaggataaattgcaaaattcacacaactagtaagtgtcagaaatgggtttcaagcaaagtcctgttaggaaatctacagtctgaattcttggtgctctactgagttgtctctcactgaggtgaccacagaatttatcatacaattaggacatacttgcaagtgaaggggtcattattaataattactctgggatgaaaggtataaactagagttatttgatcctgaacaaatcagtatatacagtcactctaccttgctcataccttagggtctcaaactggtttctggtagcttttaaatatagatacaaatctcaaatatttaaaaagggacctgagtttattcattgcttcttgtctttctggcttaaaagggccaaggctcaccgttgcccctccctggtttcctgggatcaagtttctcgctccgtctaaatcacagctgttcattatcagagctatttctttctctagctacatggaaatgaagctccagggaaggattagatcattaagcaaaggaaaacagcagcaatacagcagcacctgcataaatcttataaggggaaaatataaattaattctttttttcatgttctagcatatccttgatggtgctggaaataaatcccttctacttttctctcttataaatgaatgcctcatccagaaatgagatgatgaggcatcaggagacagtcatggcctagagacatgcaatgggtgctttgggtccttaatcactcgagtatttaacctcatatcctactttgtcttgtctgtgaaacagctacttgcttctttctactgctgccaccaaggatctatttgattgcaacaataagggctaataccattactgtagaaagtagactatcttaatgttataaataagaaagtggcactttaaggactgctcttaaaaccccgattctaatgtgcaaaaactaattcgttcactgaaaactatcccaagaaggggtgtgtagaaatctccacttcaaatgtctctcaattttagcatgcatcagaattccctgaaggaggagctattaaaacacccacactgctggaccccacctccagagcttctgatcagcaggtctagaataagacctgagaatgtacatttcaaggaagtttccaagtgatgctattgttgctggtcccaggaccatactttgagaacagtgtcctagcgtaaagctgcagggaaaggagatttttgcctgtgaaaagaagtgaaatctaaaaagtgcttcctggagcaaattaatgcaaaagtccatggaatgagattgaaataaccatgaacaatattttttccagaagtctattttaaagtctaaaccaggcatcagcaaatttttttctataaagggtcaaatagcaaatattttctgttttcaggccagatggactcttgtaactactcaactctgtggttacagtgtgaaagcagccagagacatcacataaagaatgagcatgactatgttgcaataaacctttacttacaaaaacagatgatggcacgctggatttggcccactagttgtagtttgttcacctctgggtttaatgtgataaattacataaggaaacatatattagtctgttaagtctgagtgtgcctgtgatcaatgagaaactaaccaagttggaaatctggctgtataagccaatttttgatgcctattttggttgtacaggattgatacaataagcactcttattatagaggcaaagagtgggagacatgcaccattcttgcaattcagtccctaaaactagccgtttgggactatttgaaaacaaacatgctacgattcgaccctattttaatagggatttcactgcactagtaaaatttgcctagctatatatttagtacatttactatttggtgctttgcctaaaagtaaagaatatattttctgtgtagcaggctaatttattgagctgttaattaattcaggttttgttttccatttgtttttccttcttctcatttcaaaagaggccactagggtgtctattctcaggagaggtttgtgttgctggccagagctgctagaaaacagaacttgcctggagaaattttgtaaaaaaaaaaaaaaaaaaaaaaaaaacaaaggcccaactccaccaattttctgaaggggaagaagagaagggcaagtgtctttgatgggggagaagtgggagcagatgagatgcggaagaaatgatctgagccttggatggggggcaagaagggactcgcagcatccttgcatccttgacagtcagtccccaggtctcttcctacttggcccgtcagtagcattagacacagttgaccatttcattccttcctcttggaaatacactcttcactttggcttccagacagtgttgaaggaaaccagaatattccattctaaaatatgcctctttgacataaatatttttatgatacaattttttaaaattatagaaagggctgcctgagctccgccccccaccgccaccgtttttgttgttttttttttttttttttgagacggagtctcgctcagcctgggctggagtgcagtggtgcgatctcggctcactgcaagctccgcctcccaggttcatgcttttctcctgcctcagcctccagagtagctgggaccacaggcgcccgccactacacccggccaattttttttgtatttttagcaaagacggggtttcaccgtgttagccaggatggtctcgatctcctgacctcgtgatcagtccgtctcggcctcccaaagtgctgggattacaggcatgagccaccacgcccggccgagctccccttttttacctatagcaagccacaacaattcctggagtgcttctgccttgcctctgtttacctaaaagcagaattacgaagacaaaaggtctttctaccctcctcactcccacctctcccacctgaaaataagatagaagttctctttgaacagacctttatcacctcagagaggagctagagtgaggaagtcttactccccatcaatttaccttcccacattttcccacctctaggagactaggactgccttcctctttgccttgtccctttctcaaaatgtactgttctggccaggcatggtggctcatgcctgtaatctcagcactttgggaggccgaggcgggtggatcacttgaggccaccagttcgagatcagcctgaccaacatggcaaaaccctagttctacaaagaaaaaaaaattaactgggcttggtggcaggcacctgtaaccccagctacttgggaggctgaggcaggagaatcccttgaactcaggaggcagaggttgcactgagccgagattgcactactgggcaacagagcaagactccatctcaaaaacaaacaaagaaacaaaacaaaacaaaacaaaacccaaaaaactactgttctttattggatatactatgtaagtagacttataaaccactgcttttgaacacatcccttgtgtggtgtgcactgcatgtgttaataaagttgtttgtttttctctttctctcattaatttcttttgttatagaggtttgtctcagctacaaacttacaagggttaaagaaaattctattttctccccttcagtgctctctcccagtttctctgttacctcactagctgctccttcttcctcttctttgctatttcctccttacctacctgacgtctgacactaagactgtcccaaaactcagttcttggtttcctttcctcccctccccttcccttcccttctcttctccccttgtcttccccacgactctatttgaaatttcggctcctactctgcactccctttctgccttctcttctttctatctctccttagcccttaccactattcaatacactatatattttacttattttctatcccctcccctgcaaatgcaagctccgtaaaagcaggaattatgcaggcaacttgtctgacagggactgctgtgaagtccaccatggcatgctgaacctgaagctgctgaactctgctggccagtgatgccagctgcagccagggtcccactggttttactttagcatgggagtaccagagccacccactttgcagagatcaagcaagcttggacaattattttatcagtggttactttggctgacaaaagttaagaggctctatcttaacattccaagtactctgtaagcacgagagaaggagcatgatcatgaaagagagggagaagagaggcagaggaaggaggagggtggggtgagagagagactggggtgggggaggtggtggtggggggagacagagagagacagagagacagagagagacagagagacctaatgaaggttaagattgactttacctcacgaggtcaggagatcgagaccatcctggctaacacggtgagaccccatctctactaaaaatacaaaaattagccgggcatagtggcgggcgcctgtagtcccagctactcgggaggctaaggcaggagaatggcgtgaacccgggaggcggagcttgcagtgagccgagattgcggcactgcactccaacctgggcgacagagccagactccatctcgaaaaaaaaaaaaaaaaaaaaaaaaaaaagattgactttaccacaaaccaggtggaaagggtcttggaattgggtttatttgaataaaagaaaatgtttaccaagtgacatttcctacatacctaagtttatgaacaataattcatacaccctataagagttcttattacttgaataatgaaaaaaataaacaaaagaaaacaaatcctgctttacatgtgcaaaaatagaatctaagaatggaaatagaaagatgaagtgaactttctacttctccccaaactcttcatgcaggcacaccatgtttaattgctgcttatttctcagcctcccccaggattttataataaattctaacatgcaccagagtcagtgtgcacttcctctgttctccctttgggtggaagaaatgctgctaatgaggaagggctcagctcagatttgtttgatgaccagaaaagctgactcttcaatcttcctccctgttttagcacaggcacacctgttttttcaccctgcctcgttccagcaggaattgcccagtaccccatgtgaacccagcgacgccaaggctccttagccaatgagagttcttcattcttctgcctgcgatttaggacttgaatgtttgcctgctgggctgcagcacgtgaaactcattacgcagctttgaaacctggcctccaacacagaaggagaacagcctgttcatgaggagaagtgctgtttgtttcagctatgggtgccaaaaaagaaaaaaaaatcaactgttccttatttggccattttagggcataaaatctctgttttcctcatttgcctcaggggctcatgatcctgagctgggatcttaaggggttcaaggttaacaagtttttggccgggacggtggctcacgcctgtaatcccagcactttcggaggatgaggcaggtggatcacaaggtaaggagtttgagaccagcctggccaatatggtgaaacccagtctctactacaaatacaagaattagctgggcttggtggtgcacgcctatagcccagctactcgggaggctgaggcagaagaatcgctggaacacgggaggcgggggttgcagtgagctgagatcatgccactgcactccagcctgggtgacagagctagactccgtctcaaaaataaaataaaataaaataaaataaaataaaaagaaaaaagtttttattctgttaacagctatgacaactttattagtgacatctgggagcactatttatagtcatttcccaagactatatgaatgattcttcagttttacatccattagtttcaatgacttgacatgatctaaataataatttgaagagacaaataattataaatcctaagaagggactttgaagggtcctatgataaagtccctggttttaagatgattatctcaagcaaattaaaatctcagctcacttttctttaagatccccagggaatgagacaccttatcttccctaaatatatctcactataaaactgttgatcatggcagaaaactgctcggtcagcataagttttcccattaattttatgtgtgtctaactttctaaagttagccatgcacttctactaaatggaatgatcctgatctggactgaaaagcaaccatgggcaattatcattttgaataaatggaggaaaatcaatagttatttctttttccatggaaatggaaatactgaggccacggtgcactggctgctgtaaaatatgtatcattagactctctaaattcataagatataaatgatttacaacaatcataattcaacaggaacacagtcaactttctcagactaaatgcttttatgcccatgaattggaagtatgcatgatggtctttgcttgtacatgttgctatttatttatcctgagtctttctatgtcattattgctttatgatttgtccttttttatagctttttagtatctagtcgcttctattacatctttgtgtcaggttgaaaatcagagctaaaaataaagccagggaaatcaaacagtgatgcttataataacaagttattgagcacctacttgcataggctaggcactatgcaaggttttcagaatgaccacaatgaataagacacaggctgtgctctataggatctcacaatctacagaagatgagagactgtgaaggcagatgggagactatgaaggctccattctaccaaaaggagctgtatgtgggagaggctgatatagagcacagcaagagcatggaggatgaggtgaatgtgggcccaggaggataccagggtatgagctggagggaatactagggatgggagttgtggtaagattacagagaggagaagatttttaatctgagacttgaaggaatttaggttttggccaggtagttagagtgagaagagaatgaaattttagtaaatgtcagaaagagacaaaaccacatccagtagggtatatcatttaagggaaactgtaagtatcttgaaatggatgggacatacgatctacatggtgttatgttaggagaagctataaaaacagatgaaaaatatgaaaggtagttagcaatgaaataaggaagatattgggttccatcaagataacaggttcctatgttatgctaggaacctattgtatctgaccaacaacagtaaacattgctgactttgagaccaaaatgccagtcaaacattggcaacccaaatctttctaatctgaaaagggagctcaaaattcttccctgaatgtaaaagtgtctaagaagtcttagaatggtggacagctctcctgttgggacctacttgtttacaagaactatcccagtccctgaacaactaattccaatgtagaaaagtctctttgctgaaaaaagggaggtctttagcttgaataggaaaatgggtgagataaacatgacaagtcaataccaagaaaccagtttcgctaaaatttgctctgttccctcaaagttatttttttggcttcattattacctttattgacaaagtaacttttcattaacaagcatgacaaatatttcagttacacagccaactgtgtcaagtcgtttcatataatgaaaaagcagggatatagattgtgttgtttattcctcacaaattattctttagagggaagaccctctaaaaggcggagaaagctttaaacatgtttacttgacagcacctgaaaaatgatgtcattacagtctaaagtgaactgatcatcaatttggtatttgtgttttggaaggcctttcccttgactgtttgaggcagtagaaagtttgcatgattgggctgaacagattgtagcacccacagaaggaaataagatgttcttgatatacagtcatgtgttgcataatgacactttggtcaatgacagaccacaaatacaatggtggtcccataaggtagtaatagagctgaaaaagtcctatcacctagtgacatcttgatgattctgaccctgtgcaggcctagtttaatgagtgtgtttgtgtcttcatttttaagaaaaaagtttaaaaaatacaaagataaaaaattttaaagacagaaaaaagctcatagaataagcaaatgaagaaaatatttttgtatagctgcataatgtgcttatgttttaagctaagtattattgcaaaatagtctaaaagttttaaaacgttaaaaagtttacaaagtaaaaaagttacagtcagctaaggttaatttagttttgaagaaataaaatttaaaaaataaatttagtatagcctaattatacagtgtttataaagtttacagtagtatacaaaaatattctagcactcactcagtgactcacccagagcaacttccagtcctgcaagcaccattcatggtaagtgccctattaaggtgtactatttgtatcttttatactatgtttttattgtgtcttttctatgtttagatacacaaatacttaccatcgtgttacagttgcctacagtattcactaccacatagtaacatgctatacaggtttgtagcctacaagcaataggctatactatatagcctaggtgtgtagtaggttataccttctaggtttgtataagtacactctatgatgttcatgacaaaatcacctaatgattcatttctgaggatatagtaaccccatcgttaagcaatgcatgacagtatatgtaacctgtccaggggaatctttgcttccttttcaagtcacatggtttggacccagaactattagtctttgagagtatatttcactccttcctaattccagagctgcttggatgaagttctactatgacctttaacatacagtgtttttcatctctcttatgggacagttatgggcccaatgatggaaaatttcatgtcatggttatcccaatgcatttgatgatggtgcaatgatcaaaaaagatgccagtgatgacaattgaacgtccctttgccttcccagcctccttcatatattctcaggcataggatgacaaagggaagtccacgagtcacatgaagaaagactgtagccatgggtacgcgatcaggaagtcctctgcttgcctccacccccaccctcctttccatcaccctgtcctatgggtacatgatcaggaggtcctctgcttgcctccacccccaccctcctctccatcaccctgtcctatgggtacatgatcaggaggtcctctgcttgcctccaccctcaccctcctctccatcaccctgtcctgtgggtaaatgatcaggaggccctctgcttgcctccaaccccaccctcctctccatcaccctgtcctatggatacacgatcaggaggtcctcttcttgcctccaaccccaccctcctctccatcgccctgttctatgggtacatgatcaggaggtcctctgcttgcctccatccccacgctcctctccagcaccctgttgtatttcttcctaatattgtttctccaccatcttgcaactaaccaccatcttcttcccaaagttttgcttgatgactcattccaactgaatcaatgctcaacctatatttggcacagagttggtgctcaaatagttgctgaatggaataatgaccctcaaactctccaaggtaaccaaactttaggggagcctttttaaaaaaatgagataatgcttccatgtgtaggatgaaaggagaaagtattttggaattatgtcagcctaggtttgcacccagctgtgccactaattggatttaaggcaaaggcttaacctcttggaggtgccatttcatcaactgtataaaaggaagaaaataatccctatcttgaagggtttttgtgagtattaaaagagatagtatatatgaaaatgcctagcatggtgcttggaacctaaataaatgctcattccctcctagtagtatcccaatagtgccgtcaagctgtcctatatggtatctttaggatgataaataatagggagtaactaatttctgatgtggttgaatgtcagaagagatagagataaaacaacagtcatagggagtgatactgttaggaaattataaaggaaatgaagacttctgtggttaatttcttggagtttaagaagaaattcacattttccattaattatacttaccaactgagtctaactggcaactaccccaaaatgaataaaacaagcgggagtcaagagagaaaaacggcaggcatcctgtcaaaaaataaaatctttgaaatttctacaccctgtggttgcatacacattttattaaagcagatggattacccaatttacataaatttatatacgtgatggcaactcaagttgcacagtgaaacctatgtagagcatcatccagcccttctgcaccagctatatcttgtcttatcactccttcaactggacaggtccttaaaaatcatagctctttgctggaggaagtatcattctttattctcttccagcctagatagcttctgtggtgtggaaagggtcaaatgagttaatatctgttaagtgcttgtactgatgcttagaacttagtaaaacctcaagaaatcttagttgttgttatattaattataatgataattatgaatcttccaattctgtgttttccaggagacgataggaattgaattctttccttccctccttttaataacattttcctgatttctagagaaataagtgttctagtttcaagtgtttagctacttttgacttaaaagaactatccatttagaggctaatctacccagtttcttttcttttctttttaaaagaggaattgaaacaaagctaacatgttactcaacatgcataatattattaattggactgattcctctttctctctctggccaaggtatagatataaatatatctacatctatgactatgtctacatatcttccaaaaaagtcatcaaaaccatttcagtataattggcaggtttcctaccaatttggttattgtttcccaaactaggagataaacttaatggtaatatcatatttctggagttgctaagcaagctagcctttggtcagatggtctcagaggaggaccccatgagtatgaacagctctgctctgccttcattttgttccttccttagagacagcattaagggaagatcccaaatcctcaagttagatctctagaccctagcttcctaggatcaagctagactttgagagcagcctcacttgtggcaaatattgggaagtaggagtttggcagctggtagctggctggtgagaggcatgtaggaactcacccacttttcatgaaacatcaacatcacttggttatatgtcagcacccataccctggcaaagctgccttctcataagaatgtactcactggggaaaatgcaaagcaatatcacttgaagcacagcctctaagggttggttcctctggattctcaatagtttgtaaaatggccaaccaagagcaactactgtacattttccagagagttcctaattaatgtgtttctgaggacataaattcggcttttaagcacatactccccaggccattctagcactgtgtatggcaattagactgctggcttaatactatcagcaaagtttcaaatagacaacaccacaaaccctcctggaaatttagcacaagcacttgttaatggaaccaagcacaacattggcttagctatgtctttcctgcagagtgaatggcatgctggtattttcagcttctttttcccccatttatcaaactctaatgaaaaaaaattaagtaatactttagtgaaggtcaagtggggtgagattagtggtactatggttaaaaatggaaatctctggatagcaggtatgtgttatgtccgcaaattgtctcaatattttcttaattacctttcaggacacaatagaaaaaaatggtcttaagggggaaaattaggaataaaaagtgaaactaaggtagtgacacaaggctgggcaaagaagagcagacaaggagtttagagttcaggttcagataaaagctctaccaaggtaattcacgtaatgaatttagtcagaacacgtgactgtgattttttttacaagtggctttcctatctgcaagatgaaagcaatgcgctaagtgatgctcattgtctgaattcctgtagcactttatattactaaagggcacttaacatctactgctttgtactattcacaatagcaaagacatggaatcaacccgggtgctcatcagtggtggattggataaagaaaatgtgatacatatacaccagggaatactatgcagccataaaaaagaataaaatcattatgtcctctgtagcaacatggatatagttgaagttggagtcattatcctaggcaaattaacataaaaacagaaaaccaaatatcacaaattctcacttataagtgggggctaaatcttgggtgcatacaaacataaagacagaaataatagacactagggactccaaaaggaggcaggggctgaaaatcttcctattgagtactgtgttcattatctggggtgatgggatcaatagaagcccaaacctcagcatcatgcaatatacgcttgtaacaaaactgtacctgcacctcccgaaactaaaataaaaattagagaaaaaaaacacttgctgctttataatgcagctctttgcatacagagaggctgtagagcacagtggttgaggcatgggctaagaggcatacttcttgagcgtgctatttactagcagtctgaccttgtgcctctttgtgcttcattttgtttctggtaaatgggagtaataaaggtatccccttaagggttgtcataagaactaaatcagttatttcttgtaaattgtttacaatagcactcaatcaacactagttgttattaacttatttgtaagactaagctcttcaagtatacagctataccttatttatcttgctacccctacagtgccttgagcattacagatgcaccagcaaatacagtagagaaagcgcttaataaaaagtactgtcaagagaagatataacagagagcagtcacaatttattttaaataacagatattttgagttcttatttttgccacatcttaaaaagctgaagaagtttgacatgtgtttagcttccacatgaggtgtcttagaagttcagtggggtggagtacagagagaagcacgtttttcatggtgagcacacagacaatattgaccgtgaaaccagcggtatatgagctgcaccataacgggttgtaggacactggggaaagggagctggactttggggtgcctaggaacatgatgaaggagcacgatggacaattttagctccactagattgttctcatgatatggatgtaaacatgggacattttcagtatctccaatataatagtatatctggctacagctaagaattgggaatacacctaggcttttagtcattcaccaaccctaaaggggtaaaataattttgattctgatttcagccattataaaatgtaagcatcaaatgtattacattggtctcatcagttttatacacatcctttatatgtgatttgaaaatactgttctctctaatgtccttaaccagcctctcttatgtttcctgacctgactctttccttttgttttaaaaggagaagcggattgccagaagtaagcaagagaaaagaaggtatgtcaaacacagctgtgggggcacttgacccacaggtcaagaatgatatccatacccttgagggagaaaggcacccaactcctaggccctgtgaatagactactttcaaaggttttcttcccttccctctctcccttcctgcttccctccctctttccctccctctttccctccccctcccttcctttccttttctttcttttttcgttataaaagcaatattttctcattgtaaaaaacaacatcaagcaatttttaaaggtataaagtgaaaagtgtcactccctgtattttttctcccacctcaagtctcactccctggaaactgtaactaatcaatgttcacctgtgtcctttcaggtatttttataagtatatatatgtaattttaagaaaatataatatgattatactgaacatacagttgtactatgtacaacttttaacttgagaaaagaacaaacatacccttgaatatcttttatgtgagcccaacagcggtattacattattcacaatgatttcagaatatttcactatatattgacatataatttgtttagttgcttactgatgaatctttaggctatttccattttattactgtaaacaatattgtggtaaatatatgtaaaatgaattcctagaagtaaaattatggggctaaagggtacatatatttcatatttaataggggcagccaaattgtcttccaaataagactgcgctatttatgcacccacaataaatgtgtaagtacatatttctatatatacataatgacactcaatatttttaatctttggcttttgccaatttgataggttaaaaaattgttttaattttcatttattcaattatgaatgaggttgagcacttgtattttctttcctatgatcttcctgcggatagattttgctcactttcctataaggattttaatatttttctttttgatttgtagatactcggcatattatggaaattagctctttgtcattgttgtgaatattttctttgcattgccacttgtcttttgcatttgttcactgtattttctaatagggttttttaacagttagtttatttttctatggaagcttagcttgtgtgaatgaaaaagttacaatagctatgagtttgatattatgaaatgatggaggaaaaagatgttaagccagaagctgagccaagaaattgttttacaagagtacagcgagagaaaagtcaaggtttattttcaaagtgcttgcttgtggtttcactaaatctgtaagacaacagatactcctaggctttgttcacttaacaagatggaaaggaaatctcagctgtctatagagctaccatttaggtttcattgaataatgcaaactagaattatatgaaaaaaactaactagagttggattctctgtatcttgatctctaaaacaaagtgacccagttcactatttattgagagaactctagctagtaattatcttttcataattgccatcagcaaacacatccaattatatatttactggcattccaaaggcgtcaagagcccttcaggactgtctgtatcttgccaaatcattagttatcacttaggtgttattaaagtataagaatgtcaagttagataattggtgtaagaatcctttaaatccctcacaaacccatctgctcatcagagcctcctaaaatgtttcaacagagtcagaggatggctgcttttattccctgagacaggtctcttgttcttttcccccaagagggccaaggcccagttataaccttttttttccaggatagatttgagaggctggccaacctccattctaccacctgctgccaagattactggcatgtgtagatgacattagaattatcttccaggattcatcttagaagcattaacatcaaaagtacagtgtcatagaaacacttctatttatttttaatattttggaacttaaaatgttacgaaatgatgtgtaacaaaatatgtggtaaaggatccattagagaatgcacatgcattaatgcatggtgctgcatatgcgattattattttgaggctaaggggatctgtttaggtttgttaacttaaaaagttaactaaaccaggatggtctaaaataatccatatctttttaggcagtttgtcttaatctgatttccacagctagtgcaagacttatcactaagaagctcacaggtaaagagcaaaagggcaagatatgacttgcagctgcaggagctatttatgagtgaggttcttcaatgagcacgttagaatacacagacatatcttatttatgagtggcagataaattttatctcatgtgccaactccagccaactcttaatgaccatctgtctctcaatatctagtcttcctttccttcatactgataggattttagctggctatgcatttgtccaggataaagactacatatttctaatcaccttttagtaaggtgttagcatgtgacaaaatactgacacataagatgtgagctaaaatggtgtgtgtgacttcctcactgtgccttcgaaaggaagggcagggcctccccttgctcttttttcctgattgcttctggccagaatgtagatgtgacagtgggctctcatggaccatgcaaacaggaatgccagagcaaaggagatgaaatgagtcctcacaggagtgaggcacccacatcagagctgaactcatgttcagagtaacatatgaataggaaaaattcctgtctcattgaagcatctattattttgagtcattgttactgaggcagaacctgtgtcctaactaaggctttatggttataaggtgtatcgagattcagcggggaaagtgtcatgctaggttggcagtgttgggtaagagaccggaagatctcctgccaatctaatctcttactacatgaatacacaagttactccaaaatggaaaactccccagaagaaattctcattagaaactcatacctaacttttgtcatcttcctatctctctgtgctactacagaccacccagtcttggcctctctttatttagtataaatgcaaataaatgagacttatctaaccatcataataagaataaaaataaatatgtcatatttattatatattgtttattcatatatataatctttaaaaaaagcttcccaggaaactacatgtttatttcaatcatgttgacgttactaaaatatttttggttttttttggaactgttatttctgttataataaagtgactgggtcaagtcacttaaacttttttgaacatttgttgtgcacaacattaacgtcagtgttggcgtcagagacattggtaaatttattgaggatgtcagtggtgctcgctagataacctctgtcagattcccatgacaaattgtcttcatcatttaacaagagaaaactactaacacatatagggtttttactatatagtccagggaaatgaaagacatatgccagaaatggaatgtgaatttttgaaaagcatgattcatgaatttattcattcactcaagatttatattagccccctggcctattttcaaaataattctcagtaatttatagattatatgttagagttctctttgcattcaatttagtaactctttattcagctagaaacttgatttattaaatgatatcctgggcaatgccctcgagttagaaggctgtccagagacccgcaggtaaagcgcccacatttctgggcccttgcctctccccaaagtcagctaataactgtggactgtaggatttctctgcgcatcaaggactctgacaggaaggtgctcagctttgagcacatttctggagtcccttagcctgaaacatataaagcagtggtgctaagagtgggtgcggccgaattggaaattctgatctaatttacttcatgagttagttctgcctgttaagcaagtcagtgtgtctcttcccatgaaaaacagcctcctacagctataatggaagaaggtcaatttaagtatatttagttttcaaatatgctgagagctctaatacagacaatgacttttgtcctcatctgggagagaacaggtttaagattcagtgcaagtgaaattagatatgaggaagaacttcccaatagcaagtggcattaggatttgaaggaggtaccagggctgatgtccggcttgctgtggatttaggacgccagagccttcacaggtttgttaaatacatattttgaatctcactgccattcactagtaacatttcctctacatatgtctttacacttgtataggctaccttagaagggtatggtcttgacaagtgaggagagggttatgggaaagatttagaaaaaacaaaaagaaaactcagggtaacatgctccgagtagtgtttcctaagagatgctgttggtatctgggccaggcgactcttcatgtgagactgtcctgcatattgtaggatgttaacattcctggcccctctcccatgccattaataagcaccagaaattgtgacaaccccaaatcccacctctcacattttaaaatgtctcccaggggaggcacataatcatagatatataggtgtgttggcttaggaactttataataaaacatatttttgcagatatttctaaataccaatatcctcaaataccaaatttgattatattttatgaatccagcaatcctttctgctacttgtttacttagaaatgctaagcccagtttaatctgctgctttagagaaaggtactctaggtggcttcaacagatgagaccacactcaaatgtcagatattactatagggtaaagaaaaaaacagagcttcaaattcttctccaagcaaactttgaaagtagcaaaagcactggttatggaaatcaaaacctacccagacactccatcaattaatattgcaaaataggtatatctgtaaggtctgccatggggaaataatcccttagactagattacatatgacatagatttcactttcaagtagggagataacaaagtcagaaaattctagcctcataatgaaatttcctatacccaaggttgatgttcacaatataatcagatgtgcaatccaaataaagtttccattcggcctaacctaaaatataattcaaagacaaaggaataacacctcaatcaaatggagcctgaagacaactagatttctgtcctcttcttctaatttttttgaataaaatggtaaatcacaagaaaaaatctgatattgactcaaatctaatatttcaaaatatagtctcggtcaattcatattcagctcaagttcctacacctccaacaagtcgagtactcaaaaatcctagtgccatttatgactactctaagacactgatacagcttggatttttaaagaaagcttaatttttctctattattctctgtttactgaggcaggagggacaactacagtttagaatatatttcttattgctgcagtgactaagaaattaaattactctgtaacaaataatagaggcataatgatatgcagcacaatctaattttaagcctccacttttccctttgaacctttctgtaactaaagagagtataagacttctctttaacaagcagagccaggttatgatttgttataggactttttttgtttgtttgtttgtttgtttttgagacagagtctcgctcttgttgcccaggctggagtgcaatggtgaattcctgacctcaggtgatccgcccaccttggcctcccaaagtgctgggatcacaggcgtaagccattgcgccgagcctgttataagacattctgatgaacaccttgggctctgatgggctttgagagagaaggtccaagtctcaggttggaacctatggcagtgaggctgtgtagacatggcacatggcactgaaccgccaagaaggcaggaaaggaatcaatgtttttgaactgccacatgacagaatcatatctcgactcctttaatcacaacgactcctttaatcacaactccatctgtaagctagggaattgttatccctagcttacagatggagaaataaagtcaaatacggtaacttgcccaaggtcacagagccctgacaatctcaactcccaggctacctgccactgttactttatgtcactagcaacagacaaagacttcctcttctcccaaaagttatactcttctctttaaacccttaaaagaaagtcacaattgctgaagatctttctaatcttgaattctaagaattgcaatgtaatattcattttaaatagtttttggctagctgaaagtcgaatttgcaaccagaaaagatgactgttaaatctttaagataaatttcagcatacaatagtgtatttcttaatttttattttttgaaagaattgttaaaaaattcttagactaatatttgccatgatgctgctactgagttaaagaaatatttttaagatctagcctatgtgtggccaacattggtttaaaaaatgcttttgtactgaaatatttataaaggaaatgatacgctgtctggatttccttcaaaattattcagaggtggaagtaggtgggtatatggatagagaaaacaagattggcccagggctgataaatatagaggctggatgatagctgtagggtggctataataacattttttaataataacaattttataagatttttaaattcttatcaggatacatagatgctactttctggagtagtcccttggtatccactctttaagctaacacatgtttattaagcagctactatgtttccagcaatatattaagttggtcgaacttatataaatatctgaacagtaaaataaatattaaaaattatttattatgaacctgtttacttaaacactttcaaggtgtgagtcacttttgataatttacttaaccatctctctgtacatcagtctactcttttagattaatgattttatgttcttttaaatgtcaggcataacatttttttcattcatagacactgatggtactttagggatacagatatacagagaataaatcagtttctttctcttgcttctccatctctctttcctacttgccaggtaaaatcccagattgatgcctattctaccactgtaactgaacatggctggaaaaaaccatacaactctgatgattcatgctgctttaaatttacaaccacaaataccaactgtgctgcatgagaattctaaattttcctagtctgttcattctcccagtctctaaactgactgtagttgttttctgtccctaatcttcaacaccttctcctcttacacactcctagccaataagctcctgtattattttatgtagatatagaagctatgtttagagaatcaccttatctttccaccagaaagtgtcccttcctacccacatctgtgcccgtaattctctgcttttcctcctgttcttcatttgtgcatgttctttatttctgcgtggaatctcaccgcttctcaaaaactttgtacaaattccctagagactagtcctcagtccctttcttttctgtaaacactccttaggggctttcatgttgtcccattgttttaaggacacagtggtgtctcaaaggatgaccatgcatcactcttgaagtgtctattccttatcctgaatgctcaattcaatagcaagccctcttgagctctattttcaaaatatatcttaggacaaagattttataatgccatttatatgaggtacctaaaataggcaaatgcataaagatagaaagtagaagagtggccactaggggttgggggagggggtaatgtgtaatggggagttagtgtttaatgagtacagagttacagtttggaatggtgaaaacgttctggagatgaatggtggtgatcattgcacaaaaacaatgtaaatatatttaaggaaactgaattgcacacttaaaaatcattaaaatggtaaattctaggttatgtatatttattttaccacagtttcaaaaacaaagatttgtcttgtgtgtgtgtgtgtgtgtgtgtgtgtgtgtgtgtgttccccaaagtaagtcccctggtatttgggtctgtgcctctctcctacttcgtactccagacttctccctaactgggtccttgcttgtcaatatgcccatgtgtcactacccaccttgataatctagcaagggcccggtgttttcatgaatgggatgtgatgtgtccctgacaatctaccccaaaactagcatctgatggtggcttctccagcatctctggcatcctgaccatctgccgtggcctgctcttcagctctgcactgctggcctctcctcctcacggaggctaggctgctgcccatgagcctctctgggcttcccctgcagtgctccccccgaccccacgcacacacacatacacacacacgcaaaatccaaccactttctactacctccactgctgccatcctttttcaaaccagttatctctcacctgcattattgcaatagcctcctgaaggcatttccttgtttttaatcttgctctctacctcagtctaatctctacgtactatagcagagtgatgttttaaataattagggagaccctgtaatgtcccagatccagtcttggttagaataagctccaactctttaccaagctttcccccgctcctcactgaacacctggtggcttagttcctgctttcactctccacagaatgctctttcacagccagccgcttgcttcattcaggttgttgcataaacgatacctcctcatagaggtcattcctgatcacctaatagaaactgtcctcccaatgcacacgtgtgcatgcacacaagtgcactgatagatgctttactctgctttatttttctcgaaagcactttttaaaaactatcggccatcacacagttagtcattttcttacttattactatggttgccccccttgatgtaagctcaatgaattgttaattgttgctattctagaccttaaccatgactggtacttagtaggaattcgataagtatttacttactaaaggaatgactgaaattgttccttgcatattaaatttgaagtttaaaaaactgtagatggaagagcattgtgaggcaggtaactgctcatgtctgaaaggcttctcttttataaacaaagcccatcactaactgatgatgatgtttcagtcctgactgttggctgtaggaatgcaatgggagaggagggacaatgaaagtcagagtgtggagaaaaaggtcaaacactggtgcttggagtatgttttcagtgatcattgccatgttgatgaaaaagcatttatgagtctcctgaacaggattcatttaatgtttaggggaaatattcttcagaagattataccatttatgtaagaaaacaggctcgttgataggatactacagtatgcaggtcacccctaagtgatgagggggaatggaactttagcaaggaaatgctgaggggcgttcatacctccctggggccatcctgagtgtaagaggtggtagacactgttattgtggcatagtgtttcattttcaggaaattgaattacacatttgtaaattagatttcctaaacatctgaagcaggaaatgaaaaagtaaatggaatttttaggataaacttatggaataaaattttatccttttaatttttttattttattttttttttgagatggagtcctgctctgtcgcccaggctggagtgcaatggcatggtctcggctcactgcaacttccgcctccagggttcaaacaattctcctgcctcagtctcccgagtagctgggattacaggcacccgccaccatgcccagctaatttttgtatttttagtagagacggggtttcaccatgttggccaggctggtctcgaactcctgacatcgtgatccacctgcctcggcctcccaaagtgctgggattacaggtgtgagccactgtgcccggccataaaattttatttttaaaaggaagaaccacaaagtgtccatgttagaaagtagatttgctgttctaaattgctgactgaggattgcattaaaggtttgtattcttctgccgtttttcatgttaagaccaggtccgctttttgcctgtctttgtgtctttgtcagtgctgttctagaggcctttgtgttctcagtgagcattttttgctgttaattgaatggagacctcaaaggtcctgctttacctacttcaaagagcctgggtcactccctaccctctaaggagcttgctgctccatccgactttgggggctgagtacagtaatgagggaagttgacctaatgacttatgagtcactctcttgtagggcgacccattatctcagtttgcccagactgagggggcccagggatttgggactttcacggctaaacctaacaaagtcccaggcaaactgagacaagttggtcaccctaccactattaagttcaggggtagaactgctataggagctaactcttgacattcactacagctcatgcacaaattccttaccttgggcctttttacttcctgtgacttcagaatttctcttgggcttttataactctcctcttaccatttaattattaatatattcactggaagaggagcctgtgggtctctatgaagccacaaatacagtcccaaaagtaagtcccgtggtacctggatccgtgcctctcccctcctttgtactctagactcctgacgggcccctgcttgtcaagtgcccatgtgccactacctgccttgataatctagcaaaggtttggtgtttccataaatggaatgtgatgtgtccctgatgatctacccaaggactagtatcgggtggtgactcctccagcattcctgacatgctgaccatccaccgtgccctgctcttcagctgcgtgctgttggcctctgctcctcagggaggccaggccactgtccatgagcctccctggacttcccctgcagtgccatccatatatgcagcagctctcccatttctgaagaaagtcaccccttcaggcacgtacattgcaaaagggtactccctctgggatgatcaattagaaaaaggaacccccttcctctaggcattctggaaggtgccaaagtttgactaaaacctaggctctggctggggttttaactccagctcccatcccctttgctgggtgtgtaacttacacgaacacatccctaggcctgctacccacactactggctaaccagcccagctgccaccagggcctgccacaatgacatgctttgcctctctggaccgattttgtcttattaccaagtactgaacttgaccctgaatttattccttgtttccttgctcttatcctcttcagcttctagctcagtcctatttaagctctcgttcttaacttgatggtgtacagaaagtcatgctgcagcttataaaaacctaaatagataacactgattacataacatttgcccattctatcaagtactgtaatggaactcaattttagtatttacagtaaaacctaccacccattgatcacagtgctttgttacatttgatctctgctggtctctgtatattttctagtcttttctactctttttgtttccagaagatgttcaccttgggataataacacttgtgtttcttctttccaaagacagtttgggaaggaaatttcgtaatataatttttatttcagacctaggacaaaatttattatttcaggtttcactgtgaaaaatatgaaaccatgaaacatgacacttaaacagtagcagtccctaaaaggtgggaccagaaaagagagtgtaggaaggagaagctgtggtctgataaatctaacatccctgtttttggaggaaggtggcgatggcaatgaagacccatttgggacaggtgcagagaaaaatctagagaagggaaaagtcatttggaaaagttgaatcacagtacatagaacctctgaaaactcatctagccaaagggaatcttttgttctttggaactgtagactttggaatttcaatcaattagatcaaagtttccctgatgggacatctaattaccacaaagtttgagcttgccatgcatcctcacctgttactttataaaaacaaatagaattttattttgtgaggcgggacggtagattgctttcatacctaaattgcatttaaatgcaagccacttagtgatctggggagcattgctgttttgatgatgctacctttcacagttaaaacaaatgtttacacaataaatacagcaaatagagattcctatgcgcttaagagataatattagcgtaactatgtactatgtggttcacatatacatctatctatatctaaatccatatgtatctagagacaatgagtacatacttaaaattcagacaattaaaatttcatgaagatagtttcacatgatgctttagcttagagagtgaatgttcaatttctttgaaatgcctttgcacagctagatcgttgctaagttcaaaatctgattcttttgcttttctgtttagccaccaaaaaaagcttaataaatagaaacattgtctcttaataaatagaaacatttctgtttagccaccaaaaaaagcttaataaatagaaacattttcacatgatgctttagcttagagagtgaatgttcaatttctttgaaatgcctttgcacagccagatcggtgctaagatcaaaatctgattcttttgcttttctgtttagccaccaaaaagagcttaataaatagaaacttttctccttggagtaccatgcagatgatgaaggaaaagtctgaagagaaagcttatctgcatacacataccccagatggagttgaatttttcacacatgatacataagctggagtcactaattgtgtaattacttcttacgcctccaattgttctcctctggatggcttcctctcattctaagctctggcccggtagaaataatggttcatgtttaaaacttgctcaagtttttattacattgctgcatggtgtacttaaagttattcactttcagcatacctcctacgagccatgccagtgggaacaaccgctacttacttgtgtttatcttctggagtgaaatatgcttttccagttgtcttcgaagtttcacctctgctccatattttccagtggtcccgttgtcagccagaatgaagtgggaatgcatgctgttgagaacagtgagcttgctcatgggattggacatggtctggtatggccggacaacctgcagggtatcaaatggaagaggcagaagtcagaaaaaaagaacacaagatatgaaaaggagaatcagacagaggaaagagaggaagaaagaacatcagttctgtggtacagtgaaagtacagtctacatcttcttcttagtattgctttggatagaggcaagatttatggcaaaagttattcaaagcaagactgtgcttaaatgagtatttatttatttactgaaatggggcagaaaatagagatggtgctctcattgtactaaaaaactggcatgccaatgattgtttcattttgaagtcaaccttgtatttgctaatgatcccaaaataattttacaatctagttattttgtttctttcctttctctatcatgtccatactttaacaggcacagcagaacaattataattctggagatggtggcggggagctaggagaaatgtgattctttctgtcaatctcattcagtaatttgaaggtctcttatttaaaatcaacattattcttactagataccttatttaggtggaaatcttgaatataaaataattgtctcatgagatagatatgaatcaggcccaaaatgttcaactctgtctcattctaccttttttgttattttaatttcatggtgaattacactacttaaaatagagcaatttcagtgtggccttccagatttttttttttttttataaaaagaacagcaatacctattgcgagctagttgctctatacatgttatctatattccttgcgacgatcctgcaaaatagatgctattgtgttcattttgtaggcgaagaaactaagaaatggagaggtaaagtaagttttctgagagtctaccacacacacaatcagaattcatacccaggactgcctgattccaaaatctatgcttatttttctttcccatactgcttagacccagtggaaacataagatgatgggttggaaatctactcctaaaatatttaggtaagaactgccctcaagactatagaaagagaatattcaacaggctaattgctacatggtcttagtacagctatcactgtattgaatcatcaaaattgacaggaaagaaataaatgctaccgaatttttatttttgtgcctttacagagtgtgtacattaattatagaattgagatgctcttgttctttttcagtatgtaataacacactatataaagctgtagtaagattgagtagtttgttaaaggaattacaaagtgatttataagagcagtcctcaatagtgaagaactcatgtaagtcatttttttagaccttgattctgattcaaaatcccacatttctatgtgtctggcagataaaatgtactcaataaatagtgaatgaatgaatgaataggcaaacttgagacagacatgcttttgttcaacattgaaaaaaaatcctttcttttctgaattgaggattgatctcatttaaatataaaatgtgtatataattctgagcttctgaaaaaggcttcagtcctattaatatataggacttttttgttaatgtagcattaatttaatgtagtattgctataatgttaatttgtcaatgtagcattaatgtagcatttgttaatgcagcattaatataaggttaattcacagcttcatttagttggctcttattgataaaagaagtctataactttttgattattgtctctagtaattgcatggagcagtaatcaattactgctttgtctagatgattgcgtaagagtcccccgaaacacagagacagtggtttgctaatcccatcctgagcttgttatcactggaagagtaggttgcttgtggttaaaatttccattttgttgctacttgttttttatcataaaacattcattctacagcagagtgcaagttaataaatattaatgctttattgaaagaggctcagcagaaagactctcctgttcttaaagtgcctctgcattgtgcttgtagacaaaagaaaatgctttagttactgttctctcttttctagtagcagttcctgcaagagtccttgagaaggaggggtaagaccaaagcagtctgtgagaggcaggggacagtgggttttcgagaggttaaactgtgtgtaatagtgaacaccgggcatttgtgctggctgagacgtaagcccatgttttttaattcctatgaacatatttaaagactatcagtgaaagtgaaattttcaaatgaataaaggaatgaaaataattctcagccaagctgatgtattcaccacaatctaagaataaaagaagaaaattaaataatctatattctatatacagtatctgtattctaaggacgtgggtgctccagtcttctgacttttgactttcttttcttgtgaaacatagctcagcggctctttgggaatactgcacatctgaattggtcatggcaaaagggtcaaatttacagtttcactcatgagtttcaatttcttcatcttactgatccctatttcttttgatcttatgtggaagccagtcaagtgtggtcatattttgggagagagtttgtctgctgaataataagggataaaaattgaaaaataagtaaagtgtcctaatttagttttcagtcatcattggagaaagatgtgctgaatcgtggaataattctgaacatatgaattgtggaaatttgtttgaatctcagttttgctaatgactgtgtgaatctgagtctcacttttttaatctgtagaaggaaaatgataaaaccacttacctcttggggattagttgagattatatgtgcaaagtacctggcactatgccaagctcatagcaggcattctataaatgttaattccttctccggctctgctctattttaccaactataagccgatttttcaattgtaaactagtgatcaaaataaaatgatatgagacaaatcagtgacttttgttttgcacgagatagaaatcaatgtaagtaaagaaaaaaaaatcagcagtctgttggcaaaatatgcaaagtgctttttctttgccatgtcctcccaggcatctaagagggtgatggtctgaaactatttgctgattactgaaaagttagaaataacttcccaaatacctcaaaggaatacagtttggtctaacttgcctacaaaatccatttaatattcttcatagcaaacgtaccagcaatctatttttgtttgagttataatttacatatctaaaaagatttgctgatcttcccgttatgctttccaaattaaaaaaataatgtattttaataacatgaatacaaatgaattttttcttctgaaaaaattttggaagtaatgaagccattttcattgttaagagattgtaaaataggacttttttttttttttttggaattgtgtgtgtgtgtggtaagaacaatttgatgtgttcataatttgtaagtgtactggattactgtggcatgtttctcagccaggctttcctgagaaattaagtcctactgccccgcagcatccattgcatgtaatggatcactttctttcccaagaacataggatgatccaggttatgtactatctttggagaatcgagaagacagtcactcaaacaatttcctgtgttgcagttcagataagaaacctgagttgagaaaggctgaatggtgtctgaaagggcttcacatcaggtgagcttttatagttggtaaatacagtagtatgatgggtagaaaaaaaaatagaatgaataagacctactatttgatagcacaataggatgactatagtcaataataacttaattaaatattttaaaataacttaaagaatgtaactgaattatttgtaactcaaaggataaatgcttgagggaatgactaccccattctccaggttgtgcttatttcatagtgcatgtctgtatcaaaacattttatgtaccccataaatatatatatatatatatatatatatatatatatacctactatgtacccacacacattttttcaaaattaaaaattaaaaaaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaaaaaaatagtagtatgtatatctaaaagagaaatttgcttagaaatggattttagacacttagtactctctgagcattgtgggcccgaatacctgtaagcaatgacatttgcctctctttcttgtcccttaagagtaaatgagagaattcttgcctcattaatccattgtacaccttttaatactggctgactgataaaattctggttctgtatactttgactttgaaacaaagaggccctctgaagtgaaatgagagctgtttaagaggtgaaaggaggcaaaagcccttttatagaaggcattagtatggacatcatcattcccaggaagggactgattcagagacactatgacacaaccttcagtcatgggctggtggcagagtgcttcatttgtgttttctgcatgggcttaaatcagtgattcagaagctaatctaagaaaactgcttgagttttcctagctattttcaagcatttttggtctcacccagaagtagtaaacaggaagtcaggagatgggtgttctagctctagttcttctagttactaatttctaacatggggcaagtctgtgaattcattcatttgtttacttattaagaatttcttgaggaaatatagtgtgtgataaatattctgctggcttgaagagacatacaatcatgcatcttggtaatatctcacaataaatgttcaaaacagattcattgaaagaaacttttggacaatagtttttccatctataaattagaggacttgactaatttctgtttcctgcctctaaaattgagtctggacagcctgtgttaaacagtgcttttgctcttttcaagttaacgcagaatagtgacctttaatgtgtgttggctacagaaagaaaagtagttctttcatgtcctgtggtctcttccattttatggtgctttctgcaatgcgagggcagtttgatgacctgggactacttttccaaacagaattgaattggactacgtcaggtttttgtgccatcaatcacaggccttctgcaatcccaaacctcattacctactgaattatgaaccaacatgctccagacaagaggcagggtagtggatgtgtggcccaaacaatcattctttcctaatagcaccatcattttaatttaggctgaaaaatattagcatttattgatcacttattgcatgccaggcactgtgatggacaatttcccaaggattaacccattgacggcatactttataggtgggaagaattataggggctcaaagaggtgaggtatcttggtcaaatttgccccactaatcctactcttttctctaaatcccatgtagattttaagagggaaggcagaggacccagtctgattgtaaatttgtagaggatattagggttggttttgctgctggacatttttatcagtggctcagctggatatgaaagtccttctaatagctgatcaggttatttccagatgagccatctagaactgtatgtatacagaggtcaggaaagccaccagcaggcagcaaaatggcattgtgctttggagagagagaaacaaaaggagtggggggattctcttaggatcacgcatctgtttctgggagggaagatgggataccactgagaagtgggaaggaacctctgcgtctgagataaaggaacatgggggctgagagaatgaaatgaaaaaaaagaaaggatctgtggttcctcacaattatagcgaggccagagctagcagggacactggctagttacttcccactcaggcaccttggctgtaaggacaggtgcagagcagggtcctgttgaaacccagatgccgcctttcagctcggcaattcaaacaagagaccagcaaacccagggatccatttccaaagactgcccagatacattagcagtgtgaatcccactgaaatccatgggtggaacaattatgtctttctgcagcactttgaaaatgtgtcccttaagttgcacactgcagagcagcacagtcctcatttcatgctttccacacaaatggacttgctccctttgcccagtcctgaggggaaccctttaccattcagctacagaacctactggcagtgggaaaaggctgttgagttctgaaagacggttacatcctttagaaatcaccatgtatgagtggggtgattaaaaaatatctccagcaattctttgaaactctttcctagtctaggttggactcagtgactcacttctaagggatagaataaaacagaagtgatagtgtgtggcttccaaaactgggttataaaagggtttctcttagctctctctcacgttacttactctgggggaagccagtggcatgtgtgaagatgctgaagcagccgtgtagagaggtccacatggcaaggaactcctgcataagtcatcttggaggaggatactgcagcttgatccaaaccctcagatggtgcagccccaactgccatcctggctgtgacctcaagagacagcccaggccagaaccactcagacaagccacgcatacattcctggccctcagaaactgtgagatcatcaatatttgttgtttaagcctgatatagtttgagtgcttgtctccccgaaatctcatgttgaaatgtaatccccaatgttagaggtgaggcttggtgggaagtgtctgggtcatggggtagatccttcatgaatgacttggtgccctccccacggtaattagggagctcttgctctgtcagtgcacatgagagctctttgtttaaaagagcctgacatttctcttgctccctctctcgttatgtggtgtgccagctccccctttgccttctgccataagtggaagcttcctgaggccttcactaggggcagatgcaggcattatgtttctcttacagactgcagaaccctgagacaaataaacctcttttctttataaactacccagattcaggtattcctttatagcaatgcaagaatatactaatacaaagccattacttttgaggtactttttttttttacgtaacaatagctaacataataatgtattaatattatcattattatcttcttgcttctttaaggcttcgaaatgtgtcttcttccctttattctaaactggtggatgcatcatagtttcataacctctagtccccacccccttgccaccctgagtcctctgcttggcattccttccctgggctctaatcagttctggtttctgttccattggggtgactaacatcctccactcactctcctcacacctttgacccgaataccatcccttctccatgtggcaggtgatccaattcctgctcctacacgcttgccagttgggtgaccctaagcaagttatttatcctctgtgtctcactgtctccatatgtacatagagaataataataatcatcccattgaagtattataaggcttaactgagatagaaaactcatagaacaatgaaaatatgatctcaagtaaataagagctgttattaatatagagaagcagtattggtctctatactgcaaaggataatggctaagaatatggtctagggagctaggtggcctaggtttaaatcccagaaacatccatcaccagttatagaacattgggaagatgatagtaatgctaaaaatgatgacttctgaatgccactgtgagaattaaatgagtttatctatgtaaaagtgcttagaagggtgctgacagtgagctctacagaaatgtgaatattattttagttgttgttggggctattattattatttcagtgataaatgataaacctccaggttaaaactccttcaacatcctgacaccaatcttccacatgtgtactctctcccattctccttcagtgacaagtgtacccacagttgatctttcctccttagctctgggccccatcacctcatggcccttctaggagttattcatcacttatcacctctctgtcccatgtccctttctgctatcagcacataaacaaactccagtctccccccatcttaaaggaaaaattccctcacactgtggctccctttggctacctggatctctccccctcacaaccaaaacctctaagaggtctctgccaactctgcttctccacttcttcctcctgaacccattgaaaagtgctgccttgtcaccattcttctgaaacagctttgaccagtaatgccagtgatatccatcttgatgaaatggatgggcacttccaggtctctgccttccttagcctcttgatagaacttggcattgcacttcacactcttcttcagaagcacactcttcttttggcttgcatgactccctctgactttgcttctacctctcagacattgctttggtctcctttgcaggctgcttgtcctctgctcatccattaaaagctggagaccatgaggatcccggggtaagccatccttttcctcatctgaatactctcccatccaccataatgactttaattgccatctgtatgagatgccttccaaatctaagcgtgtagccagatcgtgcttctgaacttctatctcacatactcactggcctgccagatattttcatataggtagatatctcaaaggaaagtcaaaatcaacatgcccagatccaaactcatcactgttctcactagaaccgcatttcccacgtaagtgaatgtgactaaggcagttagctccaaagctgagtgtggtccaggctcagcaagcattggctctgtctggtataattataacagatttgggcgggtgtccttgtctccgaccttttcctcacacatctccccagatacatcttatctaatctaatcgtaaaaatccaatcaactccatgccagggccactcctggaaagttttctgagcttataatatgaagtcatatttggcttgcctcagaaataagtaacaaatgtactgacttggtaactacattaaattagcaatcaattgtgttattgaacttgatgtttcctggcttgaaacataaagatggcatcaaaagagcactttccaattaaacataagaacccttacaggctataaaacttggagaaataaatctatagtttagggaaaatagaagacatcattgaatgtgaagataatttaataaccacacaagatgatgtgttgtaaatctacccaaacacaatttccatcctcaagttaaaatggaaagtgctttgtcttttgattatgtctgggtttttaaattgttatgtgtcttgttaatctagatttcagagaagacaaacaatcaagccttcagaaactcttcatttacctgacacaaatctggtcagattgttttctaaagtaggaaatctaaattcaaactgtgtcatatgaaaattatatttcactggaagttccttcttgactttatactggtgatactttcagaatcctctatccaggtcaagattctctagggacaaagaaaggggctccggtcatgcatcgagtctgtctctgagttcggtttacagtcacagatatgtgccaatatctcaaccaacaataaagatactctatcactgaatattttcttacatcttacttgacatacatatatttaaggaaatgggcattagagacagttggatcttggttttgatcctgtttactcaactgtaaagggggtataatacataccttgtaaaactaatatatgcagtcgcagagcacagtcaaataaaagctcaataaattataattactattattgtggttatgctcatagaagttgtatgaagacaggcagaacaagtgtttttatagagatgaagaaaccaaatcttacagagtttaagtggcatgtcaatatgtcatgttcatacaaactatgacattaagggttaacaagaaataaacaattcagtcctcattttggggagtttttaattaagttggtacaatggactgaatgtttatgtcccttcttcacccaaatttatatgttgaaattcaaatttccaaggcgataatgaggagaggggacctttggaggtgatcaggtcatgagggcggggccctatgaatgggattagggccttacaaaagggaccccagagagatccctatctctttctaccatgtgaagacacagcaggaaggggctgtccagcctcctgaattgtggaaaaataaatttctattgtttataagccccctggtctgtggcattttgttatagaaacctgaaaagactaagacagctggggaggaagaagacagctgtggtaacattacaatcagggatatgacgttaagggtgaagttagtcaggaaagatgtcctggtggaagtgagccttgagctaaatttgatgaagtgtaggattatggatagtaatagaggagagggatggtggaaataatatggagaaaccacagaggtggagccaacctcaataactgaaacagtgtatgttttcaggcctaagtggcaggggataaaatgattaccatctcagtattcatagccttattcctcaccaaaatctgttgttcgatctattaattgagaaaaaaagggcttggttaaacagagtggacaatatttaaatttaaaacatcaagattagtgctgtccctcagatgggtagatcacacatctttcaaaagctttagagaaaggcctgtttccatcccacactgttttaccgccacacccaacaggccgctccctcaccttccaccttccaccttgagttgctatctaagaaaacagttttacagccagatgcttggttaaaaaatgtccccactgtagtcacaatcatgtgatgcagcttgggggtaggattagagatgaagttgtgaagtaggtaagatttatcattatctgttccataatacttattttccctgtagcttgaatctcatcatgcccaatccatcttcatcaatatttactgagcacctactaagtgtgaggctctaagttgggttctgagaatccaaagacaaatgctctacacttaagtaacatgaagcccagctatgagatgagacctgaagggaggtgagtgtttcagaagatttagaagcacactcaaggacaagtaagttttcttctttatttttaggactagtatttgcctcgctagtgccatcctaaaggggttaagatgaatagcaattgctgcactcactacttctatcaataaataaaataattctagtagtacttgaatgttcagtttctaaaagtgaagcttctcatctgagagccagccccacaaaaataacataatttatattttccatcagtttggaaataaatttactgcaataaaatatcaggcataagaaatggagcctttcttttatccttggatttatttccaatacatttcccagatttcccttgacatttattttgtacctcttcaatattattctggagtataaacagacttgaccaaagatgcagctattctattttttcaaatgatggcattttgatagaattctgaagtggtaaagatttttaataatacattgttttgtttttctctgctacctgatgtctaatgctaaaaggtttattttttgatgtttattacatgtgatttttattatataaaatggaagaaaaaggacagatggcagtacattaagctagctgagaaaagagttgcgactgtgtaagaagcttaccagataatatttttaatttgataattttgaggggaatcttcactaatgaccaccatcattttattcaaacacctcttttaatggcaacctaacatcatagtaccttttagctatcatattggaatagtgaacacatagaaaaatttatctcaaactatgtcataaatcctgtacaccaaaaatagtactttcattccaaataatttataacttgaaaaactaactctattatcacacaagagcctgagaaatcttaggtatattctagttccctagttttaagggaagaaggtaacagagtggtcaaaattcaatagatccctgtgaaagatttatggaaaaagtaaaatacaactgtctttcctgtgttctctataacctgccacttttatttcctttttgcaatagtctctcccatggtccacctggttctttgtgagctgtggtttgcctttacgagaccctcgggaacagggatgatggatgcacacatttactgaacatttttctgccctctgtgctaggatcaagactatgttcagttgggaaggcagacaatgtcagtaagtcccattggaatgcataagtttctagttgcatacaaccaagaagaagaatgggaagaaacaaaagaagaaaaaaaatgaggagtgaagggagaagttgaagtcagagaaaaagttggaatgggaggtagaagaatcagaagtgattctcccaattcaacagataagtaaatgtaatagaattactgtctttctgcaatcttataaaatttataagatgaacaaacaaaataatacaaagagccagtaggccagcattctctgcaaatgcttaggcaactaaggaaattatttagttactctatcttgcataaataaataatcaactgccatttattcacagttcatctgaatgaggaagttcaaagtagtgtcccccttcaaattgaaaaataatagtttgagtttacaggagagatcctgaagctatgaacatttcaaaatgacttttgaatcaacacattttaaagaattaatttatgtattaatatgcattattaaatgattttggtgcagaaatgattttggtgctgaaagcattttggcatattctaattctttaagacacatatttgttctagtgcaaaatcaacatacaattaaaagccaatttggaatctaagtattaccccaaatatattacatgaaagactagcctcagatactttgaagaaatcagtaacacttacttttccagtcaggtctgcctatataacacttaggaaattgttgctgagatattcaatttgtacgtaatatgaaacagccaataagttttaattaagagaatattaacagtaacaaaactgacatctcattccttatcctatgtatcctggataaattagcatttatacatggaatctgatatcattgatgtggacacttgttatcacttaaaacaaaggttctaatggatttaaagtgtttttttattaaggaaaataaatcattatataaaaaagacacctgcacttatatatttattgcagcacaatcaacaatggcaaaaatatggaatcaaactaagtgtccatcaatggaggattggatatatatatctatatcccactatatatatatatatatatatatatatatatatatatcccaccatatatatgtatatatagatatatcccaccatatacatatatatctcccaccatatatatatatatatggtgggatactggccagtcataacagagtgaaatcatgtcttttgcagcaacatggatggaactggaggccattttcctaagtaaaataactcagaaacaaagtcaaatactgcatgttctcacttgtaagtgggggcaaagtactaggcacacatggacatacagagtggaatatggacattggacactacaaaagtgggaggggtgagggctgaaaaatcacctgttgggtacgatgttcactattcaggtgatgggtacactaaaagcctagatttaatcagtatgcaatatacatacataagacatctgcatctgtactccataaagatattttttaaggccaacagagtttgtttactgcttgtgtttcatgacatttagtttttttgaaacatacattttatttaaaactgagaagaaagtgtctgccactcaaatgcatcacagtctgtcccatttaggtaaattttcaggagaaatgcaagcccctggggaaaatatctctgctcagggtcaaatggatcctacctccttttttaaatgcctgcattgccattggtaactcatactacacattttaagatttgcaaagggcaggacagtgagccctatgatgacatttattttttaattcaaagtattttgcattgcattttaaaaaattgcatatattgtgttggattaaaataagatggttgcattgtattgcataatagaaaaagtagtttaagaccaattaattcttcgccacttttaaaaaaaatttttgtggctcagatagacctcatggtactttgaaatgaaaagaatctctctctgcaactctcaggagctaggtgaaagatactcaaattataaagatgctagagccctggggtgcggagagtccgtgtttactatatctgtcaatgagttcatgttgccgtatattaagtggtgttaattaatcttaatatcactataccaagagtaattgcaggatttgatgggtgaagaaagaccactgcttgatttaagcagagagggggtaggtggtaagtcttactttggacctttcttgatcataagaattgacctggagtttgcctagagattttagaaaataaatattttcccaagataccattccttaacatgtttcattttagtgagtagagacccaaagaatactataatgtgcacattttgaatactaattttattatacttttctgatatcccctctaggagaagtcatggaaagcgacagcactcaggacttacatctcttccaatgaggtcctcctggttttccacaattccccagggggcaatacctatggtgcatatctttcctcgagacttagaggcatgatccttcaaggcatcgccaacatgacgaataacacctaaaaaaaaaagagaagcattgattttttcttttaaagcaaataccttttcatcattctaaagaaaactgtggtaatggtttctcccgaggttaaataaattgaatataaaattttgacacatttctatacaaactacttgtatttaggagaaaacataaactcatggctgtaatgccagatgcattggccagatttgtatatgaattctagcattgcatttcttactccaattcatatgaaaaaacaaaaagcatccaatgtctataaaaagaataaatacaattttttttaactagaaactctttttcttataagcataataatttgttagtatgattaggagccaatagcttgactgtgtcatgttaaaagcaccatgtataatggtatgttaaatctacaccacagtctgtatatgagttaaattcattcaaagacatgagctatttagtttgagattttgttaacctttatgagaacctactcgtaaagacaatgttggattattctgtggaaaatttatgttaaaatatatagacacaccttttaatcttcatcattctaattattttcctcttctgttaaaatgaccttccccatcatagttaagggtgagaaaattcagtttacaagatgttaggcggcataactcttacctttttaaaaaccatttaaagaagatgcaatttctaattctcttaacctccctctcaaatgatcatttttataggaagatgtataagatatatcctctacgaaaagatgtttctgcttatcaaaattccacccacttctccaggaaaaatttatacctagtgccacttcctatatgaatgttgagttggatttgatttcttctccatttgaacatattgcagtttgtcaattttgaatagctcagtatgtcacttaacatgttctgcagtgattcataattatatgtgaagatgtctcttctaacagtaaaactgtttgagagggaagttggagggtcagtgccttattcatcttcctacacctcaggggctagcctagaggaagggctcagacactgtgcgctaaactaactaaacacatgaaacacaccaggcaatttaatcatgggaaaagacatgtgtatttaagtaactcaatactgaaatattcataagatgaaacagaaagaatcactgtttaaaaagcaaataacaaaacggtgtaaatggccattaatcatgttgagctattcaacagtgttggaaagaatatcattttcacttattatcttatctatgaatcttctgagtgagagaactggtaaaacaaacaaacaaacaaacaaacaaaaacagacccgaaccaaaaaacaacaaaacaaaactcccccaaaaaaggctgtgaatattgatattaagttgtttccaattgtttccaatacaaaactcctttcagggccagccctggacaagaagtttaacgttatggtatgctcatctgtctgcacaattctatcaatacttcttacctaactttaacattttattgttaagaacctcactttgggtattggattgaacactaagcctggagtgaggcagagatgaactcatgggtttgtggcatgtaggctataaattcttcttttgatattgaatgcattttataaaagaacaaaaataataaacaatattccaagttcttagaaatagagtattggtaagactttcttttgaacctgtagaaccctttgagttggtctctatgtgacaggaatgcaatagacaataatcacaagccaatgaggcctgcttagttgagagggaaacatggagcccaaaacctgaacagtcattgaaagaaaaattgctctgtagatatttgattactacaggataaggagtaaagagctaagcaggtcattctaagatcatgtcagtgtatgggctgagtcagaatttcacataataacattgaacatgagcagtctgcagacttcatcgctgaaatatctttacgtagctgtgtgcagaatgttcacaaattctaggtatttaagagaattctcagtgtaggtcttactcaaacagcatccaaactacgaatgcaaaattaagcaacattaagataacgtgttatttttgttttttgagacagagttttgctcttgttgcccaggctggagtgtggtggcatgatcttggctcactgcagcctccacctcccaggttcaagcaattctcctggttcagcctcctgagtagctgggactacaggcacctgccaccacgccgggctaatttttgcattcttagtagagacagggtttcaccatgttggccaggctggtctcgaactcctgatctcaggtgatccccctgcctcggcctcccaaagagctgggattacaggcatgagccaccatacctggcccgagataatgtgttatttaaaactaactggtccagagttatgtttagaatattccattaattacgaatgtatccacatgtacagactttggggcttgtaataagtttgcctaacttattgcaacattacctctacatttccaattggcacctcagacttcaggctgggggagtatgccaaaaacatttacaggcatccattccattatctggtgcacattaaaaatgttctgtaaataagcacttaactataggtgggccagtaagaactgatttgagaatgcgtctatatcacaatatagatggcaggaagcaaacattctttggaattcagagtgagatgtgtcttccattggcacagtgaggagttaataaaatattttaaacaataaacacgtaatgccctagactttgcctttatgtcccagatggaaacgtcattttgtaaaaattaaagctatttggtaccaaacttgaaattgtgtaaaggacagaggtagggcttccaatttaaagcagaagtcattccctaaagaattattggcaacttgagctatttaaaaatatcctgtgaaattccattagtcatgtttatgaattctgtatagtcaactattaaatatcccaacccatttcttatgtgtaagtaattcttcttggttaagaaataactttacagttctcatttagataaaggagggagtgataaccagcaactatggacccatgggtagggatgaagtggggtgatatagaaataattaatcttagcagaaaattacatcaggcacaacattcccatggcctatgttgactttctctgttccacttgcaattacctgtgttaacccctccagtgaatatccacgctccagttgtcattgctgctttgatgagccctttcccaaagacttgcttgagttttggctggagttcaaagttctgcaggcccccatggacagagatgagaagcttgggaagctccaactgccattccttggtcatcaggtgtaagaggagatcaggttttgtatcaaaagatactcgcacatactggaagaagaaaggacatcaattagggagacaaggcaggactggctgaggctggttatctttactgattgcaattatatgtgtagttatgtgacaaaaacgtctcatataaaatcagatttttttaaaaggggtgatcatttgctttatcaaaagagccttcattagacagagttcatatttttaaaggctttcttgaaattatgataattcattctgaaattattagattttctaaaatgctgtgcaagcatgacttttcccagaccgagttctttgctcaaaggaaatcatttttatatttcaccaccctttacatgtgtacaacagttcaaatgtttctaatatttttcatatctctttatattaactagatgcacatattattatttctgtgaccctattattttaagaggatttgaaagattctagaattctacataatgtaatgagagttttaaaataacataatagtgaattacatttatttatagctataacaactgcataccaaatgtaatgtttctgtatcttttgaagaagacaagtaacaaaaggcaggacaactattcttgaagaatagttgaaaatttgagtgtatagcaaatatcaaggtgttaccagatgcaactggaaataaagttataataagtctatataaatgaaatactataaatacatgcagtaataattatgtatataaccatatatatagatactcatttaggtctcaatgtaagtatgttaaaaacttcaatttctagctggaaacaactgaaaaactgggcaaatatagaaagtcctttgaaataggtttctgagttggcatgaaaaaagaattattgagactcctaaacaaagaagcagtttagaacctcaggaagttagggagtaccaaagcaggatttgaccctgagtgtctttcctaaaccctggaagacctagagcatctgatttaatgattgcatgcaggggggaattgaatgattttatgggagaatttaatatgggatcccacatagggctggtatacttcaaagggctcatcctcaagtataagaaagaaaaaaattaaataagcctgatgcacagaagaagatggcaagaaaacttgcctacctcaaccttgactctaggtggatgaggaaaaaatttcccctctgattatttttgaacacaatcaggcccccacacaggccttgtctatattcacactatcagtgtggtttaagaattgccaagcagtgtttaatatgttaaatagttctggctggacgatggttccagataactggtagaagtaaatggagattctctgtggaagaatgtgtcatcaatccatgcctgaaataattctcacggggaaataagtatttcatagtaaaaccataaaataaattatacaggaaataaggcagcatgaatgagaaccaatagaaacaacaggcaccaaaataagatcctcaaagtcattgaaatgataagatacaggctataagataactgttaatatgttaaaaagcataaatgagatgactgagtataagagtcaggagtaagaaactaaaaaatgacatatacgtgcatatatatacatctgaaaagaaccaaacagaacttctagtaattaaaatgtaataattaaatgaaaattaaaatggataagttaaattaaatattagatataatgataatagatccagaagataaatgagatgcagccaggaaaacaaaggatttgaaaacatgaaaggaaaataaaggagcttggaggagataatcagaattataggtagaagtaaaagagatgatggggaggaggcaatattggaagaaatattggctgagtattcctcggaattatagaaagataccaattctaacatgcagaaagttcagtgaattctaagcaggataaatgaaaagaaacctcacttacatacacatcacatgtaacaccaaagggaggggaaattcctcagaagtggctggaaataaagacagatcatgtacaaagaatagtcattagactgaagacctactcctcaacagcaacaatagacacctgaagccaaaaccttccatgtgtcaaaagaaattacctggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcttgaacccgggaggcggagcttgcagtgagcctagatcgcgccactgcactccagcctgggcgacagagcgagactccgtctcaaaaaaaaaaaaaaaaaaaaaaaaagaaattacctgtcagtctagaattctacattcagcaaaactatcttttaaaaatgagagcagattatagatattttcatactgccaaaactgacagagtttacttctaggcaccttcactgaaggaagttgtttttgttattgtttttgtttgtttgttttgagatagagtcttgcactgttgcctgggctggaacacaatggcatgatctcggcttactgcaacctttgcctcctgggttcaagcgattctcctgcctcagcctcccaagtagctgggattacaggtgcccaccaccaggcccagctaatttttttgtatttttattatagacggggtttcttcatcttgtctaggctggtcttgaactcctgatcttgtgatctgcccacctcggcctctcaaagtgctgggagtacaggcgtgagccaccacacctggcctgaaggaagttttaaaatatatataggaagcaggacttatgtgatccaaaatggatgatctgggttgtaaggtaggaagataaactaagatattagttaatgtaaggtaaatcttaaaaagtattgggtatataatataaaataacatctaatttacagtggaaagtgacagaactaaaacactggacaatacagcatataaatgaatggtaacaattagagttatggcattctaaagcctatgttgtgtgggaaagaagggaaaataattaattctggaatttaagtatgaatgttaaagttgcataaccacaaaatgaatatgcctgcatgtaatcatacaaacatatgctttttgatttatataagattatccaggagatgacaatttattgccatgctttcgggtctggaaaaccccattgtttcaaagcctcaaaaattgtttctctattctttcgttaaagtatatttgaaatatatttagctgaaacatgaggcaaaagcacgcagaatatgaaagcagcttaataaaataaaccgcaccatcaagagataccaaagagctaaagtttcctgaacatatatatgccagaaatccaaagtgttggcatccaatacagttgtttctatattgatttgatttatctagcaaaaaatgattccagaatacagagtaaatgttgacaattttaggtaagtacattatatcactagaatttgactagagtttacaatatgaaaaatggcatcttttgtgcaccaactctcatgcagagggcaaaaactttcagatatctatcaacagaaattttcaccaatgtgtacttttgtgccacacaaggagcattcaggcagaagagggggtactggagtatcagaggcaaacagaggaatttcttaagtaaaagtttctgttaaaaatcttcattgagagtctctttataagagacatatttataatgaatgctataaaataaaagaataaagaaaagaataaataaataaaggggcagaagaacactttggaggtgttgggtaagtttatggccttgattgtgctgatttcccaggtatattcttatctccaaactcatcaagttgcatatactaattatgttcagcttgttgcatgccaatcatacctcagtaaagtggtttaagataaagatgaaataataacattttttctgtgcctgtacactgctacttgagtagtgtggtttagcgacttgaatagttaaaatttgggtgttctgctgaattgaatttatttcattttgactaattccagaacagattatttagtaaaataaagtagaactgggacttgcaaggcttccaaactatacaaaccaagaatgctttagtgtgagacatgttaagaaattgcttttcaagttactgttctcttatttatcaactttaacgtatcactttaaagaacctcaatttaatgtggacttatgttctcctaaggtgagatataaattacacttttcttaaacacagaaaagcatctaaagtataaaaatactcctaaaattatttgccccttgcaagatttcagagtaattcctaacatttctgagttgttatgattgtggcttttggaaccccaaaattctccatgtagatctgcacctatacatttcatctagccactgcgccactacactccagcctgggcaacaagagggagactctgtctccaaaaaacagaaaagaaaatcccgaaaaacaagaacaacaaaataaccagaatacaagaaccttgtatatttattgtgcaccaggcacatacatgctgtgagatccagagccatagttagtacctgggaatagatatgcatacattattaactcacatagtgtgaagggagattacaattcatactaaattaatacagatattgtgtaataatttcagcaagcttaactagctaagtgacatattatggagttcaattattcatactaattggtaataaataaatgcatttttaggaataagcctcccttgatagataatttactttaggacttctatggttatacatacaatataacagtaagaaatgaaaagggtctacttattgatcaggtgagcagctcactggaaaagaccaatagaactactgaatatgttgaaattccttttgaagtaacttaacccatacaaagctgtgttcattatcacagaatgtttgttactcagctagtaagcaatcaagagagtgaatgaatgaatgacctaagagatccccttgatcccagctccccatcttacagatgaagaaagggagacagtaggtgaggtcacactactcgtgggatctcttcacatttttctctctgctcacaattactttactaagaaaaaaaaattccggccaggcgcagtgactcacacctgtaatcctagcactttgggaggccaaggcaggtggattacctgaggtcaggagttcaagagcagcctggccaacatggtgaaaccccatctctactaaaaatacaaaaaattcactgggtgcagtggcgcgcacctgtaatcctagctacttgggaggctgaggcagaagaatcacttgaacccaggaggtggaggttgcggtgagctgagatcacgccactgcaccactgcactccagcccgggcgacaagagcaagactctatctccaaaaaaaaaaaaaaaaaaaaaaaaaaagagagaaaaaaaatcccaaaaaacaagaacaacaaaataaccagaatacaagaaccttgtgtatttactgtgcaccaggcacatgcatgctgcgtgttctacttgtaccttctcacatactcctcccaacaacagggatgttggtttcacccacgttttaccgatgggaacagaaagaatccatcatgttctcaagttcactatgctagtatgggagtgctcacagcccaggtctgactccagggccctttctctttacctcaaaggtgtaaatggctctgtgtctctgtacttctccttttcctttacctatgaccaatcagtctccaaattctaatggtccacttatcaaaacagtgctgtcaaccagttccttttctctatttcttcagttgccattttaagaatgtattcttactaggatgtccatttgaattacagcaacagcctcctactgacttctttatgagacaccaacaggcagatttctttctccagtcccttttggaccatattatttctcaattaaaattcttccatcagatgtaaactccccattcttgccctcagcatcccctataacttgacataatcttgccaattctgaggctttcctcacttctccctgcatttggccagcactgctcccctctaagtcctagataatgcaatctctcccctttcatctacagaaagcattctcatctatcaaaggcctttgtttcatccaacgtgacttttcctgagaatgcaagttcaggttgatgcaatataactcttaatcaaacccagtgtgatatatatatatttttttctggttgtttttcccatgggtcaattttatctccctatgttgcaagagctttgaggggagagactgtgtttgacctgaccatgtctttttctctttagtaaggctttcagcactggctatgaagtagtcactgtcttggaaagaaaacagagtttagagatatcttggcaatcatgggactcttcaaaagaatctgttccattcttttgcttttcaaatgaggatacagagacccagggaaggtgagtgactggaatatcagagctagttattcaacaatcctttaattcattattgaagctactgttaacactggtggctctagatggggctgttcttctctaattttaatgtgcacagaacttacctggggaccttgtcaaaaatataggctctgattcaatacatctggggtagggcttgggcctctgcatttctaaccagctcctcaggtaccacatgagcagcaagaatgataacttttccccagaccaaacatcccaaatgatgtgttttgtgtttgctatttggtcaaagaaagagcgctcagtattttacatggatatccaaaggaagatttaggaagtactggaagaattagtaaggccacaataaatatgaaaatggagcaattgacaagctactcaaagtatcctcaattacctaacctcttttgaccagtactaattcttacacaaaggaacatttggttaactgtagaacacacctaattatctagaatcatgcaagtagcacaaacaacgggtggctctggcccttggatgttgcccgttatttgtgatttattgtgcccttctcttgagaataaaagataagatataaataaagcatttaagtgaattaatttggtacttttttcatgtttggttgtcaccatttagcaacacaggtacatgtttttgtagataagaagataattaaaaccgagggataaaacactttgagattatctgaggattttcattttcaaatgatattcctatgctcataaagatcagttccttttgtaagctctccaggtgctttaatacagcagttaactcatgtgccgactcagcagctccacgctcataaatggacgtgcccagagcaattaatcaattcctattaagtagtcaatatgatttgaaattaggagctattttggttgtcaagatcagcaattttgactgtcacttgtgagtctattaattgcaaagggctcaccttacaaataacaagaagtcttcctaatgagcatgctcagttttgtcccctgagcattactctgatgtggtgctcccatttacagatatttcagacataagcagcatgatacttgagtgtcagatagtggcattgcaagtcctttggcaatttgagcatcctctgttgttaaacaggggtgatcctgacgacctcacaggacactgtgtggattaaattgtggcacataccaggtatggcggaaaaactaataaatgcaaattgaatgaaggtcacattcaccttatatatggcccctgggtataacaggtccaagtaacttgcctttagctctttagtatgcctttcaaaataactttttctttttcaccttggagttatctggggagtgattggtgcaggtgtttatctttctaaaagcacctgtttgggctatccaatcctttctttatccatggcctttagttccccaatttatcatttcaagagataaactgggctcgaataagttactcatggctggaattacctatctcttctctttctgtcattagcgtcactgcctggcagcaggaaggccctgtgatgtgctaatgacaatcagaataacatctcaagaatgttctgtatgaactagaggctagttctagttgaaattgtactttttgatctactcttagttaccttggaggccagtacatcagcatgattttcatgagaaaatgtattttgagttccaaacaacaaatttagacatgacattctgtgagactataaatagaaaactagagattttctttcattcaaatggcagagggcatcagtaactaaaactctcaagtttttgctctgcctggtgctaaaggtctttttgcttagcaggtgacttattgcattttttactaaagcctctctgactgctttatcattagaaatgttactatttgcctatcaaagcagaactcaactttatcatggcttcgctctgcactgatttggcatcacaaacaagacagtcctttccccttcatcaaacccacagtaggcaaaggctgattggtgggtggggcagcagccaaactgcatagaacagacgggctgtttcattaagaaaaaataataataatcttcctttggcattctcaatttgagttttggcagagcaatctgcctttgaaaattcatcagtcacctctttagggctaaattttaacccaagtaaattttgcccagctgtttcaatgaaaatgtaaaggaactgcagaacaatgaatctggctactctctcggaaatattaaatgacaggtccacctccttctactgtaaggccatctttaattcttggaagtaatcacctggtttttgttacgtagtgttctgaaaaatggaactatcattgctaaatctattctaacaatatttttaatgcctttcttccaagcctctagtggaaaatctgccccattttcctttcggtttgagaaatgtaacaagcaccatttcatttcctaactctttgtaggtacctttaaaatgggcacttgtaattaaagctgtggctgaagagaatatgtcgcttgagactactaaggcaattttgctaataccagctttccaagtccatggggccttgtgctttgcatcaagagtttaatgcttatgatggtttaatagataaaaaaatatccttagaaaatatttagaatcacattaactgtcatcaaatccctagtttgatgacccacaaaactctggaattggaggtgttattgtaatttattccatattgtttttgcaatgtcttaatatgagatatcaggtacttacaggggatggatgctgacaagccacaactcaaggtttagaaataatataaaactccagtaagcatataaactagtcataggaggtagtgtatgaattttctgccagaattatttagcataacattttctagacgcaaagataggatggtttcttggatgagaattggttcttccttctctatagatctatgattaggatcagaaatataactgataaattctagttttattctcagtttcagaaaaaccttccaaaggtactgccagttcagtggtcttcagattacaaggtagaaactgaaaatcaatggaacaattacaaaacctctcaaaaccttaccgtgtatgtaaagctgcttggttagccacagcctattgatcagctattttgttttgtgaagtgggactcatttaatttcctacttggtgtgtgccaatcagtgatgattcccagataaaatttgcatattgcaaagatagacagttttttaaatctcaaattcaatcctaaaggatattaagagcataagcttgtagatgtcatgctgctgacagcctccccctgcctgttatctcccccgtaaatccccacattccctttcacctcacacccacaacgcccagagaataaggctttcatcctctggcaggctctatatagttagagctttaagtgtgaaaatgagggctagaaataattatctaaatcatatgaagattataataaggggctcaacctaatttaatagggagtgtaaatagcaagggaaaacctaaagagaattatgtgggtgacttgagaggtttaaatataagtccttaattaggttacacttatttacctggcccacaagtcagctcagcattaattggaagagatgactagtaagaaaataagattctgtctgtaatcaagtccaacactgcttcctttcctaaataatgtaaggtgtgagccccagatgtagaagagtctttgagacatgatactatgttggctgatgggtccatcttcttgttgctctgtaaagggtcctagaaagttacctggattccattccagtaaaataatgcctaaaccagagcttttgcctcttattatcttctccctttgtctctatgttctgacatttatggggcatctgagtgaactgcagggtcttctggttgttcgggaatagcttaccggggcttgcaatttggtaggatgtggcttggtacttaacaggaagtcagaatccttcagttctatcagctttgaacgtcttcttcctgcgtcacaatttttctctgtcaagggctggtttcactgtgattttatgggggctggtcaagcctgggaacggaggactgaacactacaaagtactcgaaaaggcacagaaaatggttctgtgaacctaggatgtaagtttacgaagaccccttcctgctcacagcttttgagtttcatcaacctcattaaacaatagtgactttataattctaaattgatgtttccttatcaatagctagaaacataataataattagcttcctttcaattacccacatatatatttcccaacaaaacatctaatatagcctgtgctaggtgtatacaacagagaagaaacagaactgacaggagtcctgaggaggctgggttcaagaactatgttgttaaataactgtgactctgggaaaataatttaacttctctaggcgcagattagttagtgttttttaagcctgactgaacagtagaataacctgagtaattttttaaaaactctggatgcccacggtctatgccagaccaatgaatgagactctcttggaagtaaaccttggacataggtattagtgtgcttgtctcaaaagttcgcaagttgtgaattgctgcatccaatctctcaagtgtccttggtggcttaagctctgtgacacattgctgtactgcctgcatgataaaacagacacacagagtgctcctgagcagagatgtggctcacatggcctgcaacattgtaataatgattatgattctctttttctccaactttatcctctacccagactcctgcagagtgtctcatattatgtccagaccacactggcaacacaagggcttcaacttggcttcaaaagttaataaaaatcaatcttcctctagagttttttgaccactttgttaaaaataatttcaactttcaagtattcttgttagaggcaggggacccaaggcatattaaatcagttggccaatctgacctaaatcttagtgaaaaattaaccatgccttccccatgcaaagattggcactctttaacagatggtggttgctgattttccctttctacaaactgtgtgccagtttgtttgagaggataagaggtaaagaaggaacaggttggcacaaaacaattatcctgccagataaaatgagacctccgacctgtggacagctccacccctttgcccagacagaagaatcagaataattgaagggcaagttttcaaagtggacaaaatgcttatttatgtctggatgaagagctggaacttccacttgttaaatattcggtagtaataagaaggtaaattggttctcatttggctgattagactcagaaagaaagaaaggtttacgctcgtagggacagctctgaggccatctagggcagccataacctccgagacctagcctcagagccagctttgtgggcgtgggaccaatatagtcacactattcagaaggccagtgcttagggtccattgctgtgcacttgctatcttaaaattcttaataattttatccttgaatttgtgtttagtaaatgaagtccaatgggacagtggagtcttgaagcttcagttcacaggtggtccctggtcctacctccttgctgcctctccaggatggggaaggtcaggggcgggtatgtaccttgcagcatttcagggtaatgataagggagcagccttctctgtcttgggctggcaaaaccatgctgtgcttcatggatgacttggcagaagttcacctgccttagatactagccatgtcccagtgtaaaggtggcaatcccatggcaggggtcacccatccactgagagttggggctgccagccatcggaagggaggattgatttctctgtccctgcaaggaccctacattttaattttgtactgggttccacaaagtatatagctgaccttgtttaacctgatcaccagcagacaactctaagttccacagagccatgtggagcctcaggagggctgtcgaagccagtgtctatatgtgtcccctctgtggagcacaatggaagatctatctgcttcttcgagtctttctttccactgtgaaatattgtaatatacatacagtatatatttgctctgcgacatggagaaattagttaactattaagggctgcagtaggttactctgtcatgtaggaataacaatactgctgttataaacataaaacaaggtatcatagttaagtacttggcacagtaccagcgatgtagtagatgttccatacattttagttgctattattattgtggttatcattacttgctacagattctgaaagcaattgcacaagtattttaatactaagaaggatacacattttaataaaatcgtttggagtctcagtctccagagttcttagggtctgtcaaatgcactacaattttccagcaggagaaaaagtaatcacagataatgagaagggatcttggttttgtcccccgtaatagcacacccatggcagctgttcaattgttgaggtgtaacagtgtctcacttactgttttgctggagtgagtggatacaggaggttgactgaaagtggaaatctaagtacgtgatgtggtgatccacagaccacagacctctgtcagtgatgggctggtgtcctggacccaccctcctgccagtgcctgtcaccaatgccattcactggaacagagttgattgtggacttatgcagcctggcacccctatggaaatattctaacacatctttggactcctgggaagtaaaggaagctgtttcactactctgtctttgttacttttataagtagctattattttcataaacatcttgagcactagctgtataccaggtacttttaattttctctctaatcttcataaacatcaaataaggcaactatgcctgctttatagataagaaaacttgaggctcagctaagttaaatggtttaatcaagactttctagttaaacagtgagagagtgaaggctgagatccagttctgtctgacttcaagatcatgcatcttaatcgcaaagcctctctttccggtacagtaagttagctctttgtaggaagaataccaacagaaaatagttgctcagctttaacaccagacaagattctaagtgcttaacatgaattgactcatttaattctagagacagccatatgaaggaggaattactatcctcattttacaagtgaggaaactgaggcagtaggaagctaagtaaactgtcacaaagcccattaatgacagtcaggctgtaaataaaatgcagtgtgccttcagatgctgtggtcaaccagtaggctaaggggtgagaacttctggaataattttaaaacattaactgaaaaagtgtaatttggctttctaaaataaaatataagatatgtgcatccaaatgagtgtctttcgaagtatttagtcaaaatgtttttgcaatttctttcagagactgaagcaaataatagtgatgatagtattaataatattaatagcagctagattaattttatatctattgtgtgctcagcactgtgtcaaatcctttacataagtcatcccgtttaatgcttatgacagtaataccaaccatttatacaacagaatacaattactgaggctcagaaaatttaagtaattttctccatgtcatagcattatatgatggttctgggttaaacttgtgttatctaaatccacaatctacattcttcgcttctaacctcctaatactgatacttcactactaacactccatttttaaaaggtattttttaacggtaaaaaactttatcttcatagaatagactggacttgtaaaaaacagtagaagttacttgtgactaagctctaggttttatgaatttcaggtacttctgattcattttccattaaaactatcatttgatgaaaatacagactgcttttctcttgtaatctataaattgtcgggaatcactccccaaaagacagatgagtgcacatttggacaatggcagcatcatggtcatcagagtctcctaaggtgacaactttgagggatgctctcacttacaagcctattggtgctccatatctgacactaactcttaacagtggaaatgatgaccagaggcttatcatatgcctactgggctaatgacacgaggcttgcaggcagtattcaagcatcctgtgaaggcactgggtgtaccactctacaatgattattgcccagcaagccacatcctcatttacagcacttttcttacagggacaactcgcatgacttttaacacgtggtttcagagaatctacattgtatgtgggtcaatcccatactgtgaacagtgactgtactgaattggggacagttaataatcttgtgtgggcaaatgcatctcttaagtgagtaaggaagttgacagatttccatttcccttagttttgcataggccaagactacttaactcattctttgttttcccaagccttgctggaggttgcaaatagcacatttttctttctaaaatatcgttcagaaatggttttaatatacagttcagaattatatttcatagaaaagaagtgttaaaatagctcagtcagccattcgtggtaaagaaattactgcagtggcgggggtggggggcagggaaaggggaagaggagagagacagggaagggagaggtaagaaaagagaagaaagaggtggctttattgcacagttttagactgccattcatgtgaggtgacttcccttgtggtctgtagtatgcttcttttagcaaaatttcttctccagactcaaaaaactccatgacacgcctaagaacagacatctcctgctccaccctcagctagttttctctcttataacagttagaagcaagcttgttggacaatagcatctagaattttcataacacatgctagacaaattctgtcagctaactaggaagtggcccatgatgaaaggtgaaatttaaaagcaaaaactcttagaagtaacatttgcatatttcctaaagtctccccaactcaaaaaatgctttttatgtggaatcttctaatgagaacattattgagcacagatgcttggagaaaaagcacttaatttcgatggcaatatttctcttagaacaaggaaagaaataggtggagttaatcatttctactttgaattaagagaaatgctagttaccaacagaataaaacagaagtctaaagagcaacacattctcaccaaagggataaaaaaaggagttagaaaaatatgtcttaatggatgagacccagaaaatgacataataaacagtgaataactatagaaagctattttaaaatgattaataataagagtcactgtgtctgtaattatttaaaagtcactaattactttaaaaatcccaggaggaaagttttctttttcctgttttatagaagaagggttgagacacacaggggcaggggactcagagcaggtcacctcatcagacagtggcagagtggagattaggcccaaagactaaatttcatgctcttaaccacccctttgcaggacttgagacttgagatagcatttgggagcaactgaatggctttctgattaccatggctttgttggaatggccacctccttggaactcaatggtcccaaaagcatccgtagggctgagttgagtgtgtttgctgatggaccacttttcagactggatgtcatttcgggagaggcgactttcatttttctcattctgaagcacggagatactgggggtgaggccaacatgctggcctatcagacgcccacagcaacacctataacagaagaggttaaagtgaacccctggtattagtcactattgggatacacacttaaggcaaccagctggagaaatctatagtctgtgccaacacctgtcagtcaattctcaggaagaattccaccatgtggctatatcaggtattggtaaactcaggctttccatgatatacatatcttttcttttctcccctctacccattttcctttagctgtataagttgtaatatgtctcctgcccttctccgtccacctcttttgtacctggcattttgttcaggattggacatctgcaaacaaaacttctctggatttctctacttctcactcagcccatctatcaaatctatcaaagcacgaaggtctctgaagagctttgaggaggagaagtttaacatgcacatttaaatgaggaatctcacttctttgtgaatcacaactgaacttgtctcttcccaattgacatttgctgtcaaatatccaattctgagaataaaaatctgcaggcttaagtgttcttgacgaaacaatgaaaaatattcatgagatatttgaaaacttaaactttgctctatcatgaaaatgtccttcatacattactattactacctttatgactattagtcataatagttacaatatgtagctgccatttattaaaaactaacaatttagcatccattgtatagatgaaatattgtagttttgaaggttaggtaatttgcgcaaggttacacggatagtctctaagactctgtagtctatattttaaactgatctgttgaattgcccattcataagggcatttcagacatatatatgctactttatcccaaatgcttcttatcttatatattgttgatcctaaggaaggtaagtagggtgctaacaaagtgcttaaatgggaatctgaaggtatacagtttagttaggaatctgctaggagtcttttatttaagtgtctccttttttcctattgcagaacgtgttggtactaactaagcatttggaggaggtacttaaaaggaaaaaccaataaccataacaaaaaacataatccactgttatatacagtgattaattccttccacaatggtatatatgtttttctttatcggctcttagagtaagaattaattgtagaaatgacatattatatagtgtgtataaataagattgcctcaaagatgtccagaaacaatataaaagatatttaatttgacagtgtttcccttgtaacaggtcatgattactcttgcaggttttttgtataattactacttcatgttctcaacattatagacagcaagattacctatgggggtctttggtgctgggtatgatgtggacacattctcttttataaaatgctctttctatccaggatttctgagcctgaaaaagaaaacaaaaaaaaaaaaaaaagaaaaaagaaagaaaggtgaacataccgtgaaatatttttaactagaaagcaaaatttcataatcacataagagactagtatatcacaaattgaactgaaattgtgattatttcacacataaacactaaatataacaaaatcaattacttcccgtacctgctgattagattatttaacatcacaatattgagaattaaaggaactgaccataataaaaaaaagttagtgatggaatcatgtacaaattcagaacagaaagacaatgctatttgcagagaaaataaatttggagggatagaatagtatgtttgtaaccttatagaaaacaagtattcagtagtgggaagaaatgcatctaaataagcataaggttttcacagctgacacttccattagattttccttgtagaaggaaagaaaaatggcaagagaattgcataactcaaaagccctaatgtatcactatgcttttttctaattaacagtgctaagtacaggggggttggggggggggaggaaaataaaagcatgaggaagataaatgcttttatcatagtccaaaattttacaggtaatgcctttggaaaaaagtaagatagcacattttttcttgtgcgccccacacgcccttcagcagagcatatacagcttcttagaatgggctctgttgggtccatccacccagaagtcctgccactgagattgggttcccatgtggacaaaggatgtctcggaaaactgtacaatctctgttccaaagcagttgtccatcctgcatcccttcatagttttctttaccagcatttgcaatggcagcggagtctcccatgaaattcaatgagctgctcagaggattccttctctaagcctttaagatggaagttgctagagcaacatttaatgttatttctacatggcatcatcttctctctaatgcagcatcagtactaaattcatactcttatatacagggctaaagcacaactgagctgttgatttgacctgtctcaatggtgttaactgttataagcccccatgtgttgaaccataattaatcttgactctgccaatgactcagatgtctataagctgtgctaaattctggttggtcctcagtacttcagtcttgcacctccctcttctctcacaagggaggtttaggcaagcatgtggcaccgaaggcagtaattgcctaatactcgtgacagtgcacattttacaaggagcaacatgagccatggttgaggggcacaaagaaactgcatcctgtttcagtaatggtgaatatcagatggaatcatttctgggtgttcatgcattgtccacatgaaaagagcacccaccgtgcctcagagaccctcaggtccaggtgggcctctgcattctcacaccacaaaggtaacatttgcagttttgcctttcagctaaacatgaaaaattcccaatgtctagtctcaaatatttttcttttcaaacaagtagaaaaggctagtggctacctctttgtaacaaaaatgagcttagcagcgtagacagccagtctttttctttgtaaaaagcctgttcgctaaactattcataggccatgatttttctccagacactgaatactttcattgataatatctcttggcagaaagagggtaaaatgctcttcactggacatttgaaaccaacttttcctacactttagagagcaaaaaaggagaatttactttccttctctttttgtgttcaactttggccaacattcagaaggctcttttgtgggggagcatctgggaattttagagagtgctgaccaatactccctgagaaaaagtgggacaaccttgaccatgggtagagcatgaggtctgcatttagaaaaaatggtgtgagtgggacactgtgacctggagaaagttacatgatttctttgatcctcagttttcctcatctataaaatggagacaacagcaatacctgcaacacagcattgttgtcatgattttgggggtactatgctttgctccaagaagagagacctgtccagggttgattctggtactaaaagttcagatgaaggctcagatgaggggactatgaaattggtctccctttgtgttggggatgataggaacccacaagccctggctggccactaacaagatatataggaagcttatttaacattttggaacctcttctatgtcacatggataattccagctactttgaagagttgttgggataatcaaaccagatgattcagataaagcacctggctttatctgactctgtgaggaaagtactacttttatatccatttttccagtgaagaaattgaggcagagagatgcagcaatacattctaaagccagggtttgaacttgaacagtctggcttcagagttcacactcttacccactctgctaaattgccattaaaacattagatgttattgatatgaaatacccttgttatgggcagtactatctaagcatgcccaggagtatcctggcatttggacagagctggctcccagagacaggtcttggaaccagttcatcctaattctttccccctatcattcccctcttctagtccccacatgcgcaggaatgaatactctgctatgtcttcttcttttctccttgcggtaaaggatgaaggtaggacattaggaagacaccagaatctgagaaatggctatacagcaaagaaatgtaagcacaagactcctcacttaagaatctgtgctgcaaagacaaatggatgagacttttcaaggacaccttccttatttctcttgctcatggatcccattgttaacctggaaagcactggaagttttagtcagatgatgggtggtaagaattcctacatatggattgccagctagttagcgtttcagtaaaaaagtaatttaatttgtgtgtagctttgctacttaattaccttctcaaaggtgaaacgctacatcattgttagcaaaaagactgagaatcgtttctatatcttattattagcagattaatcatctcccttgcaaagtcacagaaaattgggaggaaaacaaaagagaaacagaacattaagaagtcttcccatcattcatgattaaattggattttttcattgagtagaaaagtataagacacaatagaaagaatgcaggtataacacatgaattaggaattctccaatatatcatgcataattactatattgtgagcttcgctttatcatgcttttattcaggtctttagtgtgaacatcatatattagatttttaaatttattttattggagagggcattttgacgtttaatactggtttgtttcctaaacaaattccttttctttgtttgaaggttttgaactactctatatgaagctttatattttgcttcaacatccaactcagttatctcagaatagttatcctcattgttagaaagcatgaaatagtttcgatgtgctgtgtttctagctgacccttcaattcttctttaatacaaaactttaacagacatcatgtcttaaaatcttttctttttaaatatgctttggaagtctcatgcacgcttagaaaagatggcttctatggcccccagaaaacctctctgtatattcttttctaaaggtagaatggtcacataaccatgactgagtttgtgaagggctggttattttctttcttgtctttctgcattatcagtcatgtgtgatgtgtaatagggaagtgtttttcaaaggctaataattaaaagacatcatattcaagacagaaatgaggacactcacattgaacaaagtataatgattaccctcaaagaataaagcaactactaattttgaaagttaaatatacagtcaataaagcatcaaaataataaaaacaagtctgtaaatattgctttaaaaaattaagtcatttcatttaagcaggattcaatgtttttcacaaagtctttgctacaaatgttagtccccaaactactttgaatcttcttactatgtcctccccaccagctatcgaatcaagttctccaggcaggaagatttacaagcacatacacacacacagggtatattaaacccatttccaaaaagccttggaaagtgctattgcaatctcctcttcagcagggcagcttaacagaaggacaaccactcagaccagtatttgcaagattaggaaaaagggtccactaactttataggaacaaattacaagaaaagtttcacaatgcttctcattgtcaccctctcttgtttcaaatgtataccctgtcttcatcagaacaaacatccccaacccaaaggtactaaattcataagttcgttttgccctttccctccaagcctccctcggtgttgatctttggtcttcctctaggtccccagatccaatattgagaagttgaacaagagaaaagttagctgaaatcattttacctgagcactgattctgggtactggcaaaagcagtccccggagcagctcctgttgctttcattttgctgcagctagggctggtcattccgttaataatgctcttatgaccgcccactggaaaaaaaaagtcacttgttcggctcttcccccaagagacgtttcaagtaagcaatgaacttgggcagattagccccttggaatgtgctgcttcgggattagcctcactaagaatcccatggacattccctcccagccctcaaacactgcttgatttgaacatctaatctgacgccagaagaaaaacaaatccccggagagatcggatttaactggcacaggtcctaacaggctcccccgccctccctccctttttctttttccattttcagagagaaagcttgtgaaagtgtgataaggtgttctgagttctgaaagttcaactttggaaagcaaatccttctaaagaaacagtgtatgaatgatcctagtggttggagcacacaagcggcattgttccaccatccccaaagaatggaatggtagcatttctttaaagagaaactgctaaaatctctgaatgtttcagtagaatattttggtccctgaacatgggcctaagaagaatgaagttggagtttgtcggggaccttcgagaacttctaaaatgtcaataataaaacttctccgatcatacttcttatcctgctgcccctctagcaattgcaaatgtatgattagaaacctacagtcctgcttccttattaaaaagaggtgagctgtgaccacggtggcctatggatgcagatcaaaagttgtgatgccctgatatgtttatttggggtggcccaatggagagattccagctggtattcagtcacatagaaagggctctttcatatatcatccaagagtgaatattttagataatagtattcttgattggataagtgaacaaactgggagataaaagagcttaaatttcaagaaggcaaaaatactttttaaaaagtgagtatatgagcacttcatctccaaaggacttttctcttcccaaacacagaaataagtgctaagagatggcactcttcccttttcttgtggatggtaaatctgtgagggcaatggggctttggttttcatttttccgtaatcctctgttaatgcgcctagtacgtgtcatgtggacactcaataagcataatactgggaaacgaatgacttatttcaaacttgaattcggtcctgagccatctttttagccctctgctctttccagggtcaatcttcttcaaactcccacattttctggtctgtaacttgcaaggtttccccagagaaagaaacaataaactacctagtgactttcagttggggaaacattatgataaataagaaccaaatgaaacatcaaacttagttttagctttaaacacatgatggaggaagtccctttgcctgtcttcaggagttggctacagaataacacttggtgacagccttaatgacatatataaacttgcttctctgcagctgtaacactcccaagcacttattccaaaggaatcatcagagatgtgagcacacagagatgttcactgcagtgttatttataatacagaaaaagtggaaacaaatgaagtctatcaacaggagatgaatcaaataaacagtatttcatgccatttggtggtgataatcaggtttcaaaagactgcttaattacgtagagaaataaacattttcatgttgctatgtgaaaaaagcaggccataaaacagtaagggtggaaaaattataaattttaaatagatacagaggtgataggtaggaaacatttttaaggtggtaactatgtagctaatttttattctattctttttgcttttccatgttttccaaagttttctcctgtaaccatatgtttatagtcagaaaactatattttatatagtcagaaaatattttttttcaactgtcaagcttaaccatatgataataggaggttattacggatgagtatctcaggaagagacaaagcaaggagaattaagtaaaaagatagagggatcagtggggaagatttggaaaagaaagttttataatgtggagggtgagttttctagagaaacaaagggagaagaggaggaaagtgggggaaatgagaaggtgggagctgagtgggtgggcagggaaacacctgaaagatacactgagctagtaggctgtagtgggtctgtgagactaaataaattgattgtagataatattctcaatgtaagaaatattttaacagttcatctttttcaacttccttcttcactagatactactccaacccttcatctgaattactttaaacactgagttacatgtatacggagtctttaaatattgcttatgtatttttttacccgattctctccagtcttacttgtttttgtcttgttttccctttataaagataaataactattcaatagagaatagaataagaggagctttccatgaactttaaccaaaaacaaaaatattgctgccagaaccctgggcattttgcttaagtgaaaaaggaagtcccaggtgagcacagcaactttttcatgtgaggttgtagattatctttaggaccctttgatttaagaaggtaattagctccaaagagacttgtagctctaggccacactgtccatatagatctgcataaaatcttgtgcatcacctgacaatgcaactcccaacagggtatattatcaacctgtttcagatgtagtttagagtgaatgtaatttgaatactaacaagagaaaaccacaagggtaatgcttactgtgcttcttcctcactcttttctttatgcaatggcagataccttattcttcccattcattgttaaagaaaaatcacacctgaagataaaatactaaaaagtttctactggtacacaactccgttttgaaaaagtgaaatcagattttctaccatcagtaacgagattttaacatggaaaatgcatatttcattattataaagatgtccaaagcagtatttttctgggatgttcgcatttgacaaccgcatcaactaaagagcatgatataaagtagtggttagcaaacgttttctgctaagggccagatggtacatattttaggctctttgagggcgatacagtctctgcagtaatattcaactcttgttgtagcataagaactcccataaacaacaagtaaacaaatgagcatggttttgttccaataaaacaggtagtaggctggaactggccctggtcaacccttggtatagaaaaaaggggtgtgagtggtgaggtgtcaagcaggaaggagtagtagtggtcttaatagacaggctttcatggcaccatcactagtttgcctttgctctttctcaagcatgtcaggcaagatctccttgagaggactttgctcctgtcattcctgtacctggatagaaccatcctcagatatgccacaattcaccctctcaacacatctggactgctcaaaggtctttcttgaccatcctatctaaaagcacaccgtgtcattatttattcctatgcttccccctattttcctcatagtccctcacattacctgccattgtgctgtgtctttgtaggtttgttttttgtctgtgtcccccactagaatataagttcctgagggcagtgattttgtaactgatgactagataagtggacaaactgggggagaaaagagctcaatgatgttgatctgatgttgccccagatgatgtggccccagcacctagaactgtggcacatggttagcacatagaggatgtaggcaaatcatctgatttccttgcacattaattcttcattggaaaatgatggcatcaggttgaccagcatttcctaaagaaggatttcagggcgggactcagatggtaccatcctaaaaatgcccagataagcatttttcttttgatagttaggtttatattaatatacaatacacaaggaatggctaaacctgcaaatttaacaaatactagtgcttgaagatatatttttttcctttttggagttgtgaaaaaatgagcccatcaaaaatatttaaaaactagagtaaaaatgatttttggataagagaaaatcacgatgatgtcacaaaagtgacccaagtttgagaaacacaggaccaagcgctcttaaatgtccctcaggctccttgcttttattccaatgcttggaaataaatgtattgtgttctctaacatttagggttgccgttggcctacaaaattaatggcagaggaccatgacaaagccagctgcctccagagaacactgccatcagtgtgttctttccaaaacaatcaatggtgccatcccctgatcaataccagtcagtggctctccatccctagtatggtcagctcagcatctaaagtctggctctggctctggaagtatctttcttcaaatttcttcatttctgtacaaatcttcgtacactttacgctccagcaaaccaaattattgattattcccctcatgaaccatgttgttctaggcttctcaaactctgaatatgttgtcccttcatctgaaatgctaggttcttccttctctactcgatcaatgcccctgcattctttaaaactctgcatgaaacattgtgttccttgatgggcttagctggccactgccagagtgaatcaccatgaccattgttcctcttccctattttggtcacacttccattaggggaagagtcacacgatataatacttattttctttccaacatgtataatcatctgttgccagtttccactgcaaatctacagtattctaggtctactatggcataaccagagtgttgtaatttcacctagaacacttcccttcttccttctcctatttttatcattatttggggggtatcaatttctcatccctataattcaccctaggggaataatctctttgtgggctgaagttatttgtactaaaatttactttatagcctctaaacttaaatcatatacaccttaacataatgttaggttagattatgtttttatcatctgattgggaaaagattcaataaattatgatttacaatgataaattaaactcatgttttgtcaataggtcatgctgtgtaaatcatacttaaatatattcagaatgttcatgtagcatgtcattctacataggcatttttataaataattttaaaatatacttctgtttctttggaaatttgtttcttcattatggggcaattaatcattgcttggcaataatatgttatatttataaattattctgcagttcccagaatgctatggcatatagaatttcatgtaatcttaataacattgtatggtagatattataaaattccaggatacaaataaaaatctggggcttatagaggttaagcatcatgccaaagttatacgtcagccataggcttagcccagtggacccaaagccctcatatatttggtgtagagtaaaaatgaggctatgctggtgggaattataacttcgttttctgtcaagtaaatgcagagttgcagcaacataatgtcatgatttaagtccttaattctgtttagctttcacaattcattccttctgattttgttagcagccaaagaaatgtgctgagtcataaaattggaacattttatgttaggtagaaatgtggaatttatgtgacaaataatatcatagattcaccagctgaattttgtttatctctttggccctggaaggatgaagaggcaaaccagaagtgagaatgaaaaaatagttacaaagttgcaatagcattcatagtagagtggtcatgtaaggattaactactaaaaaaaaatcaatctctttctctctctctgtctatatgtatgtatacatgtatattatatatgcacaccatttttatttttattttctttattatcattcctaactactattaagtgttctgggtagagatgctgatttattttagtcaatggatgattccaattctgaggtcaaattatttatcctcacaaggtacagacttaaatctggctgtcggatcttgtttctgaaatccctattttctgtatccattcaaagcaatagtaaggtagaacctgggggacgcatgaccgattaggagtctcaagatatgcatcctagccgtgatttgcttacaactagacatgaccttggaggagtgacttaattttggtgatcttcaaggtcagccccaattcctagagttaggattctgggaatcagctttattgttagtccctcattaacgtgtacaaggtatatatagggccttttttgaaaataagagatctttttaaattttaatttttataaattcatgcaatcatttcttttataagtaaacaaacaaaaatgtagcagagcacacagttttgtgtttacttagtgcagagtacacaagagatttgaattaataagtaattcctgaaataattctcaccagactccaatcatccttaagaatgccctggttgaacaatttggcacatgtgtaaaattttaatctatttcaatgacacttcaaatattattaagatgttattacaattaattaataactctgccatagagagaatttccaagagtagaacttggtattcttttgcctcatcccctactaaatgataaatcaaatcttgaagatcattcaggtcagaatatgcagagactgctcaagatttgtaatattttttgacctaacaaacaagaattatttaactggaggaactgataacaaatcaatcccatttgtgtcatcagaagaaacttataagcagacagatccagcaatataagtgtaaggttatttctataactctctggaaatgaaaaattattaggtattaagttaacgcagcataaatatatttctggctgataggcatttttctgtcaaattactaaattgttaggtagaaaataaatccatctgcataagttcagaattatgcagatttagatcctcaactgctccaaataaaaaggtagaagggtaaaaatatcataagctagtctttaatttggttatattgttctaatgtgaccattttaaggttgttcaaggttattaggcttagcttcaaaatattgttaatgtctttccttatgactaactaccaaagcctatatcttactgatttattcttacctcagtgtgttaatattaaatctttttggaatattttacatcctagaagacactaatatatatacatatacatacatacacacacacatatatagacatatacatatatagacatatatatatataaactttaaatatattaatttaaatttgatgcatgtagaaataatcacaattcaaatgtaggtataaagaattttagtagtatcactatacattatatgtaccccaagtcactatgtagcccataaatatgtatgattagtcgatttaaaaaattataaaaattaaataattaaaattttaaaagataaagtgagtttctgatagacattataaaaataattttcaaagatagcacaaaaatacagatttagtttccaatttgtttctgttccattggatggaaacatgactttttttcctcctctctgttttcccaccatctcacccttacactcatgtagagttctaatctctgaatatttgttgccagaatgaatttctgataatcggattcttctgagacaagctatgctaattttaaaaagaatattgtgctggctttctaattgttccccacaacccattctttacccagcaacaagttatcatttttcccctttaattaatagactttattttttagagcagttttaggtttacaaaaaaagttgagaagaaaatacagtctcatatactccctccttccacctctctccacaatttccctttggtgtagtaccttccttataattggaaaattgatacattattattaactaaaatttgtaccttacattaagcctcactgtttgtattgtacagttttatggcttttaccaaatgcataatatcagatatccatcattaatatcataacaaatagttttattaatggtcttttaaaatgacgaattagctcatggcatttcatctcccacactccacaatcattcaatgatttcatattactttcaaaatagagcccaggttcgttactggatctcaccggccttacatgtcacatcctagctcacttctccaaactgtctatgccaagtcgactcagctcactacctccagccacgtcaacattattttagatcctcaactgctccaaataaaaaagatagaagggtaaaaatatcatgttataagttagtctttaatctggttattgcttctttaaagtgacacaaatattcataacctgggatgggagttgggggagggattactggaaatttgatatttcaaatgtaaatttttgtaagtagcaatttcagaactacctccctccagggaactgaaactccctacagattgttttatttgataatgtgatttattctaagattcctgtttgggacatgagggataagtgtggtattattttggatgtaaggtaattataaactcattaatcactgggaaatcatggagtggaaaccaagtatcctaattcatttatccatttaaactctacgtttgcaagagatcttaggtcctttctccaatatttagtagaaaactaacttctttctggtaaatgataccttgttttccgttggcgacctaagtgcaaagagaaaatcataaaacacacacacacacacacacacacactcccatgaaattcctggctctgggaagctatatataacactatttatgattattcattaaaactgtcaccactggtgatggtatattatatactattgtactagttggatccccaaataataatatggctcttttgtttgaacaattatttttttctctttacttttttgaatgccacatgacacactgatgtgcacattaacattaaatactgacttgacttgaggccacaatgtgtatatatcttatcacatatttgtgtgtatgtatcttatcccactgttgattccaatgttaatgatttgaaagcgaattgttatgaaagcgggcatgcatttttacaaatgcacaaatctaatatctcacaggggagaatcaggtagagaaaacatttcactttgcttacagttctaatgcagaagtctttaatttatcaagattaaaggtaaacagaagcatagctgtggagttaattgtacttcattaaagtcgatgctacctggagctccaactttagtcattacgtggagaatttgaaaatgagccatcagagctgtacttacttattttttaattaattcactcatgcactcaaaaatatctgttgaacactgacctgtgcaaagctcttttagtttctgaggaggtacaaggctttccttgtatctgtttttacgtttatgctgtgttctagaacaatgcttctaaatgatttgtggtaaagaatcttttaaaagaaaatttcaatccattacattacaaactgatacttttataacatgccataaaatcgattatgcacatggattttgtggcaacaacaaattgccatataagtttctaaatgcttattctcaatttttgtactcttatcattcacaaacagtttgtgggccaacaccagtttatgaaccacaaggcactaatcagtgtgcagtgcatggtccagaagcatcagtagcatctgagaacttgttagaagtgctgattcataggcccccaacggaagatctactggatctgcacctacacgttagtaagattctcagatgattcccttacatctaagttgggaaaacaccctgtgctggaggaaaatcaatcagagggagtaaagattacaataacgtttcataatagcagcaataacagttttatagctattgcaatatgtcatacattggtctaattattttcatgtattaactaatttggacctcatcatacacctgtgaagtaagtgcttttattatgctcattttgcagataaggacactgaggaagtggaggttaagctactggttcaatgtgatgcagctggaaggcaaaatacagggacatagaataacttcagtgacacagagaagtaaatacacatgccaggcatgctgagaaagaacagtcactttgggccaggagaggtatctgagctgggcctggcacagagttagtgctctcagcacagagtaagcacttaaatgattactgttgcatttcatttaattaaatttgtgtcctttcttatttccatagcttcagagaggtagttgcaaattaattacctgttctcatactttctacattttaagatttaaattttcctttctctgtttctcctaaatctttacaatggacttctaagtactttgttctttcgcctgcccattaacactctctatcctgactaatagcgtgcagttatcctatattctcatgatgttctctaactcatttagggcagggaccagaccatatctatttaccttttcaaccccttccccaccccagtgcctggcatctggtagaacttcaataaacatctgttaaaataatagatattatacagttatcaaaaaatagagtagttagctgtagatggaacattctttcagatgtgaattaatggaacaccttgctcttttattttcctaacatgttttgcataaatggaaccattaagccttaaaatattgggacaaatgtaactgaccgtctcttaaagcactgtcattgaattgactgagtgattacactgaatcacatgtgcaattcatgctgcacctgtgtgtgcacacacacagacacacacacatgcatgtggtttttctgttagaatctggtagacacactcctagtattgcattcaccaattctgcattacagattacatgctggaaaacactgataaaagacaaattatgtattaaatctccaccctgccttctgttggcattatagcctaatagctcatttgaaggataaggggtccacactatcattcttgaatgtctgtgccttccaattaatatttcatgatctatggaaaaaaatcttaggaaagctctggattatcaaatgctattgtaggggtacagaacatttttttcttaatgtcagtagatatcattatttaaattcagccatttgttaaacagtataattgcccatcaattatgttttcccactgaatttagatcacatgttataccttccctttgctcaagattttttaagccttagaaaataaaggcagattcagactaacctgaaaaataaatttagtcagtgtgattcacaataatggaaaagttcagacttttatttcttaggtagtttttaaatgatggtccttgctagctttcatcttacccaattagaaaattctatattttctatgttaaaaaaataaaattgtgcccacagggtcctaaacaggtggattttagttggtatttgcatgtgtgtatagttgtgtgcaccctggccaggtttaaatgattaattagtccataaatttgaggacaaagtcctgaaatgctttgttcagcttaattttatggctctctttgtgttcttagatggcacatctatactgctctgctcattaacatttaagacctcattgatagcttcctcatgacagtgttactatcaacttgagcttttgtgtcagatatcaatacaagtaacttagaggctacttatatgaagcctaagtcactcaattagtgcttctgttcttacagtcctcttccacctggcctgtttagaacaaacagagaaatgaagtggtagcctgcttgtgttcccaactgtgactgggacagatttttcctttgcttcagtttttccttttgcaaacataaagaatactcctatctcttgttacttcacaagggactatggtcagcattgataaacatgatgacaatcctggattctttttttaaaatgacttacaagtttttgttaaattttttttaactgatacatattagatgtacatattttcaggtacatgtgataatttgatacattcatataatcagatctaaccctggattccttatgagtatcatgtgaggactttgttagcatagggtactggcttaccatatagagactaaaatattctttaaactttctttttatcataataggtggctgaatttaagcagttttaaattacattcttgcttgacttacacctaaatgtcaattttcttcggattacaaaagcacgatatgaattaatgtgaccgccctaccaccacccccatacaaaaacccattaggaattttctgagatttaagtaacatggaatttgattacacagtgcattctggggctcagccacagcaggctgtaggtaccaggcaggctgattatgacttaacgcattgtttcaatgtgattttgcaaaggatttcatttaatgcagattagtaagtttattaagctgttgataattgaagcctcttaagtttggtaagtaccatcgagtgaggtagattagtggggtttaatttgttgctctcaaatagcaaacgaagacttagcagaataattacatctcctctgtgggctaacaaaagatgacattgcaatggtgcttttggccatttctgcatttctgcatttctgcagtttcctttacagtactgcctttagagttttcccccattgctctcaagtgaccaaactcatcaacttttctgttgtttcctgaaattatctctttattcccttggtcacattttaactacattgagggtagggactgtgtctcctctgattgctaagtatctggcatttagaggggctcagtatgtgtgtttaagagaggaatgaattatcttaaacaatcataaagtatgttctgaaaataacattatcatcaagttttcaagtgctaggaagttattcttagccagagcgttaagtagctgtgtcagccaaaagactaagagtcaactcaacttattaaagggattgtatcaatgagtaaaattatttattatttcataaatccttggccacacagagtgctcagcccaagttagtctaccaaacacattaacttaatctctggcatgaccaggtcctcattttgttacatgcctatggtgtcattgcaagagaaagagtctttatccttctgagactcctaggtctgccatatttctagcagagtcataaatcagatggtagaaaatgctacactggcatgagcttacataaattatatctcttaagaggaaatgccaaagctgtttggaatggctgtaaatggatttctaaagtcaattttggttgtctttttcattgctggttgttagaatacccacaaaactgcaggtgtgaaggcttagggacttaggcctcagataaggtcatggtttttgtttttttcaagtggctattcaggtactttatttttttcagaatgacaccaaaacttcacacttagcaagaaattttgagtattctggaacacattgccttcctgaaaacagatgaatgaattatcttaaacaatcataaagtatgctctgaaaataacattatcatcctgttctcaagttcttggaagttatttttagctagagcataaagtagcccactcctggtgtctccctactttataatgttgatcatatgaggtctaccttgaattgttgaggtagtgcaccttgaaagatttaaccaagtgactgtgcaaggatgcttggttgcaggtcatggcaactattctcaatgacttcataataccataaagaataaaggataatgaaggtcgactcctttattttactgagtggtgactttgttcttgactgggtacaatttaaaccatggaaacatttccaaaaacaacattctgaacatatgtgtttcctgtaacataataacaatgggagagtaacaaacttgaaaatgatatatatgtaagagtacaaaatccaagagctatagggaagttctcaaaccaatgtacttcctagagatctccatcagtacctctctgaccacacgtggccatttttacaatgatatcacctccacacccatccccatggtcatagctgaatagaccaatggaccagtggtagtgagtgactcaggagcaaaaaatccaccagtggtcactacttttgacttttgcatttccctcaaagagaaactaaccaattataatcccttttctgaaatttgaacttagaaacttacaggaggcatggaaaattaatgctgacaggtcttgaggcagagaaagttccaaataggcaactacacatgtattagcagaaattgagagaggagattacatgtattatgagtactctatagtgcttgtgcagttagaaacagaaatgctgtgtataagacagaaatcaagtggcctatgaaagactgagagcttgagaaagtggtctctgatgcttttcccattccaattctcatcaatttctaggcccacattaatttctcctcctcgaagtgacttgagtgattttcataatatagttgaaaaaggtaatggtagacttatatgagccaaaggtaccagaaaatttatttcttcacaattcacagattgagcatttcatttgatttacctgagccctatggtagaagaagctgacatcgaggggcgatgagacttgctcaagttcacaccactagtaactggcaaagccaaagcaaggacttcttacccagatacaatcactctttcatgtagaaggcagggtctggtggcttctaaggtagagtatttttatctttggaaagaggccgaatttgcaagacaagtacagaggctgaaacgttctgtgtatatcaggggcaagatcctaggagttattttgcatttggaaacgattgcagttttagctccgacatgtgtgggtcttgatgtcccaaggtttttttttttgatgtggttcatctaagggaatttcattttcagcatttgggtagttgttttctatttgccatccataatgaagggattcctagggagtcagtgttagggtgtggtttataacaatcccttccagggacagtatccaaaagtaaactcctcaagttgcttttttaaaacttattttgtatgttccttctgtattacaaaagttgtgctaattaattgagggcctttgggaaatagctacacagaaagaagaaaataaatattacctccaaccctaactcctgctcagagaactctgataccatgttggcatctataaggcaaatgtctgatttcactttgggatgcagtgacctggtgaaagcatgcagaactaaattaaccattcatctgagaatgcgctgaccaggcaagcaggggcagaactggcgatggccccagcatggggcaaagtgtgcgtgtgtgtgtggcatgtggcaaagctgcttcttattacagaagtaaactttgtgttttatggaaataactccgaacagtctacagaagtcagctttgcattttatgtaaataactccgaacagtctctgtatacagctatgcctttagtttttgcaacatcctaaatgtgtttggttcatgttcctgcttcatagagctagagggcatgtattctgctaatttaagtgattaaatataaattatgacaatcctggagataattataagcataccaatgtattagaaaacaggctgaggaatcaatgacttgaggcaaaactcctgctaaaaatcatcccaggagtttgtgaaaaatgcatactctggtccctcgctcatagattctgaatctgtaggtgaaggtgagtctccagattctcaacttgtttataaaaatcacagataattccatgaactgctttctgaatgacactgctaacatttcctcttcatcagagtttctcagagttggcctcctgacgtctacttgcaatgtgcccaaccccctgttgctgcctcctttgaggtcctcttcatctcactccaactctaactgcacttttctaacaggctaacactctgtgcccccagtccctgctcccctctccatccttgacggtgccataagaagtatcttcttaaagcaggatttctcaactcggtattattgacattgggtattattgactattgcataattctttgttgtgggtgctgtcttgtgccttgtagaatgtttagcaacatctgtggcctgtattcactagataccagtagcccacctccagttgtgacaaccaaaattgtctctaatcattgccaaatgtcccttgagggcaaatttttttccctggttgaaaaccattgttcctaaaccttagggaagaatgagttagtctcttcatccagtgtctgaatgttttaccatagcatccaaatacctatgtgatttgcccccaaaccacattttctggcttgtctattattaaacttctcaataaccctcactttttacccagctaggtcattcctcctactagccctggcattcacacttctgcacttgcttctgctttttctcaggccttcggtgttcttcctttcttgcttgctttaccaggaaaaccttagctcgcttccaaagctaagctcaaaatccattctctccaatttttcttgagttttctaattaactccttctttttgtactacatgtttacttctgcttttgtctagaaagtattcactcaaattttattctgcaaccaatttttccctatctctttcacccttgtagataaggaccagaccctatttctgcccaagtctctggtacttagcatagaaacagcacaaattgcccttaataatacaaagaaacaaaatttggcaacttggcatttaaaatataccacggaaagtaaaatttttcaatctgtatgttgtaactgactcaccaagaataatgacaataaaattaaatgtgaatgttatagactttcagcattacacttacagccaggatgttaaccatcaacattttagaaaactgcatttgcattgtacattaagtccttaggtaaagttaagttaaaatctgtaagaacaagtgacacagttattaataagcaggccaaattaaaaaaagccactttccaaataaacacatgagccatggctactttagtgtttttcctttaatagatataaattaaacctcaaatcatctttgaaaagcactgattcagtagatattacgtggagcatcgttggtggaactgttacaatgggaactcccaaggagttctaggttttaggagatgctctattattgccttaaaaatagcagtaatttaaagtaattatcttgtctccatttccctcagtgccttgtgcctttactttatattgtacaacaaatgcacctgaaccttctaatcttaaccccgggtctacagtgcttacttctaccacctttgctgccctgaactcagaaaaaagagatagggtcaagggtttgaaggtgaagtaaggactgctgaggaagaaatattactggggatggcgatcctctgtgagtgtctctttttgtttataatgagtcaacacttttttttctttttttctttttttttgagatggaatttcgctcttgtcgcccaggctggagtgtaatggcacaatctcagctcactgcaacctccacctcccaggttcaagtgattcccctgcctcagcctcctgtgtagctgggattataggcctgcaccaccatacctggctaatttttgtatatttagtagaaacggggtttcaccatgttggccaagccagtttcgaactcctgacctcaggtgatccacctgccttggccacccaaagcgctaggattacaggtgtgaaccaccgtgcccggagagtcaacacttataactgacaaatataactgcaattgacaggaaataaaatcaaaacatatgatgagtcaaaaggaaggacattcttctacattaaaatctgtaatagcatctgcctagagtttaccaatataaacaacctaactcctacatcacttggatctctgcacacaggttacctgtggctagtggattgggctactgcttagaaagaaagagggctaaggatgtgagttccagccatctagtttaggttgtttcaggttttattaagctcaaattgtgtcctgtcaacatgtagtctccttcctaactccaatgttgaagtcacagaaagaaaattaaataatatttactgaagttctggatatatcttcagtgctaattgttcactgacaaaatgattcctcactatgtcattactcatctaaagtgttaatcaaacttagaaataatatacagaatagaaatctaaaaataatttctccattttaagagcttattggaaagaacatgtgatacaaatttaataagtaaaattttatgctatgatatttatgccagcatgatgcctttttatgtagtacttcaggagagttttcctgaatatctggtatgataagaagaggcttctggcaggcaaccatatgtttcttattccagtagttatgattcttcttatttatgttacagttgaaggaatgaggcagcccatacaaatctattttcttagtatctgggtatcttgtgggtttcaacatctgtttgtcaattaccatctcatttctttaccaccagagaatggtttgcccctttacctctatgtacataaatacacactctcataagcacaaagactttaatttgggcagaagcagagatacagtctataaagtactatgtatctttcccataaccatcatatgatgaaaaataatgtcaacaactgtgcaactgcagtatgacaagtgtgaatgccctaattggtcaactggaccagaatgatgagttgttgtttttattttaaaccaatgtcacttctaatctattacaatggtaatgaacagtcaagcagcctatttcccacggatatcttcaaagctctacagattgccatttgaaccattctttaattgcctctggcacagattgtagcatgctccatagaaccaagaaggcgtattaactagatttggctatccccaagtcactataatgatgaggctttatatgactaaaggaggttttagcttcagtctttactatgaaccattataaccacccagcacatagtaggtacctgaaaaaagtgaatttttatggcaatatagtcacattttaatttcttgttggattaatgggagttaggagtattttttgctcttgcttttattttggggtgtgtgtgtgtgtgtgtgtgtgtgtgtgtgtgtgtgtgttccaatcctagaagtaaaattttctggataattaagataaagttagaaattaccagatatgtattctccaagccttttctcagaaaagtttactattttttattagaagggttttactcttgaatttagtttgccaggtacaggttttgttttaaacttttgcctattgtcttacatccattgttaatgcatgttgcataccatttgtaaaaatttcagattgaaagaatggttgtatcatatcctcttcctgagccagtgatagttcactagatctgcctgtctactttggctcagcagaggtgcctacttgactcctgggcctaggatgagaagaggaaggagatgacatgtggttcccttcaagccgacttttgcctaagttaaggggtggtcatgtttttagaatgggaaggaggctgattcaacaacatttctgatcaaacctggaagattagacatatgcatttatctcgatttctctcaagtattcttctaaaatgagaggaaagttgtaacaacaaaaaggcatgacctacaaggacaccagtatggagaaggaagtgggaatacataacagatgtcaacaaaatttttggaaatttcaacatgaatggatgggtagtaattaacattgccaactagagaatgttcaaagctcgggaactggaaggggtggcacagccagcaagaaacaacctgattcaccccactgaaactcagataggcctaggaataaaggcaccaggtatttttaaaggctaggagatgggtggaatagcaaggtcaagcccatatgggacaaatggttgaaagtctttaaaagaaccagccaaacttctgcctcctctccacatagccaggaaactgctgctctcccaccaaggggaagaccagaagttgattcttttgagaagttgaaccttagactagatgtacggctgaaagtatgaggcaccaggatgaaagcaaaaatatgagtgaaagtttacacattgatgggcgaggtccccgccaaccccacctgttttcttacctctgtcggccactagaccatggtcagtttggctctatgtcctcctccaaccccctgaccatctgtaccccacccaacacacaccttccagcaggatagtggtggacttttctttggaaatattgaagagcaccaaacagacctcatgatcttgactttcaggaatctcctaagaaaatactgggtatccatagaaaagaccactggtcaataaatcccacctaaggacaaagaattcccaatctgcattttaatgccttactctgaggtataagagcaagcttatacttaggtttaagtaatagaaaaggcttaagtaatagccaagggtcatcaggaattaaggaaagcctctaccatgaaagacaggaaccattaaaatgaaacaataaaggaaacagtacagaaaagtatagtaaaaagtgtatatatggcatatacttagtatatacagtatatatagtaaacaacataaaattagtatatatgtagtatatatgctatatactatatataacatactataaaatataaatatttatagcatattatatatttatatttatatattctatatagcatatataaatatatacacactatacattagtatatataatatacaaatatagtgtactatatactatatagtatatatatagtcaatagtacaaaatatatacaataatataatcagtagcctcagagaactaaagaagacccaagcatggaagaagagagactataacacaggacatttttaaaacaagaagagagtgttagaaagttaagagatataacaagaaaaacaaaaacctaaatagaagataaaggtgaggaagcaaacgtgaggctatctcttacaaaacagaacaaagagaaaacaggagcaaaaaatatataagttagagactcagtaataaaggtttccagcaaaagagaacagagaacaccaaaagagaaaattatcaaaaaaattgatataagaaaaacttccagaattgcagaacataaatttccaaattgaaggggtcactgtgagtggccagtggagtagatgaagatagacctccaccaaagaataacgctgtagaatttttaaagaccaagacaaagataagattctacaggcttccagacagaagaaaacatatttcgtaaataagatcaagattcaaggaaatctagaatgcaatggggatatcttgaaattatgaggaaaagatttttaatcaagggtgagaataaaataaataaatgttagttcctaaaatagttcaaaatttaactccacatgctgcaacatttcatgggatgctattggaaaatatgctccgtaaacaggaaaaaacatggtatctaaaaacagggaaccaagcacaggacagaggcagagggaattcataaaaggatagaaaagcaaagtgccagatgataagacagctctgcagcagagctgggaacagccactcaaggctggagtgtatgcatgaaaacaacaacaaacacaaacacaactaacctaaagaattgttcagcaatgggacacaggaaggggaacatcacactccggggcctgtcgtggggtggggagaggggggagggataacatcaggagatatacctaatgtcaatgacgagttaatgggtgcagcacaccaacatggtacatgtatacatatgtaacaaacctgcacgttgtgcacatgtaccctagaacttaaagtataataaaaaattagaattgttcagaaaaggagattgaataattttatatacagtgaagaaaatttgcatagtcatagaaaataaaaacactgaatactgaaaaattgaaaaaaataattgttaactgtatggagagtgagggaaaagatgaagtatatgctgggaaaagggaataaaatagctaaatcccatttttcaaagtaaaaatatcaaacatgcaaaatgaaaaaagcagaattataagcatgctgcttataaacatagagttaaatgccagaaaaagatgcttttagagctgaaagcagatgtgaaagcagatatgtggggtgagaagtgtcaggcaagggaccctgttttttgtgtgaaagtcctcgtagcactatttgactttttaagctctatcataaaactatgtaataaaaatgaacagcaatagcaaaatttggaaaaacaaaaacttaaatggaagtactggaagataaaggtttcaaatgaatgaaattgtatccttagttatctctccagctcctcttgggttgttgtataaaatgaacatgtattatgtaccatgagccactgttaggaggtttcttatgcattatctgatttaatcctaatgacaactctgtaaattgtcatttttgtccccacatcccagataagaaaactgaggctcattgttctgaagatttgctgaagacctcagggctggcaaagtcagacccaaacttaagcctttctcaccttgtgccttaggcgcttaccatatcccagagtttcattttattatataagaaagtttacttcaaaacttacggactaccaagcttctcccagcctacagatccacagcagggtgaatacctggataataactagaattccgtggttggagcaggagggatttacgaggaaaaaaagggaaaaaggaaagagatactgagaggacttttaattctcagaatgaatcgcccatgttattttaacattttgtgccttaacgttttggaagactatatagagaaattaattattcatggagtaagataatttacttcttttagccacaagtgaattatacagtaccaaaagtgaaatgagttaatatgtaatatcattcagaaaaagaggcctttatgagagtctgaacataaaaaaaggcatctgtaaattcgtagaaatacctagaaatagggtgattactctagatcagcacttctttgcctttaaataaatgaagtcagatcctgaattttgagattacaaacaatatcaaaattattttcacagctgtgcaacatttattatcttgaaagaataatgtggtttaacataatttaattttaattattttaatattttatacttttggagagaaaaaagtctcaagtcaatacattgctacttctttaggttcaagtttcaaatttacccgtttgacctcaaaaaaaaaaaaaaaaactagccaatctgcaagcatttatgagaatctatcacattcatggatggttaagaccagttctaaataaatatatttctgcatgtagctcaagagttttcaattaaagaggctattctaattctcaatcaatactttaatgtatgtggttaaaatgtaagtggttaaaatcagtaattattattacaaccatagtatgtggtgaaatagaaaatcagttgaacaacaaaataatattacaggtttcttgttttgattgttaccttcacatatctaggaaggtcacttaatttctacatgaccggctatatccacaaataaaattgagaaaataccatctactctactttacaaggttgttaatatgctgcaacatgagatagcattttaagcaagcacaaagcactatctatctacaatatattctgaaaaagaggcaatgttgatgatatatttccccaaagcagagtctcctgtgctggactgctattattaatattatatgtaggggaagacattttctgcgacaccaataatgctttttctaatgaaactattccccacaggtcctccagattggaagggctgcataaccatgctagggaggtttgctgggtgaaatcacatggaccatgccaggggcttgggttagagaactgcctttgtcataagaaaacttgggtaattcacttaaatgctcttagccttagttttcttgtgcatagaaaggaagccctaagatgctttatagggctctcattaggttcaagtgaataaagaatatgaatggctagagtgtaagaagctctttataaatgataaaacactatataaatatgttatgatgatgctactactaatagaaatatcagtataacataaatatccaattgtcccatggtgactacgaatggtttatggaatactacatatatttctagtagtaattttgatgactttgggattgaaagtgtacctcctagatctggaaaaattagggccctatactcctatctactgaaaagggaaaactgtaattatggaaccacattactgtggaagcaaagcgccctcctcctgaaatccaacacgtggcgagattaaaggactaatggtaattaaacattgacacagagtgaataagattaatattagaaaaggattacatcagaaaagatttacatcaaaggattctttctcttttctcccatagaaggcctaagacacaaaagaagtcttatgcaaaacattctaagcctctcagttattttaaaagaagctgaaaaaaatgatgaggtaagcacaaatttcttctactggaaaatgccaaaagttataatatgcttaaggatttactccacatatgggaaatagcaatatattggaggacaaaatgggtcacggatgtccaggaacttggaaaaatgtttggaacattgttggaggaaagcatatataatagaatgaaaaggtgcccataagccatcccaccaaattttaataccatcacgtgctccttgttgagctacaaagatgcaaggattttgtttgtttgtttggtgttagatacaaatgcagtgaatatgtgtctatgaaatgaacatatagaataacattatatgaacaaacaaaaaggaatatcttcagtggggttgcccaggacactaccagctaggagcatagtcaggattaggacctggcagaggtctgctctagcctatgaggtcagtggttgcctgggcccaagggaccatcgggcattacttgggttttctgggactgtaccacactggtttgctacattcagcatttgtatctcatggatacaaatgcatttctttaaatatcaagatccatgctgttggtacaaaggccagggatatttctattaaacacatgtttcttgagcacctaccatgtaccaggcactgctttaggaacttgggagtacagtattgactaggagagcattgaactttaggataaaatacaagattagttgcagttgagaattttctaagcaaaagtgaatgcaagatttggcttctccaggactcagatctacatctatttgggctgtcatacagaattgccataatattaccaaaatatatatagcactcaacagtttgctacgtaaagtttagtagtatcataacaacatcacttagttatacaatataccttcttgaggatctgtgtcttcaagaagcttacattttagtgtcacgctgattctaacaggacctattgcggtgctgaagccctactgctaagattgtgaatagaaaatgggaaaaaagttttgccgtcagacaactttggcttgaatgctgactgtattgagtgctagtgccatggcttgggaagataccttatcttttaagagcttgtatttcttcatcagcccaaagatgctaatagtatctatcgtcatcaaatgttatattgtacatgaaggcactttgcaaaatgcaaagtgctacataaatgttagtgctattatgacgattctgtatgccagtccagatagatatggatccaggttctgaaaacaggcagcgctgcattttcttttctttacacaattctcaaatatacacagctttgtattttattcttatgtttaatgattactaacttttaacaatgttcttaaaattcttaatattttctacaactgggtaggacctcctggaccattctgaataggcacatctctggaagatagcttacactttgctgaaatctaaagggacacaataattgtgcacacatctgaaataaaactacgtaacatctggattgaatccctaatttttcttttccttcacttctgatattttgattagaattgtctaatacaatgaaccaatcaattacagataacctatgataactcccatattttatgaaaagataaatggactatagaaaattcccagtatttatgagcaaattcccagtattatgagcaaagagaattcttttatacaattacctagttggtattatattagaaataccattttcaatgaatttcaatgaataccattttcagtgaatttacaaactatctggggggaactgagaatatatttcacagatagagaaggaccttagaaagttataatctttataacttacaaaaaaaagagaccacagactcaccctcaaaacaacccagaaactacagagttgatctcatcaggaacacacctggaagaaatagcaagtttgactagagatgtcaaaactattagataactctaaattaggaatgggagagtgataaccagaggtgactccagtgaaatctcaccacatagggaaaatgtaccctcttataaaaagcaatacttggatcaaatgggccagacaacagatgccctaaaaggtctaaaaagaaactaaaaatatataagtgatgggtcacaagacagatcattagagattaagagtacttttagaaaaaacatgagatgaaggacaatccctagaaaaaacatagaaaccagaacagtaacaattcataaaaatgtgtttgtttgtttgtttgtttttggtgcaggctgttgttatttattatatgttgacacagtggcagaacagctcaaaaattttggagatgttcatttctatcttctatctgcctgtgctccctttctagagcaggctaacacagtatagccttgtagaccagtataaagtggtgctttaatcttatagacttacttggccaaattaatcactgaagggctagaactcttgaaaacatattgggatctggatgaattttctacttcagctgcacatattgattacattaagcagataagtgccatatcttcaatttattttaagcagtacaggcggccacagaaaataaagaaccagatgctgcaagacaaaagaattcaaaagtgaatgtgtgtgaattattgtacaaaaaaaggactagtcaatttgtgaacagatagagacaatgagcactttcaataacaaaagaaacaaaaactatagaggtacttaatcacaactggtattcattatgcaattaagatattttaacatttattaataaaagcctaaagtgttcattgtatatcactcttggatcgaattaggcagattttaattaaaagattactactaacaaataacaatgatgagatttgcaggggctaatgcttaaaccaggagatttatgccttattaaaatgaattcctctagtttacaatcattttctacaagtcagagcagcacaaagaactgcctaagatcacagaacattttggatctaagcagaccttatgaccaatcttttctttttattgacacataagagttatacatatttatggggcacatgtgatattttgatacatgtatatactgtgcaatgatcaaatgagaataattgggatattcatcacctcaaacatttatcatttctttgtgttgagaacattccagattttttcttttagctattttgaaatatacaataaattcttgttaactgtagttgccccactctgctacagaagactagaacttattccttctatctaactgtatttttgtaccaattaaccaacctctatctctccctccgtgctccccttcccagcctctggtaaccactattttactcactgtctccatgagatcaattttttattattcagccgtaaaaaagaatgagatcctgtcatttgcagcaacatgagtggaactggaggactttaagtgaaataagccaagcacagaaagagcaatattgtacattcttactcatatgatcatacttttcggtaactgtgaaaactgagatgtataagggtagcgaatatcagcggtggaattagatctcaattttcaatttcccaacaattctgtttggaggttcttttattacatcaaacagttgtaacagcccgcaaggtctaggctgagttttgaagagaaaattgttttctcagaggcaaatttctagaaaactcataaagtctatagtaactctctccaactgggagaagaaactgatggcatctagtggagggaacactcagagtatgctaaaggcttgaaagattaaagaaacaatggcttctaaattatgctgataacctattagttggtgcaaaaataattacttttgcaccaacctaatagaagaaattctctttattgttgtaatagcgcattggccattaatagcatttgtggtgaagttcaagaagggtcagactggtaaattatagcaaggctcacgttgtgtagggagttgttattaaacaacagataattaacagctcaagaccaactaaagcattaactccaatttctggagcttgcctagctctgcagatcctcttgcttgaataacatccccgaccagtgatacaataaatgactcattaggacggtctttatgttggttttgcaggcacctacattctcactaagcagctcactcacaataaattgttttttttttttggtggctgggggacggagtctggctctgtcgcccaggctggagtgcagtggcgcgatctcggctcactgcaagctccgcctcccgggttcacgccattctcctgcctcagcctcctgagtagctgggactacaggcgcccgccactacgcccggctaattttttgtatttttagtagagatggggtttcaccgtgttagccaggatggtctcgatctcctgacctcgtgatccacccacctcagcctcccaaagtgctgagattacaggcgtgagccaccgcgcccggccacaataaatttaaaagtaaatgtttttgaaaaatttattggtttccggccgggcacggtggctcatgcctgtaatcccagcactttgggaggccaaggcgggcggatcacgaggccaggagttcaagaccaacctggccaacataatgaaaccccgtctctactaaaaatacaaaaattagccaggcatgtttgtgcgtgcctgtagtcccagttactcccgaggctgaggcaggagaatctcttgaacccgggaggtagaggttgcactgagctgagatcgtgccattgcactccagtttgggcaaaagagtgagacttcatctcaaaaaaaaaaaaaaaaaaagaaaagaaaagaaaagaaaagaaagaaaaaatttactggtttcgttctacttctgcaaatttaaaagcagcctgaagatagcagctgctgctgataaaacgtgggctgaactagtcttttgaacctgaaccctttctgggaatgagggtggttcaaatgcaacctttttgggaaacctttgcttaattggtaagtttgttaccaatatgaagcttggacaacagaaatcatacactatccataggagacaatgagtgaaaggaactgaagccaaggccagtgcctgcataaagtgtttggagaatctgaaatttatgttcctagagaaagaaggaggacatgaaagcctgggagatatctttggaaccaaaatggaaaaccaatagggtaaaccgaaatttagagggaaagagagatttcagtttatagagtaatacagttataaactacactcactgattgtacacttgtcaccacagctttgttgtagccttaaaagatgacttgttattcctggaagtgatcttactgttactgtttattttattaaaacaaggtctttctggaaaacctgatcatatcgttcagctgctccccattgcctaagagtttgtgaacaaacttcttatggcattctgaacccttttctatctcttttccttactcatctctcattacgtccttccttcacatcttacacttgagctacaggaccacttgcaagtctccaaacgttgtgtcataacggtttgtgttgttttttcttgtgctgcttcctttgcctaaattgctctttttgttccttcccttgaccccttatgaatctgctgtcttgcaaaacttttaattgatgaaactattcctaacctacgcctcagggagaactgaccattcactcatttgtgccccaatgcatcccacagatgcttagatcatagtaaggattctatcttaaggcatttgcttgtttgagagttggtctcaaatagactgtgaacaacactgggttaggaaccctctctgctttattgctatagacgtagttcttagcatcatgtttgcatagagaagatacttgatatttgaagaatgaatgaatggaccaatcaaccaatcactggataaatatatacttgatgagactggtcttaataatactattgcagcattatcattgctttaaaatatttgtaaaaaaatataagaataagcactgcacaaactctcattatctttttccttcttgggcagaagaaacatttagagaatctcaaggttagaaaggaccttaaaaataaattcattggaaaagaaaaatcaagttccaagtataagaatcataactgatgacacagatacaatcatacttattaggggacaagaaatacatctctagaaaatcaagcaaataaggaacagaataaacacagctcatggtttaaaaagacttattacactcagctactcggaaggctgaggcaggagaatcgcttgaacccaggaggcggaggttgcagtgagccaagatcacgccactgcacttcagcatgggtgacagagtgagactctgtctcaaaaacaaaacaaaacaaacaaacaaacaacaaaaaaaaacttattacagagattaaggaagtaaaaaaaataattgtagtgacatttggaattcaaggcacaaacaaggaataacagaagaaaataaatagaccagagcattataggaatagattaaaattttaaaataatcaaaataattaaatgctttctttccaaaggcgtattctctaagttatagcacaaaactagacagtattcacaaatactttgtaataataatttctagtttttttcccaatataagcagttggttcacttggatcaatctttatgcacctcctcgtctcctcttacttttttcctggccaaagttactacacaacctgactataagacagcacttctgatgccgccctaaatcgtggtgatggtccagcataacctttggtttcaggcttgtaagactgataaggagactggaagggccaggctagagcaagaatctatatctggcctctactaagcaggtagtcacaatactattgtaagggcaatatcttccttctggatcagagacactatgaaggactatgtctttgaggtttacaaagtgctttcaaaactattttccattatatgcccagtgggatgtagaaggcaactttttctctcatttgttttcaacagaaatcactgattgatttgccttaacactatcctttgcttcagtgctatttgtaaactgccttgttccaggaggaataggatagcctaaaatgaaagtgacatgaaaaaagaaagaaacaatgggtggggacctaacatgtagccaggaatcaggtaaaaatgcatacagtaatgacctacacagttgttattgggtgtggctaagataacacaaatcagagccaaaggaaacacctttgatcattgacttccttggacacaagtagattaatggccttttaagcattaggtaatatagggtcagtccttggagagaaacctcccttgaggaagctccaaacactgtcaagtaatagaaaggcacacattctaaaggcatatttaaatccagtggcttactttgcgtaagggaaattattaatataacagttaacttttttttttttaacaaggtaggttaaatgtaactttggtcatcagcataacagactttgtatccatggtggtaaaacattttatggaatttgaaatatatggtggaaaaatatactcaggagatttttaatatccagaaataaattcaataaatatatttccaaataaattgcaaataaaatttaagcattcaaaaatcaaaaatgtataatgggagaggagcagcaatatgtggagatgtgaaagatcaattgactttgaaaatttgaagcatctgaaagcactgaagttttgatgctactcaatggcacaaaagaatagaaaggaggcagattttgtttccaagttattaatttccaagttattaatgattgattaatgacccagagaatgactaatgatatgagagtgcatgacagcacatatatgaaagtgctttgtaagctttaaccagctgatgatgttcatcatcatcattaggcttctattacatgtcacatattgtgcttgttgccgcaattaggataagataacacaggcagacagctgtggccacacaaggcaagctttatgcactgatgttctttggtagttgggggtggggtcacatagaatgtgagggtcaaccttacaggtctagtcagtaacacacagaaatttttatgtactgtcattttcctttaccaaacctgcttctctccccatgtctagctgttaatgaaccaaattaaccatccttgcaagcaaatgacatctagcaagggcagtttcagagaagtctaagcttcaaatagtataatcttgcaaagtcagtcatggctccagccccagttggggcatgcccctttatgtattcacacaacaaagctgaggttatgcttgactctgttgtactcaggatttgggatgcctcatttcctttttgcccggcactgtacatatgtgataaatgctgatgactgaatgggaactgcttaagatttatcttatcactctgaaggcaatttattttcatctggggaggacaaaggagggatttttgcattttgcaaaagagacacatatttgttgcaattctatgagacaagttaaagtcagtttggtttttcttccaattgttttacctattatttgaataagaatcatgtcaactgctttcctccccttcttccaaagaaactacaatgagcaaaaaaaacaagccatgctcattcattgatttagttcttaaggacatatccagtcccaggcactgcattaggtactggggaactctgatgaataagttacagttcctgctgcctaatgcatccctcatgagtgaatgaatgaataacttgtgactcacacatagtaatgttttagggaaagagaaagttgttggcttgaatcaccttagaataagccacagaacgtatcttaagggctcacagtgttgtgtcataaatagcagagcagatgtaaccctcggcctgcctccagttcacagtctggtgcagggcttgccacaagtacgtaaggttccacaatacaaggcatcgtgtgttttgctgtaaaagaggaggtgaagcagatgggggatgtaaagatgttatccactaggctggcgagggaaaaattacagccggaactctttcccaggaaggaattcagaaaccaaatccagcacaaaagaaagatgactccgtgttggtttgtaccttactgttctttcctgtgttgaaacgttaacattttcagatataataggtctttttttccagttcactcagcacagacaatgtgctagaagcctggacgaagttggcccatcagcagggctttgcacttaaaacaaagatctgagctttcctgactgtgtaaatgagagttgggacattaatacacagagaaatgagtgacacatttggttgtggggattagtgccactgtatggaaatgccacgttggcgcccctacatgaacattctagacctcttaaagtgtgaatggagcttccatccatctccccaaaaagaaaatttccctttaagtggcactccattcaaagtgtttttggggttttttttttaatcctgtaaaaagaagggaattacaattaggaaatatactttttccttcacaagagaactgaaagataagaaatttgcctttttgttgagtttatttatcaaaaggaaatgtaaaagcaaaatgtctaatatgaaacactaatgagaattactcaatttaaacattatctatagattattcaattttattagctagagccagtagacaataaggcaagaggtttaatttaccatacttttagttaaaatgcctacatatagcagggttcctcatatataagagatgtacaatgaatgagtttatgtaaatgttcgtttaacaatccattgtgtatcctcaagaatacaaaaaagaatgtcttctctggaatgtagaattgtataggattttaaattgtcagataatttttcttttgctgatttttttaaaataaaaaaaaaaatactgtaattccatcattttggaagaccaaggcaggaggatctctcgagcctaggagtttgagaccagcctgggcaacatggcgaaacctatctctacaagaaacacaagaattagcaaggcatggtggtgcacacctgtagtcccaactactcgggcagctgaggtgagaggatcacctgagtccccggaggtcaaggctgcagtgagccctgactgtgtcattgacctcctgcctgggtgacagagtgagaccctgtctcaaaaaataaaataaaatacaaaaacacctcactcttttggcaaacttgactatccaaaaagcagccccaaatcataatgatatttgttaactaaatacttgtctgataagaaaaaaaagtcttctgtgaagttacttatttttaattaaagaaacacaactcaggtgctcattctgcttccactttctctaattcactgcctgcaccaataagtacattaatgtggtttccaagagctcagcaggttagaaacagcttggggaagagtgcaaagaaggaggagggataagaaggcaaggacctcagaggcggataagtagggagtaaccagaaaacaaagcatgctggggccaacacatattaacaagcctggaacagcccatctttcagcactatacagaccccgatggccacaaaatgacacagtcctcaaggaagagctaaattgggtttgttatacttagtttaagaagacagtaatcactgagaatatatatttttcagaggtgttgaagttttgctgtagagacaggtcaacaagatttagagctataaatagaaaatattttaaaagagggcttcagggagagtcttcattgaacaatggtttcttttgatatcagcaaaatctgaaaggagcttttctaacaattttgtttatatgtcagagcttaaagttttcttatggctggggaagctttccttataatgatccccgagtctcataacatctgctttgttgatgctgtttaatgaagtaggtaagcaaaatctcaactgttttggcaactttcaaggggcagatgccagtaatcctgaagagccacctccagagcatcagtaacaattagatatgactcccatcaatcatggattatccactttcctccagttgcatttctgagcctacaaatgcaatgtgggtcatattctagaggagcatttcccaaacctatgccttttatagcatattcctgcatgatgttgctttaaaagtttctgaagttaagtatgtttgagattgcggtacattgtaatgttctcctggagataccaaatacacattgacatattaaagaacacaagtgctgcagtaaagaaagctgttcaattttgtttaaaccaatattccctaaacgaatgtaatgaaaagtctctctcttctttgtttagagatcagcagcaactgttaacatcttacagaagataccaaaggtcctatgttagaatttttacaaaccgactgagggtgacagcctccatttagttgtaattatacaattatattatttcatattttttcaaaataaaatatatttagttattctgaagagtaacatactactgtatagacaggccaacaagatttatatccataaatggaagcatcaacattttagaaatacctagaaatgtgatgaataaccttttgtcatctctataataacaatgctccagtgaccaatatacagacattattatcctctgtctgggatctggattctaataagaaagtcgtttctttttttttttcttttgagacagcgtcttgctgtggcacccaggctggagtgcggtggtgcaattgcagctcactgtttgcctcaacaacctgggctcgagtgatcctcccacttcccgggtagctgggaatacagatgtacgtcaaaatgcctggctattttttactttttttgtagtgacagggtctcactattgtcaccaaggctggcctgcaatcctcctgcctcagcctctcaaggtgttgagattacaggtgggagccacctaggccagcagagattcatttcttgtttgagaatcctgacttttctgttctcaaacaaacaataatagctcataaactatgagctattaaataaaagtatgattttgttcttccttgacaacttaaaaaaatcttaattttgctaaatttttatttcttttataaataggggaagaagttttgtgaatttatcagctatttcctattgttaaaaaaaaaagaattctaggtagtagccagggattttagagattacatatattacagaaaataaatgaggagggatgaaaagaaaatctcgaaatggaaatgacatataggtttcatcttctgcaattagcctcgaatatgagccaactgaatgttccctcactgggcctgagcgctgaaagagagggccgaaatcaaaggcagatagggctggtgacctcctgcttgttaaattagtgccatctttttgttaaatttcagggaagtaaatgccaagagtgttttgggagtccttggaagtttgggaaaggcttctccaggactagagaataatatgtagatgtggattttcaagcttgttagttaaagtgaataaaaatgatcttttaaaaaagtacaggctgggcatagttgctcatgcctgtaatcccagcactttgagaggccaaggccggcggatcacctgaggtcaggagttcgagaccagcctggccaacgtggtgaaacccactatctactaaaaatacaaaaaatagctgggcgcggtggcaggcacctataatcccagctactcaggaggctgaggcaggagaattggttgaacccgggaggcagaggtggcagtgagctgagattgctccattacactccagcctgggcaacaagagtgaaactccatctagaaaaataataataaaataaaaaataaagtccagatgcagaacaagaaaggtggagaaattctgagataaataagctaaattgaaaaaggacaaacccaagtatatgagagctgtatacatttgttatctactcttgagatttatattaccttactttataacacagtttattgaaaacagtataattttacttaaaaatacagtttatgtatgttatccactgattctatatgtttaaatatgtctacttgctaaaatgtatttgtgactctgaaatcaatactggcagggcttacaccatcctctgtggacatgtgtagagtgacaaacaattagagtcaccccatgtgcatgttgcatgttcccagctgaggcaggacaaggtgacactctgcctccttgtttcagttgcatgctgtgaacttttcacggtctatgtagtgccagtttttacattttaatactttttgttgatgattttgctcttaaaatgtctccgaagtaagtgctgaagtgctgtgtagtgttcccaagtataaaaaggctgtgatatgctttagggaggaaatatatgttagatgaatttcatttaggcatcaattgcaacagcatagatgcagctgttggccctgaactcaaatttctgtatgtatgtctttattttagattcaagggtataggtacggttttattacatgggtgtgttgcatgacactgaggtttgagcttctactgatcccattgccccagtaatgaacatcgtacccaataggtagttttccaacccttcattccctttctttatccccccttttcaggatcctcagtgtccactgtttccatctttgtgcccgtgtgtacccaatgtttagctcccacttataagtgagaacatacggtatttggttttctgtttctgcattaattcacttaggataatagcctccagctgcatctacgctgctgcaaaaggtatgatttcattctttttaatcgctgcctagtattccattgtgtatatgtaccacagattctttatccaatccacaactgatgggtacctggtttgattccatgtctttgctattgggaatagtgcttcaataaacatactagtgcaggtatacttttgggaggacaatttattttcctttgtgtatctatctagtaaagggatttaagctcaatgccaatgaatcaacaatatatattaaataaagtgtctttgaacagacatacacataaatcaatgtcatatatcagttagttgacaaaaatcgtatgagcagaggctcccaggaacctgtgtatttcccttaggagcagtggttccatatttgctaattcagtgttcatggtgactttatagaacataattgctacagataatgagaatcaactattcaattaaataatattaaatcatttcaatagaaaggtagagagtttcacctcagacggactagttggtttcagaccaatgtttgcactgcaacaaccaaatgagctggacaaaatatacataaagttttgaaaacattgtgagctatgaaagctcaagaaatgtggggccaaaatccaggagggaagggagcccatatagctaaggaaaacaatactgaaagaaactaaataagacctaaacaaatgggggcacacagcatattcatggattccaagattgaatcttatagaaatgtcaggcctccccaaattcatctagattcaatgtaattttaacttaaatcccagggagagattcaaatggcggatgcaagcttgaagacaaatttggagtatccacactcacacatatgaacagttattagaaagctacagtaattaagacagtgtggcagtgtcacaaaaatagaataatagaccaatggaacagaatacagagtccagaagcagacctatgcatatatcgatacttgatatatgagcaaagtgacacttcagagcagaaggtgaaggacaaatggtgctgtgtcaactgaatattcacataggaaaacaacaaaactaccgcatcttatgccatcaaataataattccaagtaggctgtagatataaatgggaaatgggaaataaagtttctagaaggtaataaagcatctttatttctttggagtaggcaaagatttcttagacaaaacacaatagcatgaactgcaggtgaaaaaagattaattgcagtgcattaaaaatgtgaacttctgttcatcaaaaaactccattgtaagaaataaaatgcaagtcacatagctgattgcttagtttccagacaggacatagaaagccatctaatttagaagagtatcctgagggcagggaagaaaaaggatttgtaagctggttctatctagctcttatctgtcattgtccaagtactccacataggaccttacatttctatgttaaatcagctggcctttacaagtagcctctaggtaactcctagaggtgatgggagcggttagacccttcatagtatggtagggttgggcttgagaatctgaactgctgcagctccagccatggtggacataaaggaatccatgctgaagcccaggccttactctggggagccctaggcagccagtagtgtcagggaaagaggcaacagcattggaaggttgggctgtccattgagcaggtagacaaaggcccaaaaggtaggggttagaaggaattagttaactgggggtggaggggcatgcacataaattgggtacaatatacaatctaataggaaagttggcaaaggacttgatgaggttctttgaagattttcaaggggccaataaacatatataagatcaagattattcaacttaatttgtcatcaagaaaatgagaattatttaggtcagtgcaaaagcaattgtggtttttgccattaaaggtgatggcaattacttttgcaccgacccaaactatgatgatataccagtgcattcccaccctaatagctaaaagtaaaaagactgacaatatgaagtattgataaggaagagggactgaaacttttaaatacagagtggagtgtaaattgctacaatttggagtgtcatttgataagactacttggaatttgtcactaatgttgattatgtacatcctataatccagcaattccagtcctaggcaaataacaaaaatgcatacatgtgttcaccaaaaaatatgtgtataagtgcttacagtaccattattcataatagtctcaaattggacacaagtttttatcaataatagatcattaaattgtggcatgcttacacaatggaatactatgtagcagtgaacaagagcaaacaactgttatatacaaaaacatgggtgattctcatcaacataatgttaagcaaaataagtcagatgcaaaggaacacatgattctgtttttataaagtttggaaacaagtaaaattaatcatggtatttgaagtcaggatatgattattttgggggaggaggctatgaatagtgactgggaagggacaggagtaggatatttaaggtgctgtctgaatggacctgactagtagttgtataagtatatgcactttgtgttaatgtattctgtaatatgatttatctacttttccagttgttatatatatttagaagtttataaaaataaaaagaataaaacttggtaaatatataagataaataggtatgccatagaagctgaatctttgattattgcattatcactttctatgctcttcagcttctaaaaatcaagattatgctataacatgcaactgaaatggccaagctgtgaataagagttaccaaatggcagctaaaagcacttactatgggccaggcactgctctaatcagtttgcgtatagttactattttcatcctgctttaattaccctatgaggtcattactattattgtctgagctcttaatcattgctcagcgctgctaaagggaatatatggctttcaactctaacctgtctttgactttgctgcagcaatgaaaaatatcaccttccttgaagttcacataccttgacttctatgacagcagctctctatcaaagtgtgtatcagaaatagtagtcttatgggatgttattcaggtttactgagtctgaaaagtgtttttggctcaatgtgttaggaaattccaagattatataacttaaacaattttccttaccagaggacttttcacaaaagaaaatcttcaagaagaaatatcttaataacatgcagcatttccaaaacttatttgtgaccaatgaatcacattctaaagatcaaaatcatagaagtatggtcctgtgggtcacactttggaaaggattttattatttcaattactattggtgttccccaccctttctggccattcttccttggtctacattacaaaaggcctgttttttgaacaacttttaaacagtggtcttccccaaggctccatttaggtgatcctttcatttatcttattctatactcccttccagagtaatttcatacaaaatcatgcctcaaatatgatctaaaacttgataacaccaaaatgaaccctcttacaaattttctatttctatattcgaccacgtgctaatggactccaattagatgcttcaatggcatctttaatttatatgtctaaacatgaactcatgacattctactaaaacctgcctcatgtatattctttatcaatgaacatcaccatcatgaatttattagtgattaaaatggaaatctgtatgtcagtagcctcccctctgatactcactttcccactcattatctaaaggtcacctagtcctgctgattctagtttctaaatatgtctcaaatctgttttctcctgtttgtccctgttaccaatacaactgctttagttcatgtcttgattttttcttgctgcattacaacagcatccttctaataagcctcatcatacccaatcatatcttcccatttgcctccctagaattaatgcaaactttcccctatgtcattgtccgttctctccttctggcaatggctggacttgacctggataaagagtggctcagtagccaggaatgaggattgagggcctggaaggaggcagttggctgctacctcaggcaacagaaggatgtctaaagaaagaaaagagtaactatgggtcaaaataatcagtgtggattccttcatgagtgtctcaatctgtgcatagttttgaagacagttttgtggccagtatagacaggagaagtcaaagaaaagaaagaaggggcaaataaatatttaaaaggataaatgtaatcttctccaagaatcataatattgatttttagtgttccaggcactttataattctcacttagtgttttttccccgcaaaggtatgaagttaagaatattggctaaaggctaaacaacttcccagttaaaaattgcagaacaaaacagcccttttatggatcaaacattatgtttgggaaaaataattttgacatctgataaagaagtaaaaacaactctcctaagatgatgttctgagtagctgcctcatggacttgttaaagtgaggtaagcataaccagttaaaacaaattagaattattcttagcctagcttctcagatagtgctgatagtagataaggaaagtgaggagagtaaggaaatgtgaaaacatgtttgggtagcttatcttaaaatcaaacatatttaggaaaggagcagcctatgagaagtcaaaacaaatgtggatattgatccttaacaagtgcttgagaaaacagacttgaagagaaagcctggaaaacacaatacatgatgagaagagaagcaaactaaaatatattggaaaccaacactctggcaggcacatttcatggtattttagatttgcctctctctttctctctctcaccatttacaatgctattgaggtacaattgacattcaataaactacacatattcaaaatatataatttgatgaggcttaacatgcatatataaacatgacattatcactataatgataatgtacatttacatcgttcccaacagttttctccttctctgaaatccattctttccaaggaacccacttagataagtaagtacccaatctatgagatgtatgcttgtaaaataaaattaattaggcaacctataaatgtagaacagggcttgtatgtaccatctctaatagcaaaattgctgaacccaattctacccaaaatagtagatacaacattttgttttcttttccaaatttgtgatgaactgtcttccataatatttgattttgctttcctgggctctgttcctctgacatcattctgaggtataaactttcaattctacccgtacgcagaggtatcccaatggtcttatttagttcacccagaaatgctttacagcattttcatagtccctgggggtcaaaaatcagtactctaatcagtgcagtgtagtgacctctttttcattgcattggccaggatcattgttcccctaggtttcatacttatcactgccacaattgaaagaagtttagagatagatattaaacagaaaggaaggccatcaagttcacacacatttgtttataatgtccaagttcaaaactaccagagggaaaagctgctgctaaaatatgcaagagtttctatagcaggaaaagacaaaaacaaccaacaattatttaaatgaataaatatcttagtattatcaagtactaaatgttctagaggatcattcatgatgcccagtcttaccagaaaaaaaccaccagactggacttgactaatggatgaatttttttttgtcttaaatctatatttctgtctctgtaatactctgagcaactcaatgtctctctctgtatgttcttccaggagtaaaatactggcttgtccattagtcttgaaaacataaaaattgctaagcatacaggttcttcctttcctctgcatgatggccacagacctcgcctaaactccattgcactgaaatattctactggttatagaaaagatcaggtcaaagaataaagaaatgaaggtattgacccctttccatgttttccaggcaaaataacttagatcacagccttcaatgacagccgataaataccacactatggtttgaatgtgtgtcctttcaaaattcatatgttgaaatctaaccctcaatccaacagtattaagaggttaggtccttttggaggtaatatttaggtcatgagagctccttcctcatgaatggagttaatgcccatataaaagaggcttcacatagcattcatccctttttcttttccaccatgtgaggacacagcatttgccccttctgtcatgtgagaacacaggaacatcgtgctattttggaagcagagattcctcacaatacactgaactttctggcactgtgatcttggacttcccagcctccagaactgtgagaaataagttgtttataaattattcattctaaggtattttgttaaagcagcaggaaaacactagaacacaccatgatatgtatttcttagtcattggaggtacaatgagagatcatatgatgtgccaaaagaaaatccctgcagtgatggacgctgaagcagaacagacgtgtagtgtgataattaaagggcatggagttactactgaataatgacaatgcagagtccagtgtccttgagcaaacataggagacagctagggagtggttacagcaggccttgagtgagactcagtgctgaatgggcttcaggtctgacccagcacagtcctagtgctggtggtcacaggagtgcttgtgtcacttcaccctcagctctaggtgactcagaacggagaaagagacactgtttgggaaaaagtaagggaagagaacaagtgtctctgcctagtgatccagataatttttccagatcttgtccaagaccatcaagacagtacctccatgagtttgcaagaactacagtgttactggactttgttactgggtgcctcctaatgaagatatagcttagattacaacacccaagtccttttgaatacctggaaagccttcccaaaaaggatgggtacaaataagcctgaactctgaagactacaataaatacctacctcttcaatgctcagatacatacacacatccacaaatatcaaggccatcccagaaaacatggcctcatgaaatgaaccaaataagatcatagagaaacagagatatgtgaccttacagacaaataattcaaaatagctgttttgaggaaactcaaataaattcaagataacacagagaaggaattcagaattctatcaaatttaacaaagagattgaaataatttttaaaaatcaaggagaaattctggagctaaaaaatgcatcagagtctttttttttctttttttgagacagagtcttactctgtcgcccaggctggagtgcactggcccaatctcggctcactgcaagcttcacctcctgggttcccaccattctcctgcctcagcctcccaagtagctgggactacaggcgcccaccaccatgcccggctaattttttttttttttttatttttagtagagacggggtttcaccgtgttagccaggatggtcttgatctcctgactttgtgatctgcccgccttggcctcccacagtgctgggattacaggcatgagccaccacgcctggccacatgagagtcttttaatagcagacttgatcaagtagaagaaagaattagtgagcttgaaggcaagctatttgaaaatacatgtcagatgagagaaaagaaaaaaaaaacaataaagcaagcctacaagatctagaaaatatcctcaaaaaggcaaatctaagagttattggccttaaagaggaagtagagaaagagatggggtagaaagtttattgaaagggataataacatagaacttcccaaacctaaagaatgatatcggtcaatatccaagtacaagaaggttacagaacaccaagcagatttgatccaaagaagactactccaaggcatttaataatcaaacttccaaaggtaaaggataaagaatgaatactaaaagcagcaagagaaaagaaacaaataacatatagtggagctccaatatgtctagcaggagacttcttagtggaaaccttataggccaggagaaagtggcatggcatagttaaagtgctgaaggaagaaaaagctttcaccctagaatagtatgttcagcaaaaatatccttcaaacatgaaggggaaataaagactttttcagacaaatgaaagctgagggatttcatcaacaccagacctgttccacaagaaatgccaggggaataagtcaatcagaaagaaagggacattaatgagcaataagaaatcatctgaaggtacaaaactcattggtaatagtaagtacacagaaaaatatagaatattataaaactgtaactatggtatgtaaactcttgtgtagaaagactaaatgatgaatcaatcaaaaataataactacaacaacttttcaagacagtagagtacagtaaggtataaatagaaacaacaaaaagttaaaaagtggggggcacaaagttaaggtgtagagtttctattagtttttgcttctttttcttgaaaccatttttatttactcactcattttttgcagggtggataagctcagaaaccatttttaaatttctggtccattcatgtgtatgaataaatatactatattatttatttgatatatagttgtataaaaagtctggctatatatattcttagtgcttagactttctaaagaataagccataaataggaaataagaaagaaaatacaagcagcactttgttatatggaaaaatgcttcagctcagcaagaatatagaaaaaatcaaagcaaaataacttcacagtatggtgatacatctactgaactggcaatcataaatcaaacttgaaaagtcagtgctggcagatggggaggcaagtggttcacttctctttagatactgatggtggcactgcaaattggcttaggctttctagtgaacaatctggtataattgcctggaggagttagaagtcctgggacaaacaaggtgagtgggtatagagactggtatgtcgctaaggcaagaaaaatagcactgaggaaagcactgcaacaggtccactttcagagagatgtaacacatttccataggggttcggatgagttcggccacatctggggcatactggtccagttctaggaggagtttctgctttttaaacacaactttattgaagtcctggattgcaaaatacagggcaatagcagtgagtgcatcagttatcataaacaccaattcagcatagtcaattaggaagcgaaagtggtatattattaatggagtttcatgaaatattgctccagaatatggagatactcccaagtccaagagtgaaaggccttcaaccactctcttccaagagctcagtggggacaccacctccacctgctcagaaatgaactcggccagactggagtggaacaaggccacccgcactgtcactgccaccaccagcaccagggccaagggagccaccacgataactggggcgggcacgcagctttgttttcttctttacgcaaacagtgttaagttgttatatcaacttaaaataatggcttatactatagattcacaagtcttatggtagcctcaaatccaaaacagagtaaatacacaaaaataaaaagcaagaaattaaatcacatcaccagagaaaatcacctttattaagaggaaaacaggaatgaagaaaagaagtcagagaagactacaaaacaagcagaaaacaaataataaagtggtaggagtaagtccttactcatcaataacaacaatgaatgtaaatggactaaagtctccaatcaaaagacatagagtcactcaatggataaaaaaaacaagatcgaatgatctgttgcctacaagaaacagacttcacctataaagacacacacagactaaaaataaagggatggaaaaagatatttcatgccaaaggaaaaaaaaaagagagcaggagtaggtatacttatatcagacaaaatagatttcaagacaaaagtggtaagaagagacaaagtaggtaactatgtaatgatatctaaccattgtaaatatatttgcacccaacactgcagcacacagatatataaagcaatgattattagagctaaggagatagaccccaatacaataatagctggagatttcaacaccctacttttagcattagacagatcactcagaaagaagatcagcaaagaaacacagaacttagttctgcactatagaccaaatagatctaatagatacttacagaacacttcatccaatggatgtagaatacacattcttctcctcaacacatggatcattctcaagaataaactatatgtcggatcacaaaacaagtcttaaggcattaaaaaaagttgagatagtattaagcatcttccctgaccacaatgaaataaaaccagaaatcaatagcaggaggaattttgggatctatacaaatacatggaaattaaacaatatgcatgaccagtgggtcaatgaagaaattaagaaggaaattaaaaaatttcttgaaacaaattataatgcaacacaacataccaaaaactgtgggatacagcaaaagcagtactaagggggaaatttatacctttaaacgcctatgtcaaaaaagaagaaaaacttcaaataaacaacctaacaatgcatcttaaagcaatagaaaagtaagagcaaagcaaacccaaaattagtagaagaaaagaaataataaagatcagagcagaaataactgatcttgaaacgaacaatacaaaagatcaatggaatagaaacttattttttttaaaaaaataaacataataggcccaatagtctactccatttgggaaagccagagtcagaaagatcaatcattttttctcttggtggccattatttttgataagtgggtcaattgcactgtttcagatgatctcatagcagataagttttgcagaacatgtttacagaatctcctctctttcctcaggcctcattacccattactcattacatcctaatagaggtgtctgtgcccctctccctgtctcccctctttccaattcatcctattccctgtcctgttaaaagaatacttttcctaaagcaccagattttcaccctcagtaaaaaatcttctattagatgttgatttgttaagaaacaaagtcccaactgcctagcatggaaatcaaggctctcctctgtcacctgattagaatcccctttctagttgaacttttcatttctcttctttggcacctgatggtacagtcagtcaaactgagccttgtcctagaaatgtgccctgcctcagcaagtgactttgccattaggaatactctgccccagcctggaagggctttctccacaaccccaatctcttaatgtatatttgttaccttcttgaaggttagctcaaacataatcattttcatcactttcctcagcagaattaatcttgcatcctggccaggcacggtggttcacacctgtaatcccagcactttgggacgccaaggtgggtggatcacctgaggtcaggagttggagaccagcctggccaacatggtgaaaccctgtctctattaaaaatacaaaaattagctgggcgtggtggtgggtgcctataatcccagctacttgggaagctgaggcaggagaatctcttgatcctgggaggtggagattgcagtgagccaagatcacgccattgcactccagcctgggtgacaagagtgaaactccatttcaaaaaaaaaaaaaaaatcttccatcccaccatactcctatgatattttgttcattcccttactatattctaccttatattttatttgcgtatgctcttgcctgatatttatttgggaaagtctaacttggggcccatctgtccatcaatcaatgcagatattcccatataagtgtggtcaaaagtagggaatagaccctccctgcagtttactaaattgatcttcaagaatataggtagttttctcttatttaggcatcaagtccaatggggaggctagggaaagaaaactgacagaacagagacatttactgtagataatgttcagtattttatgattacctcaaaaggctaaggaccagtctttttttattacttcatcttcaatatttgatatgcagtaggaattcagcaaaccatttttggaataaaagtctttcttcttcatttgactagaagcttcttgaaggcaacaactgtgccctgtttgtatttgcactcctcacaatgtctgtgtgccttgcttcataaaattttgtttcattgcttagtgggtgggtcagtgctttgaaaagtctattaggtttttgctgtggtaatgacatagaaataatgaaatgtgataataaaataaaaagaaaagaaactgtggaaaatgacagaccattttaaaatgtcaacaactttggcactttagtcccctctaccaaacttctaatcagaactctttaacatggagctaaaataacagattttggtcactctatattctcccaaaacgacatactcattattatgaaaaagtgatggaatgcaccatcaaaaagaatccttgaggattaagaggaaatcacatgaaactcccagcatgaataatgaaacatctatacttcacattatttcataaataaaaggaaatattaaaactcacaaataggaaagatataatgccaaaagaagatagtactttaaatggaatcaatatgaaaagcttactatattatccttatttcttattttaactgatcataattttaactgatcataactaaactgatcataattttgttgtagaccaatattaggcattcatttttagcagaatcttcaaataccggttgcatactctcaattaaatattcctagtcactactgaccagaggaatgttgccaaacaaatatacatattttcctttggtgtctatatatcttttttactctaaaacttcctagttttcaactgccttctgttggtccctctaaaaatgtttgattgctcccactctggtttttggttaacaagcagattcatttatctcatgctcacgtcctcttcattccttgcctattttgttcttcatcaaacaaatgactgttcttctctacacaggttgttctgttctctcccttccagttttaccacagttctcatttttacttatgttttccacagcacatttaaataaaattttataacctgcttctctgttttgtactgcctttagattaaagggtaataggatattcaaacagagtactttgtgtctcggctttgctgaggcctaaaggctgaaccatacctaattgcttactcacttcacattgtatagcaaaatgctaactcatccatgtgagattcacaaagaggaaagctacaaactagtgctattagcattagccaggcctttcacttccacaaccttgaatagtccaggaaacagaatatttggtgagagagtgctgaagtgctatgacatttctccactggggagaagaggttgttactcccttagtgaagttttagactcaagtgagtctctaagtagctcaaagagtttgatacgtgtctctaggagggaaggttgtacagagagtgactacacttctaacacaaagacccatttctccgttcttgtgcatgttctctctctctctggttcttttctgttgttcactttgatgaagcaagccaccatgtcacggattgctatatagagaggcccacatgtcagggaacagagagcggcctcttcccaacagtcctcaaggaacagaatgctgccaacaaccacatgaattagcttagaagaagataatttcccaacggagctttaagatgggttggcagccactatacacacacacacacacacaaacaaacacacacacacacacacacacacacacacacatatagttatttttgtggttctacattactaagccaagctggatcaataagctggtaataagaatcaaatgtagaactttgagagtaactcattctctttctagggtcttgcttgaaagaagttcttgggaagtggatttgacagctgacaagaataactcataggagacacatatctgtgcatagattgaacaaccatttttctgacatatgaacctcagaaacgtaggcattttccacttttgtactaactacattccttttttatcatttcttggccaaagagattgaactctgaacaatatcacccctccccacaaatcctgtccccagccacacatatatgttcccatgcattatgtcattaaggtttgacttggaccatcaaatatgccaggcctcaaaaagaagttcgactgttgtgccaattgcatattctgtaaatatcctaaacattattgaattgcacactcaaaatgaactaatttaatgttatataatttatatcttcataaagctgttaaaaatggactttaaatagcagaaaggcagccttgacatttttgtacctctgcaggtcttctgcagatatcctttctgccactatttgaagatacagaatacttttctttgattaccattttcctactaaatcatttctttcagaacttattacagttcctttgacttggcttgtggctaaaccttcatacactgatactccactggtaagaaaatttcatttcaaagaattggaaagagaaagagcttactcatttttatttgatttcagttattgtagtgcagctaagtggtctcagtctcgttttctttccacatattgagcttgggtctccaaagaggttatttttcaaaaggagattttgcaggtaaccagcatgttatatagaatgtaatatttggggcctgagaaaagagaagagactctgtaaacatgttccacaaaagctcatctgctatgagatcatctgaaacagtgtaattgatccacgtatcaaaagtaatggccaccaagagaaaaagccattgatctttccgactttggtttttccaaatggagtggactattgggcctattataaaagatagcgcctatccaggggcaatgaagtggaacccataaattacctggtttattaatttttgtaaacatttagatgaactagttaataaaaacaaaaaaagcctaaaaaacctgaaagcaaatgtcgcttaaaataactgtgtgttcatcttcatggcgttttacactttttaatacatgttcatgttcacgttttatactttttaatacctgttcacaaaactgcaattttgcaggttttgtcctattttgggatgatgggaggatatatagagaggataaaatccgtcaagattacaacagaacactagataggattacaaaatttgctttgtagcctctcccatgggggttcttaaaatgtatttaatttttttaataacaaatgaatttatgttaattgtagaaaaatacaaaaatagagaaattacaaagaagaaaaaaagtaactattttaccaagaattggatataaagtaatgccattaatacaaggagaaaactgcctagattcctaagggtcatgtgtcagaaaatctttgtatttcctatgaatttttcttgccagttgtcaaatgtgtttcctaagaacttgctttaggcaagaccctggagagccagtgagttactctgaaagctgtccatttgattcctattaactagcttattcatccagcttggccgagtaatactggcaacacaaataacacacacacacacacacactctctctctctctctctctctctctatatatatatatatacacacacacacacatatatatatatacatatatatacacacacacatatatacatacacacacacatatatacatatatacacacatatatacatatatatatacacacacacacatatatatatacacacaatctatctatctatttatctatctatatatatatatctttgtgctgttttcctttagaacattggttctcaactgagggcaattttgctgtctcccgtctaggacatttggcaatgtctgcagacatttttggttgttccttgtgggtgaaatggtgctgctgacatttggctagaggccagagatgctgctaaacatcatctaatgcacagaaaagcccccacatacccaacaaagacttatatggccccaaatagcaacaaggctgatataataccaatatttatttccttccttgattcctctttcctcccaaaattatagtcacactggtcatctacttccatatactatttattttttacttacaattatattgtgaatatttcttcatatcattattcttcaaagcatgaatttaatgctgtacaacagtttatcatgtgacttatttaatactccttactgatgacaatcagttccatttccagtatttcaacatcattaaataatgttggtatgaacattcttgaccataaatctattttcatttctctaatgattttctttggatggattcctagaagtacaatgactgagtcaaaccaaatgaatgtttttaaagctcttcgtcttgttgccaaattgctttcacgattaacagtctctctggcagcatattagaatactcgtcaggccagctcggtttctaccatatttttgcgctaagctaaaatttgacatgttaacactaatacgtaagccttatagtcctgatatgatttgtgaatgttaagtactttaataaccattctctagctgactaatacaaggtagaaagttcaggtgctatactcaccttacccccaacaaccatctaagaactcttattttcaagaagtaatttctacaaggttacacagatttcaagatgaaggagaaagaaaaggagaaggagaagatgatgatcgctgaacctaagccagaagccagctttcattctgcgctctttccactgaaccgtacacaattgccatttcataacgtgaattgcatgaacatggatatgcacggactcacttgagtcagtcaagagttttggctttcacattctccagtacttggctaacatgtatagccctacctgcccctttccagcagatggtgctgtttttccaacatttaaatgctacacagcaaatgataacttttgattgatttgagccaggttgcttaagggcgttcaacgaagtctactttgcacattggtattattaaaattgctcaaacataaaaccaatctttgctcagtattgatggaaacaatgtgtgttcgagagtactgataacaaataaataatgaatcaccaccctaccgcaatgatgtattacactagacttttttcctggagacatagaagtaaatgttttagggaggctgtgggagtcagaggtgggtcttaaacaaggtagatataaaagattatgagtcatcatacaaattctgtgttgcttctacagtaaatatcatggaacaaatgttggtagaatatggaaaaaaatatatatatatatcctcctgtctattcacagaatatggaatatatatatatatctcctcctgtctattcacagctccaatgcagctttcttacttcccaccaattaagtttctaataacacctataggcaatctttatatatatatgctggggtatcagcagtgactcattttccaaaataatttgatattaatatagaagaggaaacacaatatctcctttcagccagcgcgggagagataaatttctcactgtcaatacaggttagtagttccctcaaacacaattaggacttagatgagaacatcctctttcctgggttaagaatatgtttacaatgagaaaacaaggccaatccaacttttctgaaaagagcatcagtccagatgaggactgattcagtaaggtacattgtgattcactcatgactggagaagaaaaaggttggcttgggaaaacaaaaaaaaaaaaaacaaacaaaagccacctttaaaatcaatccacaatccgcaagtctcaaacaactatcactcatccacatagaaaagtcatccatgtttcaaaaaggccataaaccatgcataggctgctggttaagagactgatcacactggcaaggagaggacctacaatagttgtcctctcaaatttgtaaaatttgatgagaaatgggaataaattataaatctgagcttggaggcttgtgtgatcttcagagcaaagtgtcccccaaaccaaagttggaataagcaatatttttaaaatatttcaggtccagcccaaactgacatacttatctgtgaagttatctgtatttatctgtaaaaatttgtggccatataatgcagagatactaatgcatgaacccttttgtataaatcacaagtacatgtgatttcatagagagatgcacaaaaaaattaaaagtggctctctcaaaaggaagtgtttggcatttgaaaaagaggaagatatataacaaatgttgaactactttagatcttaaaacatctcagaaaaaaaacacaactttttcttcacctaatagtgcttcaaagaaatataatttaactcacatcccagtcttggctatcgattatagaagttaacaaacagaacaatttctctgtaacctattgtttttaagcaggccttgagatttgttttaattatttagtattctgcatagatgcatctgatggacttggctgttttgctccttgaacatattgtaacagtctcagagctacatgtgctcagggaaggcattttaaaaactaaattttcaaaggtgtcagcaaccttgcagatttaagattgtaaatatccacactgcagaacatgtccactaaattttccaatcagaggaggcctgtgttgacagctcatcccatggcaggcattgaatttaatcaagaaatttctagtttaaaggttaaattctaacctgaaaatgcaccatatctaaggaaattccatttcaagtaacatgaaaattcattccagaagttttcatgactgtcatggttgaagagctaagtcttatttatcaaggttttatactatatgtcactaccaacatactgaaatgttttcccatttaccattcctttgaatctgagtttattgtactctagttctcttttcctgggaagctgaggaagctagagaatgttatcttatatagaaggtttggagattatgtctccttaaatttttatggaaattcaaatttacttttcacactttcatgttctggacatagagggtcaaaatacattaagccatggataagacacagttgaatgttatttgaatggtattagtaaatgccatcacgaagctactgtcagacagctatgggtaaaatttcaggaaattcacagcataagaaaaggtaaaagaatttcaatgcactggcaaagacttaaagatgtccaaatcttccaatgtaattttataaattagaaaagcatattaaggttttcttatggagaaagagagaaaaaaatgttctatcaactctcttggattgccagtttccaacagctggtagtctttgctatttgcaaagactttctgaatgtttttctcctgtattttctcttctagcatttctcttaggcctgcgcacagagtctgcagtgccctgttttgtaccccacaaaagagaggtttggcaaagtcacagcatctggtaggtcctgccggctgggtgatttatggcaaaactaagaggcaagcacaattgatttgggtctctcttttcctgtttaaatgttgtccattctccccagtttaagctgcctcctgtctattcacagctccaatgcagctttcttacttcccaccaattaagtttctaataacacctataggcaatctttattttttattaaaagctttcctaagacatgtcttatttccaagacaataaatatactgcttggaagtatgggggctagtttggaaattttacttctttcttagtttgtgtgacttccaactaattgttcccatatttgtaggccatctggatatttaggtaatagggaaaaatgaaaggagcatggggttggagtcagagagatagatctagggccaaatgccacttccgtgacttatgaagtgggtgacattgggcaggacctttaatatcttggagtctcagtttcctcatctgtgaaatgcaggtaatgagctctagtttatacactgtaggattgcatttgtagggatgcattctattacaggcatttagacttgtcttaacagaccatgtcccgtaattcctttctaaaaattgccttctctttccagttcttgctaaaagggtgatcctagggacagtcagattttatacaggtgatcttgaccctctggccacagtgttagatcaatgtggaaacctgatcccaagagaacccatctaaatgttgagcacagccaattatggtgtctttcttgacaatttaatctaaacacacacacacacaaaatagttgagacaatatggagcacctggaactcttgtgacattgacaataaacatgggatgacctctctgttgacttcattgtagctggcacctgaacattttcgactggattcaaaagaaacatcatgaccaacctgagccactgatggcatggaggagaagaaatcaggaggccctgaggaacatgatgtacagaggggtgtggttgaataacatgggtgtatgaacagaagatgaagcgggcatcatgcaaactcatgagaggcctggctgatcttggcccttgctcttggttgtctagaaggttgtgctgacaattagccaccacctagagtctagtttgaatgggtttctttagcttccaaccaaactggaactacaaaaggcccttggttcctgtcctgacacagcataaagtttgatgtgcaatgagaattattatgattcccagtctgccagctactgtcttcctccatggctttctccattatccagggaagactcagcacatgttcaaggcagaaaggattctatattaccctggttgttctagccatcctcataaatggtgaaaagtagtttcttggtttattcagttgctggctaattacaatagaccttaaacattgactttttttttttttgcctcatctcttaaatataattttttctttttcctttttgagactaagtctcactctattgcccaggctggagtgcagtggtgcaatctcagctcactgcaacttctgtctcccgggttcaagcaattgttctgcctcagcctctcgagtagctgggatcacaggtgcccgccaccatgcccagctgatttttatacttttagtagagacggagtttcaccatgttggccaggctggtcttgaactcctgacctcaagtgatctgcccacctcggcctcccaaagtgctgggattacaggcgtgacccaccggcctttttaaaattattttatttatttatttatttttacatctttggagcttaagccacatgaattgtgttttccaaagttacatgttctggatagtccttgaggatggtgctatctaaaatcacatgtcctactggatcctagttgagcctggctgacagcagcaacagtaaactctatccttaacatggttagggaaaaattacttctccatactttctagtattgatcttaaccaggactgtgatctgaaccaagagctcagtaagtgcttgaacatatttaaaaaggtttttgtttgtttttacttttttagagcacttttgctatcctcctccttacccctgcctctattccctatacaaaattagaattaggcctcagaatttcagctcttcagcctgttagaagacagcgaaactggggaatcttatgtatcaaccagtggatgtacataatatgattggttcttcacaacaattcttatgagatagatatttttattcccaatttacttatgaggttcagagactggaaaaagagaaagcacaaatcctaatggtagtgaatagtggagttcgggtgcaaggttttgagcttctcactctttcagtttttacatccatctgtttgggggtggtaggagaaataaagaggtccacaggagacagtggaaggcaaaggtaggatgggaaaagctcagtttagtagttagaaatatagtcatatttgtaaagtgcctagcatattgccttacactaagagcatgcagtaaatggtggctatttattattatctttttcacaatagtaattcaggaaattatcttgtcaacttaatgcagattacataataatctatgtgttggcaactgttagtaggattcagcatgtcataaaaattatttatctgggtgaagttttatacttcctttcatcacctttcattatctttttcttacaattgacttttgatcataaaaaatgtaatatgcatattattgacctactttgttttacttatttaaatcttaacatttaagtcacagaatcttagtatttgggctcacaataagtaaaatgttaaggatagagtactacactggatctgtggtcttattaatgatacattagcaggcattatggcataagatgtagggttatcaagaagcaatggatgtcttggaacatgactgcatggctgttttcttgtaataaaattatgatccaaattcaattatcctcaatatcaaaagtgatatccttaaatacttttggtaaaggcaagaacactgtttattttaaatgtccattgaaaagaagacaaaaccttgcagcatgtttagttgagaacaggaaaaacagggcaaatgaaagtggctgagaaaaaaataaaaataaatatatatattcacatttatcaaatgtaataatcaaggctggaaaaatacagataaaaattagaaaatgagacctccaataactgtattttccaaactccgcattagctagaggagtataatatttatttttctctaaagagtggctttttttgtttgttttgaaaagtgaaaagattttttcttactttttaagagttacataaggatagcagtaaataacgcaactttgaagagacaatgttcaggctctgcacagatttatgtttggtagggtttctggcataatggtaattatccttatagtaaatgcatttatatgtatgtataaatcataagttttaagaataacttggaatgtataattcgaatttagagaaaatgcaagagtaaatttgaaaaacttttattttctgagtgcagtcaagaaacaagaataaaaattacaaaggttatataattttgagagcagtgtattcagggtgcatttcaagaaaattatcttcaaaattaagaaataagaacggtcttacaaatgtgacctcttgatggctgaagttgattggagacagaacccagaaaatagagttgtatacaaagatatatacccaccagcttcctaataaaaacaataaaatgaagtttgaataaaatatttaatttaaagaagtaaaagttagaattgatcaccatttgactcttttttttttgtactataattcttttgcagcacagaaaaataatcagagaaagaaagaaaaaattggtctctggagagagatattttccccaaatgacacatcttttagtattctactcatactttttggattagcgcaaaactttaaaatcaaagtttataatcaatcttgaagttttacttttacttgtgtttgggtgtttctagactatgagcatataattgataattggtgtttaaagactttctaaactcagtccttgaagttaaggaagtcacataactgcattctctggcatttgttgctttaccaatatgttgaatgctaaaggattttctcttggctgttcaaaacacatgtttatcaaaatatattcacgagtgtactaacattcttggaaggtacaggacaacagcagtgtgtgctgagtcccaggtagactcaggaatagcaaaggaggacacagacgataaatctacaatatggagggattatgggaggatttggcaagaaaaccataacatttgatgactctaggattagacctggaggaaaactgagagcattttagatttgctttatatgcctctctacccttgctttatcattacattattgccagccttcctcttggagctactgttttttctttagactgattgtgatggaaagtaagagagtggggaagagggccttcgtaaacagtctctaatgccttcctgcctgcctgcttgcctgtccacctgcctgtctgccttccttgagtttctattgagtagttttatcttctaggcactgtactactcactgggaatacaataatgaacaaaaacagccacattccctgcttactttggagcttaagatctcatgatggagacagacatcatgtaaatattcatgtatttgaatgaataattaaggtctgagctaaaattctctgaaggaagataataggcccagaaagcacaaacaatgtatcttgacctagactaatgctgactcttccaaagaagagttatatcaatagcagtggtaagagattgacaggctgagagaaacagcatgtgcacagatactgtagcaggtggaagcaagatcttgaagaagtcacgttaactctacaggagtagaaagccagaaatgcagacccatattaaggtctcagatctctattctaatggaaccacaggatgcctctgaagggctttttttgtggtggaaagtggaggtgttacactatggctgctgagtgtagaacatcttaggcaaaactatggtgaatgtaagaagaccataaaaggccatttttatactttaggctagaggtactttgatgacagaagagatggtgagaagtaggtgggtttgagatatattttagaggtaatttcagtaagatttgatgatgtgttgatgtatgaggtgcaaaagagaggatggtttcaaaaaggaccctgattctggtttctacatcaagataaaagatgaaaccatttaatgagatagacaagattagaagagatcaagattcagttgagaatatcatgcattcagtctgggtttgcaacgtttgtggttcctctgagatattaaggtagagatatctaggagacagttgggtgtgtgatacggacctagaaaaagggtccagagtggcgatagtaaatttggaaatcattggtttatagataggaactaaattggtgggtatagatgtgattacccagacagagagtaaagggtaagaggagaataggatcttggttgagacttaactctaacatttaaggattagccttcaaaaatgcttaagtatccagagaactgggaagaaaaccagataagtgtagaaaatagaagccaagaaaagagagcattccaagaaggtgaagtgagggctgaaaacatccagcaagttcagtgacatggagatttaggcagagagccatctatggagtggaatgaaaccagattggaatgagttaaggagacagtagaggtgtggaaaaggagatggcaagaacagacaaggatttcaaaagttttgttacaaaggaaaaggcagggatagagtcatagctgaagggggatataagacctaaaaagagattttttttttaatgcgtttgtttaaagatgtgtgaagctggagcatacttagatattgaagggaagaaccctggttgggaaagacaagttgaatctagtatagagaaaaggcataacttatagtgttgggttcctgagaagggcaaaagtatagaacttaaaacccaggcacaggattggactttgataggaggaagggagctccctatgacagaaaggaaaaggtaggagcaaaggaaggcagggttttttgtggtgtggtggaaagctgaggaagttaccatcttaggggttcaattttctcttggaagaattggtgacctcacctagacatattctcttcatgtgcaccaaccatgccaaggacattctttaaacttactccatcaacatttagtagttctgtatcctgttatctcaaggctctattctttaagtatgatacatgaattaggaatgaatggctgataataatttaagtggccatctacatcatgttgcattttaatatcttcagagttacagcccagagaagcaatttccatagaaaatttgggatgttggtaggaagaagaaaaaaatggtgtggcctaagagttgtggcattgttcattctgtgatatgggaaggtcagtctgatgatgccacaggagagattttcatgtgactgttatgtggtaaaacctgagtatggggactctactgctccctgactgaaaaggaaaaaagatggtagctgcatatccattgtaatctggagaatatgagcatatgtaagagttatagggaaaaaacataagcttgggaatcagctagacataggttcatattcctgttttgccatgagcagttcttagcctcggtttcctcaccatgaaatgggaacaaaatatgatcttacagggttatgaagattaagcagaaaatatataaaatatatattaggttgattcaaaagtaatcaagattttgccattatggcaaaaaaacatgtataactacatttcctttatttctcaggctaaaagttgaatatctttgtttctgttgtccatgtgttttcactgagaaggtgtacagttgaggcatgagtatgggaaattagcccaaggcttttctcaggacctgttatttaatgaattgcgcaatggaatgacctcctccccccaaaaaaaataaaaacaaggagccacaaaaaatgattgggtattcttgttctgctacaaattccacaggtgagatatttgcaatctagagggccttttccatagtagcaagttcttagagaataaaatgtaaattcctacaaatgcccttcatagtccaacactaacccacttcccagcctcatcttccatcacttccccatgccctactttgcaaacccactgactacttctctttccacctcatgaatgcccacgcacccagtggaaacagtcctttctgcgaggacttccccacttctctgggcagttgttttttctttcttctctagacttacagctccctgaaatttttgaatcatgcctccctgtaatacttactgggttgtgtttaatgagtctgccagtcagtttgtctcccctaccaggctttaagtaactcaggggcaagggacccaattcactcttggaagcatgtacccctactatggtgtgagagtatcatggcatttgatgaatgctgttggatgaagtaaagaatgaatgcttggggatattgtaaataacaaggctgacctgcataattacctaacatgtttttctctcacagaatagtaccatctaaacaggaagctggtctcacactataggttgcctgcaaatttacctagccttttgtttgtacacacccaaaatgtacgatgttatctatgaccttttggtatctaccttgctctctttactcactgatgtgtgtcctatatacttgtctgggttgctgagcacctggaactctgacaaattagctggatctaataatttgattccaagagtaagtagacacctaaatttgttttctggataaggcttagacaaaatcttgttaatatttgtgaacatttaaaaaagaagtggcagattttttcccccaagcgcaatccgtaccccaaatcaaaatatccttcggtatgttgttcactccaatcagttaccaattcccaaatttgctctagtctgctttaaagcttcaaggcttaggaaaaggagtagtggtggtttagttactgacagtacaaaaaggcctgtgaatatggagcattaatacactttactcccttcaaacactttcctcccttcaaacacttaatgacaaagactcctggcattgcctttgcaatggaattaactttggcttcaaaacctaggagagagagcattcttggggatgactgctccatgaaaataactttataatttactgtcttcagcctccaaggttttaaaacttgattgcataacaaatgtactgtaagtttaataaatgcagtaaatgaataagtaaatagatgactaaatctaccagtcttaaaatatgaacaatagtgttgctttgccttgattgaactttcaaggatttttaaaacaaaacaacaaaacaaaaacttcattcaattccatgtatgaagacctgacagccatggaattttccttgaagggtgagatttccatcctctgcaaaattttagctaatgatagagttccatactctaaagcttttgataggatgtttcattatcaaccctttggaataagataaaaaattcaggctgcattgctaaaaatgggaaaccttggcagaagagcaatcgatttattaggagaccaccaatgagttagaagaggagtggaaatcagaattgataatggtttgatcactaccagtttgctggatgttttggatatggttcagagaaactgaaagctacagtctttatctctcacatgctccaggggcttttgtttcacataagccgcctctgcctagagttctcttcacccagtaaatagatttttatgactcagtggaatatactctcttcactccagaagagagctgtccctgtacgtaaagtgaaataagatcaaattcatttgaacacagcttagttgattccaggcttgggcattgaagaagaaatttaaataacatttctctgctgtatctcttgtctgtcttctaggctcttagctccaaagaccatacaaaaaaccatacaaaaaacacacagcttatcaccaatttttaatctctgctagctcaaaaactttccaaagcaaacttagcctattgcataaatgattgtatacttttgttcaacattaacacaatgaagaaaagtgccatgagctgaaaatagtcttacagaaattaatgaccttgttttgttatgcattttgacgcagcttcaccacatggcaagagttgataacttcttttcataattgtacatttcaaaaaaaaaataagtctttcaaagtagctagttaaaatggataagagaggcaggtagcatagaaacagacagtgaggttagaattaaatttaggttccattctattctctagtttcccttcacagctgggtacaaactagcatcttcaggcaaatctttcatctccctctttggcagtgtaccatccataagttagaagatttgtttatgattctaaatgcagtcttttcaagttctgaactgtaagatgctacattggaaagcagtaactctaataatgttttagaatattttatttcattcttgctgagataatcttgcaagatattacagaaaagagtatccaaaattactgagtcaatgcaaattttattatgggcaaaattttaaaaaattacatttttaaattggctgccattcgtgagtcaaaagaaattaaacctgtaggtaagtaacttgtatttcattgactcttttgtgtgtaaacctcaccagaaaagcagcttcaaaatgtgactgactgaaattgtggccctatggaagcagagaagtggatgtttaactgggtggacttgaactcctttttcaaacaaagctcctggggccagagagctctagcaatgacactcatagtcctgtgtgattcctggaggtgctgcagaagtcaactgagaccctgactagatattcatactaaaagctagcatttggggtcgggggagggtgtagcttctaaaatttaatacaattctgaatgttgaccacttagttgaattctgaggatttgttctctcttttgcccctctcctttgagaaccgtggtctcctattacagttcctcagtatatcctgtccaataagcaagcagcagtttgctaaccatttttcaggacttcgaaatctgttaggatgtggaataggacatgggtctgtatcactattactgtgcaagggagtgctaggtccttttgtctggggcagagggagctagagtgttcaggaatttttgacctgagtttggagttgttggataaagttgcttcaaaagctagagctctagacaggttccacataacagagtcaaaccacgtagaaaccatgtaatctctacttcttctattcccttctcagttccctgagtcctgagcctgctctctttaagatcaccaataagtcactgtcaccaacgccactggataacttgtggtcatcatcttctttgagccctttgtacatatgctaatgctaagccaccttcctcctagataccctctctacatttggtgaatatgtctctatttaatcctgtcttttttttctatctctccgcttattctttctcagtcctctttgcagatttcttgtcctccaacattctttaaatggtgatatccattgtcagcccccttctcggcgtgaaacattaccaattattagtagtgttatttatgtctcccttaccaaggtgtctcagtaactgaaattccatcattagacattcatttcttttgggcgcggtggctcacacctgtaatcccagcactttgggaggccgaggtgggtggatcacgaggtcaagagatcgagaccatcctggctaacacagcgaaaccccgtctccactaaaaaatacacacaaaaaaattagctgggcatggtggcgggcgcctgtagtcccagctacttgggaagctgaggcaggagaatggcatgaacctgggaggcagagcttgcagtgagccaagatcgcgccactgcactccagcctgggggacagagcgagactccgtctcaaaaaaaaaaataaaaataaaaaataaaaaaataaaaaaaaaacattcatttctttaaagttcactttgcataatacaatatcctgtgcaagggataccttgctaaatacatccagttttcagagccactctcctcctctgtgaaaggtggtacatagcaggtgatgcctctctatttccaagcaactagggaaggaggaaaagagtgcaccaaaagggtattaaggaacaagaatgagctttgtttcctttacagttttgcttaaggttgttactcttcactgtaattcttatcaaagttattgtctttatttatgacagaactttccaaggtgagcaagaggttctacccagtgtgggtgctaattacccgacagtccctgaaacttctctcaggtgtcaatagtattttctccctttttctcatatatgttaattattcagtaggattaatgacttatcactctgatttcggcagtacggcgaatattagtcagcctaactgcttagagcaacataggatctgaatagcaacagcaagatttaccttaatgcttcaaggaacagtttcttgagataaatcaacaaatccctaattgggttacagtaatcagatgtgcccacaagggttgattttgcaagtgaaagattgaaaagagaaatatcctaagataaatccaattaaaatttttattgagagatagaacaggaaatctaaaggagagatagctcaatcttttgaattgagtgctgaattaggaaatagggttgctacagctttttccaagcatctttgtttactcattctctagccctggggaagtcgcttctacttggcattctcatctattggtaaaattaattaatcctattgataacataagatgttgctccttgaagtttgaaggtggcatgtaaataaattgcttaaagccttttggaattgcattcaataagacagattctccatggttacaataagctacttcctagctaaaggtaagaagctaaagtgaggaatcctgatgatgtctccatatttaaaacaaacaactttggttcttgtttgggtggctttaaccaccttgtagtgagcttagggttcctgcaggtgctggagcccttccttataaggagctttttatgtattaaaccatttcctgaggaacaataatcagaatttatgtgccagcctctgttagaagcacaaaatatgtgttaaaattatttcagcctcgttaaaaccttttgaggtagatagttaatatctccaatttattgagaaggaaacttaacacaaaaaaaagtaaaacatttttccccaattcactaacctacaaagtcgtaaagctggtatttgagcttttgttcttcatcaacaggctgttttatctctttatagttctttgaaagtgtgttaggacttcattagaatataaggacggcatgaatgcaagtatcaggagaatcaagaaagtggctctttcaatttcttgctcttgctggttcatcgattcaaatattcctggagcatctatcatatgctaagtgctatgctaggtgatggggtgttccttgcccttatggggcttacagtatggtggggaaatagacactaaggaagtaaaaaaagaaatatataagagcaatataaatagtgtgaaagaaataatcatgaagtggaatgaatatcaaggtacagaccctgtttccataaggtggtcaggaaggacttctctgaggagatggcattggaactaacactgaaggatgaggagtcagcaatgagaaatttcgggacagggatggagagtggagggaaggagaaggttttatgctgagggagcacctggttaaatgccttgaggagagaaagaacttgtttgcatttgaataactgaagcaaggctagagtggttgtgtcttcatgaggaaaaaaactggctctgtttttagatgtatttgcagctgaagtattaagatttctctttaaaataatgaacattttattatttctagtactttgcgtatgaattatgcaagagtgggatttgaaaatcactgtgtggtgtggaggaaaatctgagcagttatcagtgtgtgtgatggttaatactgattgtcaactcaattggattgaaggatgcaaagtattgttccagggtatgtctgagagggtgttgccaaaggagattaatagttgagtcagtagactgggagagacagacccacccttaatctgggtgggcaccacctaatcaactaccagcatggctagcataaagcaggcaggagaagacggaagagcagacttgctgagtcttctagccttcatctttttttcatgctggatgcttcctgtccttgcatatcaggctccaagttcttcagcttttgggctcttggacttacaccagtgatttgccaagggctctcaggccgtcagccacagactgaaggctgcactatcagcttttctacttttgaggtttggggactcagactggcttccttgctcctcagcatgcagacggcctattatggggcttcgctttgttactgtgtgagtcaattctccttaataaacccctcttcatatatacatatacatctatcctattagttctgtccctctagagaaccctgactaatacagtgtggtatctgctctgggatggggtactcccatggccagcagattttgttgatacataagtggaggtagaaaggcaagaggcattttactagaggggacaaactgttggctttctattcagactatgaaagacccagaggggttggattgtaccaaatgaacatctggatcagattttgttcccctgaatctcaggcaccttctgaaaacttattggactctttggataatagatatgattactctttggcttgattcttcaattcagcaagtagttcccatccccaaatctatttcttgaaaaaaaaattaacttgtctatttgtttcaaaaagaatcagacagaggcccttggaaatattatatcttgatctaaattcatagggtttttttcccctctaaaattgtactacatactcttcaacttccttttgaatgccatttgattttttatgtatgagacaaatgtatcatacagtttgggttagcaagaacttgcaggaacaattggccacctttcaactgagatattttccagaaacagggctttaaaaagtagagacaatcttccttcctaaaagtctaatccaggaccatttcctcttatattctttttagggctaaccttaggactctcaaacaaacagttaggtatgtacatacacacatacctgcaaacacacaccgttgaattaatctttcaggtgcagcatggaatctgaggcaaagaagagattactataaacatatctaggccaaaatgcatggagttcaagaagaggaaaaagcaaagaattgtaagattcagaaagaagaggtgagcatctcagccatcaacaatcacattggtacattgcacaagttatttacaattcaactcctgctcttggtgaatcaaaaccttgtttggaaatttcactgtacaaggcttcttgtcttctttgccagtggtcataccgttttttccaacttttccagtaatgaaggctggtcctatgtagcatatgctttccgtgccttttatctccactagcatggctcttcaagttcagaagcaaagactttgggatcagattggattgaatcctggctccaccattattagcaatgtgctattgggcaaaccattaacctctgtggatcatccataaatggatagctttgaccagggtttctcaaattttggtgaaaagctaataaagaacacaaaggacaagttcattaaaggaggacaaggcctgggacatttttctttttatcaaattccccaggtgattctgatacccaccaaatttcaaaaaccactggctttggggattaaagataaactaatgcaacaagcacctggccatcaagaaaggtttcctaactggggtcctgtggtaaaatggaaaggagttttgtctttggcattcgagatgtgaatttctatgtaagttccattgcttaataactgtggcagtttggcaatgtcatttaatttgtgtgacacatggtgtccttatttgttaaataggaataatgcccacatctaggggttatgggcttaatggattaggtgactcacagcaggtgactgatgaatattggctgaagtataatctcttgctacatttagatgtaagtatttgtatagaaccttctacacagagaacttatatgaatttgactcaataaaaactctcaaaacttggctgattacatatttattgaacatagaattgaatgtatgaatgccattgcatttacccatgacatacaatacaaattttgacacaaagtgctttgattgcataacatatagttcctatatatgccctcacttttaaactctccatccaatttctcacatccattcaataacccgagttgactgttccaaaatactagggaaatattttgctttactgagttagaaataatttttattgactatgtgcaaatcctcttaacacacgactaacatctcagctaatggcaaacataggtcacagttattaagccatgctctcaaatttagccattctctcactttatgaaactcaaaatccttcccaagttgttaaaagattttatacagacctcacagtcttcaaactctctgatgctgaataacctgaataacaattttaatatttattagtcattatgatttctttcttttttcttttttcttgaggagcagcctctctctgttgcccaggctagagggaagtggcatgatctcggcttcttggctcactgcaatctccgtctcccaggttcaagcaattctcttgcctcagcctcccaagtagctggaattacaggcacccaacaccacgcctggctaatttttgtatttttagtagagacggggtttcaccatactggtaaggctggtctcgaactgctgacctcaagtggtccgccccccaccttggcctcccaaagtgctggaactacaggcgtgagccaccactcctggctaaaataatttcttatcacaagaaaactccatagggttatacaagtgacagagaagcaaattcagtctggcctctgatcttggtggcagaacaaagaaggaaatcactggagggctggaggtggatgaatgaaagccagagaatagaaaatgagcatcagcatccttaatgaccaccctgcttgaacaatcccgcttccaataaacacaaagaaatccacaagctccaatgagaaacagtcttgaagcaaggatgagtttctcttgtatcccattgttttctgtattctgagtgggttcaaccgctttagacagcagagcctatatccctctcctcaatttccacagccccacttttctcttattttctttttccgctcctttcttctcgctctccttttctatgatctcttttgtcctttaacgaatgaggttgtaaaggaaaagttattccatattgtccctttaagacctcctctcctactcaacaagcccccttctagacttaatgggcaaagagtggaccataatactatttgaaaccaattcaaaatcctccatgctgacagcttacaccaggagatacttgatttagggacattcattagaaaaatatataatacaactacaaatttcccttcagtttttccaaagatttctttattaaaatggccagaaggacaacatttatatcatgactaaattttaatagtgatctcttgtgtttacaaggagatgtttatgctcacttatattttgaatgttttatcttctcccattgcatagagacagactactctgctcacaggtgaaaaaaaaaaaaccacataaaagcctcagtaaaaccaagtgactgaagagaatcaatggaagtttgtttacattttacattaagtataaggcttcaacagaagcaagtgctgtcattctttgagccacattcattttttgcctttaaagccatcatgactaattaagaagtcctctaggggtgaagcctgggcataggtaggttttcaaagctccccaggtaagtccaatgtgcagccagtgtggagaaaacactgagatggtaagaaggcacaggagattctaacttccatttctcaggacaaaatagagctcatgcccctgcccggccagtcactgtctcatcatcttgtcttattaccttttcgtaatattaactaccatataaaattatctttatatactttatgtgttatttgcatacagccagtctcttcttttgggaatgtaagctccagtgaacccagaacagtatttgctataaggtagttggtctgttatatatttgtcaaataaatgaactaaaaactgttaaacatcagctttcttgtctgtacaatgagcaaaatactaccaccaccttccttgctagactgctgtgatgactcaatgtaatcatgttcatgtaaactagtgggtaatgtgaaatcttaagaaatgttagtcttactactacaggacattaaccaactccccaaatttcccacaatagctcacaggttgaaatttccaacatgagattcccttctttggatttcagctgactattgttaaaatagtcagctgaaaacctgagtattgtagcttcattactttggtggaataatattaattagatgagttcttgtcagttagcaaccctaaaatatagaacaagttaattttgagttaagttcaaaatgtagggaagttctgtactattcaggcagggcagccccaagttgtaagaactggctgtggggagagaaggggagaaggggatagaaaacctgcagggtgttgaggacattgggtttcattgggacctgaaaagggagaaggaagtatagtacatgaataacaaactctgttgaccctggactagggagatctacaagcagctttggtcagaaaagtgaagcagacatacttttagtcaacaatagttaagtatcctgtggatagtacaaatgatcaaatatatcttctgatcctatgtcaactcttgatgtgttattatgctgattttataaaagggaaaatggtactcaaagaggtggtatttttagagacagggtctagctatgtcatctaggctggggtacagtggcaccatcattgctcactgcagtcttgaactcctggactcaagtgatcctcccacctcagcctcccaaagtgctgggattaaagatgttgagtttttaaggaagcagcatgttatactggttaagaaccttgaatccttaggcaggctgagttaaaattccaactccaacatgtaccagccatgggagcttgggcaagttaggactctgaatcagtttcctcctctgttaaatggtaataataataataataataataataataacagcagcaatattctagggttgttataattaaatgcattaatatttataaggtactcataatactggtacagtgtgggcaccataaaatcatacacaggatatatacagctagtgggcaacaggactttttaaagcttttaaatttatgtatctatatcaatgaattttcacacattaaacatattcatgtaacaagcatctagaccatgaaacaaaatattaccagcacccgaaatccctcctcatcctcctttccagtcatgtaatgccccccacctggtcccccaaccaaagtattcaacatcttaacttgcaatacacagaatagtcttgcctgtttttgtactttgcataaaaaggatcatctaatgtataatctattgcgtcttgcctcttccactcaacattatatatatgaaattcatttatgttgctgtatggtatacagtgctatacagcatccacctgtaaattgaccacaatttgtgtatccattctgttgttgatacacttttgaatagttcctagatttaagctattacaaatagtgctgctataaacattccactaacattttttggtgaacatgtatacgcattttatttggcatatacctatgagtgaaatttctggctcataatgtatacatacagtcagctttagaataaactgaaaaaagaaagcagttgtacaatcaatactaccatcagtagtgtgtgtgaattccactttatctttttcattgcagttattctggtggctgcagagtttcatctcattgtggtttcactttgtttttccctgatgactaatgaaattgaacacctatttactggatacttggatgtcttcttctgtgaagtaacatgattaaaacttaggtttttctaggtcaaagcctgtgctctatctccactttttgtttttaagaactgcctcccttcaaagctttccagagaaatataagtactaatttagaaaccaagggtatccactatttttattttgtattcacttttttttccttttggaatttagagaattatcctctagtaatggagaatggagagaggggtcttccataaaatgcacttttgctcttccttttgttgttattcaaagtggaattaaaaattatcttagctctgcaggctggctgagagctcagagctcagagaaggtggggggatggagagacaataaggaaagctgccctacttctggaggctccaagacaccatttttagtgacagcaacgtgctttcaagagccaggtgtgtgtgggtgggggaaagaaggttggacttacgtatgagaataatgacaatacagaaagcctctgggtattttccagggaaatgcagattgtagctttggattttaagttttactttcactgttaacacatgaacaggtattcctaggtttcttgcacttcccccaaatctttctgtagcaaaactaagtaggggaaagttactattataagatgtatcacttgtaaaacatttaaattgttcctgtttttctgttatttatgagagtgcacaggaataccacataattccttaacttgattttataaaaaaacaccagccttagtatcatccaaaatacagctcctatatttttactctcacattgaaaagccaattttttttttttttgtctttcagatagagcactaaacagctcttccttttcattaaagtataccagctaaataatatatcatcttggcttatgtttcaatcatgcagtttttcttctcctggacttgaaagaagcttcttccttaagaaccccttctcaaatataaattattattattttttagcctggaaaagttgggtggggaggtacattgtgagtcacctatgtcaatctgaacattgctgaaaacgaaatatactttaatagttccaatggtattcattcagccttattctgacctttccttgtttttactctaattaaacataaatcttgaaaaacaaagagccctttgacgactataatacatttttgtactgtgacatgccctctggcttaaggtgtatctataaagaactgagactgtgactagcagacttggcttcaggttaaagatgaatggatctactaacaattggagagactgtcttcaaaagcatggtcattggaagcctattaaacatctctgtcattaggaatttagaagcagcaaacataatttttgcttttccaggagctggtattttggccagcatttatgctctccagaacttcactggtgagcccaaatggtagtctttagcttcccaagaacttacaacatgacattggacctggaggcttttttgatatggatttgcttgaactacttaaaccgtttttctattgccaagaatagtaattaatgcaggaagatgctaagtttttcacttcaaaagtttcatcatattgtatccttactacagacaggcctgctgttttgctgatcctggcatttttcttgatgttgtgtttttagggagagaaagtcaatgacttctttttgattcaacaattagacttaaatgtatgtattcattcaattagtatttaaatccctattacaggctgtgcatggaaatagccctggacaagcagtattctataggagagaccaaattcatagagctcacaggatactggggtgagggaggcagtaatcaataggcagaaactaatgaaatggtatagggtgggtggaacagtagtcttttttttttaatttttaaaaataatttttagtagagatgaggtctcactatgttgcccaggctgttctcaaactcctggctcaagtgatcctcctacctcagcctcccaaattgctgaaattataggcatgagccaccatgcctggtcagtggcacagtattctaagcagatgtagctgtgtttggacagcacggagggcagcagacaacatggagacccacaaggactttcatgtggccacaccttccagtaaaaggaggaagtgaaaccgaagagactggcaagggcaagatcccagaaggacttctcccccatgcaggggagtttgaatgtaattttttttttttttagtgatggggtcttggtctgtcgaccaggctggtacaatcataactcgtcatttgccaaagtcttgaactcctgggctcaagtgatccttcctccttagtctcccgagtagctgggactacaggtgtattccaccatacccaacctgaatgtaatcttaaaggcaataaatgggaagtcaatgaagaattttaagaaaaaataacgggatgagcatcagatacacatttatatgagttagtacaaacttggtgaaggtttctggaggaaatttaacattcattcttttctagtggtggaaatcacctccttcatctgagacatgggattcactgcctggacaagataggtctgtatttctttcccatgcctaacctacaggcatgttgatagagtccatgtgaaacttggatgctaatttggcactgcagtttggaagaatgctaatgcaattcactttggcatgactaatgatatgttcctaccttgtttatactaaaattgaaaaaaaaatcatttgaagcctcccttcacagtcatgatatttctttcaaattgagatggtaaagtctgtatagtattgcaatttctagcaaaatcttttaaagctgccttatttaacaatttagaaaatatttaatatgcaaaatgactttcttttttaggtaataccacaacagagttgcatttacattcacagcagaacttgacttaaggccttgaaaaaccttttacagaaatctctattggcttttaataaagagctgtcaaaagctcatgatggtattatttttcaagtggccataatgcatttttgacttgatccattaaacatagataggaaaacctccacaatagttttcatggattagggtgacatattatgcgctcctgacagtatggcagaaggaaaaagtaaggtaattaggaacaaataaattgagactacctagtattacatggattacatgggaatcctagtgaatcttttgggaaaatgcagccctattgaggaacagcgttctttgtgtggaagcactgagaatggccactccacagtgaatgggcagagacaggtttggaagcaaatggaattaaccaaaatgaaggaaagaggagaaaaccaacattagaaactatgaattcactgaaattaagaagccaaaaagacctgctaaatctcatccgacttcttcagcttgcactgaggcctctcttctcagagcgcatctaccttgctgttttatttaatttgtttttcaattatttaggtttcaagctttcctgatctcttacaggaaaattttccaatttaatcaacttagcttgtgggaaacccttgctagattttgcatttcaggatgcatacttggtagatgctttaataaataattatgtttgaataggtgaatagatagaaatgtcaagaaataataaagataaacattttgaatattttttcagttcaacacaagtaactctaaatctgcaaactatgtgactatggtaattttttaaagggtatagtgacagaattctattattatgtaagtaatcaaattatgctttagaagagtttgatataaattcatacttaaaatatgaattcatatttaaaatacgaattaggaatgtaaaagatccaggaaaatataggtataatattaagaggtaaataacatttcttttaaaattatgacattttattcaattttattctagtacattgctagctctccctcattcaacatacactgtaaatcaggaatactgtacaattttgattttttgtttttgtttttgagatgaagtattgctttgttgcctgggctggagtgaagtggtgcaatctcggctcactgcaacctccacctcccaggttcaaatgatccctctgcctcagcctcccaagtagctgggactacaggcatgcacaaccacactcagctaatttttgtatttttagtagagacgcggtttcatcatgttagccagactggtcttgaactccttacctcaggtgatccgactgccttggcctcccaaattgctgggattacaggcatgagccaccatgcctggccagaattatgaatccttaagaatttgagaaacaggacaggatgtaagtattgttgcttatataacccaggaggagtaaagctcattgataatatttctgttacagtaaatgcttgagtttctgtactaacttccagggaaatatggattttgcagagctaaaggaatgccttaactaacaaacattcaaacaaagaagccatatcgagtcactgcatttaagctctctagaatttctgatcaactgaacagagctttgctctgaaactcaaggctgactctgccaacaatggctgctctgaggcagacaataatgcagatgaaaatgatttaggggaagaacaaggtcaagatgctccctgggatttataatccaagaagccttgatttcacctccagaatgcaaatgcaatgccctggtttgaaaagcaccattctcctaaccataaatgaacccacatttctgccctaaaaagatctgctcactctttttcagctaagactctaatatttgatgaacccatggcattaatgaaaacagatttttctttagcagcaagttttattgctcattttacagcctgattccatagcctgggaatgatcttgctactataactgcaattacatctgaattcttaagtggtgtgttagggcatgtttttatatttggaattcatgatactgttcttaatagggactttggtaatgaccaaaaagacccttgctagtgagatgtgacaaaaagttgttcatattacataagcagaagacttcttacactggaataaaaataatatagagaatgcacaattacgtagctcatttcaggcataccaacatacttacttgttttgagttatcacaactcagtgtagcagcctttctgataggcaccaggaatttggagattaataaaacatggtcagtttttggaggagcttaaagtccagtcttctgaaagttaagtaaaaattcatctggaagatgtgataagggattgaaggaaagagcgaaaaattggaagtttgacagacggattaacagctgagcatgggtgttgggaaaatgagagttcattgaggctgtagtgacaaaatcttgtgggggattgttgggagacgagactggataggtaagtaggaaccagttgctgaagggcctaataatgcacgtgaaatattctggatttaatccagaaaatcagggagagcctctgaaggactatttacacagggaagcgacaaaattgaatttgatcatcaaaaaaaatgataaagcattcaaactatttttctgcagctatgccaaatattgagaaaacaatttctctactgaccaaataacatagaaatggcctcaaagataggcacttctacctttctggttaaaatgctatactgctaaagctggacggtcatctacaccactgggatccaacatgcttcatgcttcattgctactcaacagaacttctatggcacaagggaaagacaaagtctgtgacatatctcaaatcttctcttttctttccccatagtggagagttttgcctgaaaatgtttaatgtagtggctgtacagtttcaaagtgcttttgtttttccacagttacttaaccatttgaagccctgaacataagggtggatgattgggagactgtgtccatgaacattctttcaaatcaaacttagtttgaatgaaccagtcagccttaggggaagattactgtgggtaatatatttctgctggtctcaaacaaacaaacaaaaagaaaaataaatacagttaaagtaaggacatgacatcattttctgaaaaatgtgacattgtcttgcgtttttaaatgtctcctgagcacacactctttttggaaaccaaaaaatataatttttgagaaacttgattatatgttaaaatttttgaagttaatttgtaggccgtaaaaatggtattatttaatatgaggtgagattactacagaatttggttacaaacccaagaatttgggttctaaactgactatccctccccaccaggttccaaaggtaatgtgtgtacatataagccacaagctctaatgcagaacactccagtgagttgggaggtatcctgtggaaaactcatgttacctaaacaaggtaggccggaaagaccaagagccaaagcaggttgacggagctgccctaaccttgtacctcttggccaagtccagatctcagacctcaccatgcacaggctgtcatccagtgccagcctcagagaactcaaagagcaagatgaagggaacatttctgtaatgcctactgcagatctggcctcaagaaacttcagtgggtcttctcaggctggggcatcagaaacatccctgaagaaattacatccacctccaaaaatacagagagaagacaatgattttttcaggaagaaacaggactcctccactctgatcatttcgggacaaagatcagacaaaagcagaaggaaaccaaagagaaggagggagaatcagctacttctctagtgttctgtgaggaagtccatgtagagagagactatgaccacctctctccctcttccttccctgttcaggacaataaaacatctccattattcctccagcccagtggccagtgaaatatccttcagcatgtcccgcaggcctctttggtggtgcagtgaaatgccttaatcctgactcaacttggtgataagcttggattaagtatgtagaggaatgtgagaaggaatgtgagaaggaatgaagactcccaacttcctactaaaagagtcctctaaactgcaatcacatcctgtttccttgtctctaagactcatttttatagtattaacatcagtgatttgggggcatgtctcatttatttgatgtgtagattttacgttgctttttctttgaaaagctcttatcgatagtgcaacccctaatcagtggaatcttaggattataatagtatacatatgacagtagaagaataaaatctagtttcacacttaaaaaaaactctgatttagcatttgaaatctgtggcttataactttagtcttttcatgcaaatatttttagggaaatggtttcgaagagcaacactgcaccagcttgtctgctgtcaactgcacatcaccatacatcctcggggagaaggccgggccctacgcttcctggggtcccttgccagctacattccaatatgaattatgccaaagagagtcgtttccaggagatctggaaagcagaagaaaagcagccttcaatctccagcagcagccaggtgaacagtgacagatgcctatggaagattttgccaggggctttctaggtgagtgcctgcgagttacttacttaggtgttgcaggcaattaagataatcagctatagcttctgtgtatttcctgcgttttcagagttcttgaaacttgaagcatttttttccccgacctttgtttctatagcccatccaacagttatatcagcctctaattgtctgtattacagtcttttatgctcgaggttctttgagagacgaaaaaaaagtggcaatcacattcttctttttcctgtgatactcctctgccaatagcagacaaaagttttaaacagcttagggacacttgttggaggctgtttccatgttaaagaagagattacagaaagactgaaggctattctttgatcttatttagttcccttgtctcatccaattatttttattttcatttatacttcatgttcctgtcttcagatatccttctctgttccacatgactgtataacatcagtagaagttaccatgtctctagttctgaatgcttttaagttcatgtttatatacattatctcacttgattttcacggcaattttataactcaagtggattgacattatttttattttacaggtagggaatttgagacccagatatttaagtggtttattcaaggtcacatggaaaatcaaggaaagcgctagaactagaatccaaaatttttgaccactattccagagtgtctgatagtattacattagctctccaagtaagatagcaactgcctgcttataatacttttgatctgggcaaattacctacagtataagccccatgaactccaggtaattatctctttccctgtgggatagaatccaagtctttgtcaatgttttgaaccccacccatcaaattaatctaacaagctcagtggtaaccacgagctcactgggggcagcgctattattgttatttggcacataatatacttggtatgctgaaaaagtataataatgagagtgacaggatatcattatctctgacaacctttcagtggccaatatcaattagttagtggtctcatacctactgaatgagtttttatatcagaggaactcccaatattctaactgagctatttagcactatcatttgaagggtgcccgattgagaatcacatggacctaaatgtttgtttactcaaagataagtgtttcaggataaggattaaggaattgggcatgttgggcgtaacagaccacaggctatacttatatgaataaatggagagcttggacagttcttaggatcaatctttctttaagaaatcaaataaataaagatagcctcatctctaccaggagaaatacaccttttttttttttttttttttttgccttagaaagcactggcttctgttaattaaacatttccacccaaagatagcaaattttaaatagaaaaaaaacaggaaatatatgtaatctacaataagtctgcaaggcaaatggaatagttgtagcaagctcttaaagcaaaggtaaagatgttgaaaatatattaaaacttactgttgactaaactaggaatctgtggatatatgtgcatatatttatatgcatatcctatccaaatgtataaaggtcttaatggtttacttcttagattaaaaaattcttaggctgggcatggtaatacgcctgtaatcccagcattctgggaggccagggtgggaggatttctttgaggccaggactttgacagcagcctgggcaacatagcaagaccccatcattacaaaaaaatttaaaaactagccaggtgaagtagcactcatctatagccccagctgctaggaaggctgaggcaggaggatcacttgagcccaggagatcaaggctgtagtgagctgtgatcacaccaatgcactccagcctgggcaacagagaaagaccatatctcccctgccaaaaaaaaaatttcttctaaattttgacatttaaaaaaaattttaattttagttacatttctttctttctttttttttttttttttgataccaagtctcactctgtcacccaggctgaagtgcagtggcatgatctcggctcactgcaacctctgcttctcaggttcaagtgattctcctgcctcagcctcctgagtagctgggactacaggcacgcgccaccgcacctggctaattttttttgtatttttagtagagacggggtttcaccatgttggtcagggtggtctcaaactcctgacctcaaatgatccacgcacttcggcctcccaaagtgttgggattacaggcatgagccactgcgcctggccaacattttatttttaaaggaaatactttttcactagacttgtgtacaattgcaacaacaaagtcatcttagaaggagaacccatgaactgtgaaatttaggcccactgagcacttatgaagcatcgactacttgttacccactgctccgggtactatcactgctgagaggggaggtgctctggggttaaaaggactgaattacccaagctttgtcacacaggggttgtgaaacaatcatgtatcttttcttttaaatccttagttttcacacctatacctcatatttttttttgaagatggcatccaacaaaataggtacttaaactatttagcagcatgcttggctgcattcggttcataaatactcattcctctgtttttcaaaagtctcataattcaagtactttgcccaaagtcctcaaactcagcagctgtgctgcttccctttcctccaactttcgcaaatttcatctgttctatggcatctactatcgaacatcagaaagaagaggcagaacttaacagttaggaaacagacttcctctactgtaatatgaaagtcctcttctagatttttagcactccttacaagctttggcctttgtaaaaggatgttatgtaaaacaaacaaacaaacaaacaaaaacaaaaaaaactgtgctttgcctttggaacctacttccctggacatacgctctgagtacagaaagaagaggctttagcaaccagaaaattaggaatagcatgtatgaaattagacatggaaccttgcaactttgagacaggcacagaaaggaacatgggctgacaagagatggatgatctaaggtcgcctttcccttgggagtgctccctgataatggctgtggctactatgtgatatcagcaaccccagggcagtgacccctttccattctataccccaagcatgggaaacagtttcaaaagggtaggctatttttgctagcaaagtttgtatggttctgtgctacatgggcatatcaacataaattcactagaggtcctctcctttgatgataataatgattataataataatactatgctcacagtatttttaaagtacaaatggcttattataacatatagcaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttaggaagtcaaggtggtgattcctcagggatctagaactagaaataccatttgacccagccatcccatttctgggtatatacccaaaggactataaatcacgctgctataaagacacatgcacacgtatgtttattgtggcattattcacaatagcaaagacttggaaccaacccaaatatccaacaatgatagactggattaagaaaatgtggcacatatacaccatggaatactatgtagccataaaaaatgatgagttcatgtcctttgtagggacatggatgaaattggaaatcattctcagtaaactatcgcaaggacaaaaaaccaaacactgcatgttctcactcatagatgggaattgaacaatgagaacacatggacacaggaaggggaacatcacactctggggactgttgtggggtcggaggagggggagggatagcattaggagatatacctaatgctaaacgacgagttaatgggtgcagcacaccagcatggcacatgtatacatatgtaactaacctgcacattgtgcacatgtaccctaaaacttaaagtataataataataaaaaaaagaaaaaaaatatgtcacctgtaaaaaaaaaatgtatagtaaatatttgcttgtgtatattcttctctcaattttgcacatccctaatgcctactatcctgagtcttaatggatgcttattacaatttaatacaataatacaacaataaacatgataataataataattaacacagcctttgaagtgtcctctgtgggccccaacattctgatgtccaagtactggatgatggcagaagggcaagatgtttttgaatgaaagaaatggaaagtatcactttaacaaagagaaaaaaaaaaggaaaaagcaccaaaaaagaaagaaaggcatgctcatttggcagtcaaggaacacagtccttttaaaaagcaatcctctgccaagtttttggcttctgtttgttgttgttttaaaggtaaacacaattaagaaagaaaatagcaagttgttaaaagcacagctgaatatttatgttttccttctgagacttctgggcctatttctggggatctttcttcgctactgaacatcaaaactcaaaccaccacaaaaataactcttccgcaccattttgccttggaaaagtggtaagtttcattttcccgtcccttttagattgcgttataatttctcaaagtgaacatcaacgttataattttctcttccatttcacaaaacacacacttttgtgttctgaaaattccatgttatcaagccttagcaggcagtagggtagagctatctgatctcatcttaattgctttagcctagataagtaactatactgatgataagacccccaaatgagttaataatcattagggcttattcttttctgaactctttgaatttgttttgccagagaggcaacttcagctcttgcctgcgtgtttgtgggaactccccaacaatctcttagtccattgcaagtctgctaattcattcaactctcgttctttttttttttttttaacacctgtgtggagacatagctacagttaattccaataaagtaagtgtctgaatcaaaacttactgtacgtgaacactcatttcaaactgtggacattatgatgggatgaagaaaacaacagagaggagagttagtgaacagcatctcagctctgttgtgaatgccactcaagcttgcttgttatgaagtcccttctggctgcctccaggtgatagtccctcccatccatggaaaaaggtctctctgaaagatattgcagcttgcatatttaattgctcatcacagactaccttttttcatcttcttatgattggaaaaccttctgggacacctgggagattgtttggagaagtacttcccatccctctgaatattggtattttgaagcatgatgataattcctcagaatacaaaatgcttaaagagcgatgttgtagcaggaatactgggaggcaggaaagtctgaggcctcctcaggtggttgctttcccatggcgaagcaaatatccacataaaacaagctgaggctgtatttacaagcatagcatgggtgggcacgtgggtactttctcgttctcacatgcaacataccagagacatgcaaatgtgccgtgtgtacactgtccagtgatggcttcaacactctccacatcagtctcctcatctccgtgtttccctggccaccgctctgcctttcactctgtgctgtgctcatgtctctccccagatggaaatgttcaatgattttgtgctgtgtaggatcaacttcaaagcccatcactgaaagtgttccttaatatggggttaacagcctggagtagacagaataatgcctgtacagatgtccacacctatcttaatccctgaaacctgggaatatgttatcttacatggcaagagggattttgcagctgtgatgaagttaattacaacataaggagaagatcctggtgggcccagtgtaatcacaaaggtccttacagaggaaggcaggcgagtaggagtcagagaggagatgtgatgacgtagacagaggttggagcaatgtgctttgaagatggaggaaggggacacaagccaaagaatgcaggtggtctctagaagctggaaaggcaggaaacagattctcccctacagtctccagaagacatacagctctgcaacaccttgattttaacctgtacaacccattttggacttctgacctatggaactgctgtataataaacttgtgccatcttaagctgttaagtttgcagtcatttgttacagcagcaataggaaacaataggaaactcatcttctacctgtctctcctcatctccctgaagcctcaggtaaagccatgcttgttcacccagggtgttttacagagcctgactctgcagcttttattcatcctgaagtcacttctgttttctctgaacatctctaggaattattctgagactaccttagatgtcctcttactcataggcagtattataacatttctactattactttaagctaaatttaattttttgtgactattttagttttctcctttaactaaattttaacttctctggggatggggcttatgtcatattattttcttgttttacccaggatccctagcatgatatcatgcacaaagaaagcattaaattggtatttataagtttggtttttgtaaactgagacatattatgtaatgccataaggggatttattataaaatgctcaagtagactctctttttaactgcttcatagaattaaaactggcagattttcatagagactctaattttttgaattagcatcatagaatgactctataggactgtgattactgatcaataatagaaaattaggaaatagaaaacaaattataaagatgataggaaggaaatggtaggagaactagagaaggcactaaaattctcaaagacactttcccaggtaaatcatgacatgccttagtgcagatgtaacacacaaaatggactgatttagcctttaaactttagaacttatattgaggcatttatgtggcctccaagctcctgttcaatgccaggtagtgagggtgtttcccagtaaggttataggggagagtgtcatagactcccattagtttttccaccaagaagctctccagtgatgagttaaaatccacagatgataatcttccctaaaggatcatagtaaaatattataggatctgcctgtatcacgggcctgtacatcagcagttaaaagccaggctcataatcaactgcctaaatggaaatcctaactccatttcttagtggttgagtaagctttcaagtctctctggtctcagtacttcagctctgcaatggggatattataaatacctctttcactcacctatggtaaggacggaatgagatgcagtagtttccccctatccatgaaagatatgttccaagactcccagtggatgcctgaaatcatggatagtaccaaatcctatgcaacataaactatgttttcttttattcatacatacctatgataaagtttaatttataaattacaaacagtaagagacaaacaacaatataatatactctaataaatgttatatgaatgtggtctctctctctctctcaaaatatcttactgtatggtaccttgcgtaactgaaagaatggaaagagaaactgcaaaaagtgattttgaataccaaatcaccggggggacaaggggactgtcatgtatgtagagtgctcagcggaatgtctggaacataatatgtccttatgaaagataaattgcagttactgttatctctgaaaatctttttgggtcatttttgtaatcttttgaaacacaaaccagttgagcctgtttctagatgaatggagaagaaagagctgctccataggaagaaaaggcacagagaaaaggagaattaagtggtaggatgaagaccagtgtttaaacagtagacctcaaggcaaggtaagctctagcaaatgtttccaaatcaatccaccgttatcattagcatttctgtatttgtatgcactgctagtgaaaacaactgggaaggataaaagagtcatcttttctggcaactggctggaagccaagcaccttacaggctgcacaacttcaacagcattatcataaccacagaataaggaagacatcatttctcccattttacagcttcagaaatgtggttcagtaaaagcagctagacacaccaaacaatacataccattttattccatacaaatatagtttttaaagagggggtgcaacatcaaattttaatgttagaattcaagagagtggctaatctggagaggagagaggactagagattggaggggcccaagaggagattttgaggggctggcaattgtccatgtcttggcttgggtggtggcaacacagacttgtttggtgataacacttcgaggtatgcattgatattttgtgcgctttttgcaagtgtgctgtattttgactaaaatgtttacaaaaatgaggcttggaaggagtaaataacctgttcaagttcacgctggaaacctccagaagagtatgtattcatactcatgttcctcagactgggcaccaaaatctacagtctttgccaagctctgctatcttgaaagtgggtgaataaacaaatgcatctcctgcatcaacagtagcctaagctttggtctagaaaacttctctctggggtcagaaagaaatcttttaaagcaagactttaaaattaaaactaataaaggccaattataatattaaagattctaccacctttatatttttctcttacaaaatgtgttttctctggtggtttcttcttttggctagggaggtttctaacctcagttttaaatttcatagagttttcttggcaaatcagtgactacagatcaatttaatgagtgatttctcaaaggaaagttcaaatttcatctagaactgctattctgaagtagcatacgctgcctgggtatttgtcagcattatttttattcttattatttatcccaattatgattaagatatattttctacttattgtctgtctttcctaaattagatcataaactccaaaagggcaaggaccaagcttttttattttacagtatataacccatgcctacaataagctcaaagctgaggttttaggtgaatgaatggatacttaagttaatgagttaattaacagagaggtaacagaagaaccagagcttaaaaactatgagacattttggtaagtggcagaaatgtgttactgaagtgaaggcaacaatctcagtatcattgctgttttttacttgtggttcctcattctgtttcatttccctagataactggttgggacagcaagcattcactgagaagtaactaatttctaggctctgtcaaaaggccaggaagaatctacaatccccgtggttgaggaactcacagagaaatttccagttgtattctgagctgatgtgaattattataaataacaagtttcaagcagagccttaggtgtgactcctgtccttgactgattttcataaatcacaatctgtatatgaataatagatattttcattaaccacagggtttcaaataaatcaccttttgctttccaaagattctgcttaggtgtctagttctatttcagcaatcagaagaattttctaaatctgaccttttctgactcttttctgttatatgggacaataaaagttgagatcagtctgtatttctctgcctcattttaattttctttgtataatataatgtgcaccatatttagcttgtggttgtttttaatttagtacagtaagccagtatctgaacagaatctcattgttatctacattctgttgttcctaatcttatcatgccctagttctctaactcactcactctcccccatctgacttctagcttctcccagaatagctacagtgtcatgctctcaaattatccttttttttatttattttttttaaattcacagtaaaagcaactcatgggcattttcctttggcacataaaatagttccattggtgcatcagtcagaaggccaaaagattccttgctttcaagaatagcactgaacatatttatggcattttaaactcagtaattattgtactttgattttacaacttcaaaaaaggtggtcccagtaataagtaatgtgctaagtttaaattagaactgttgcattttatccccccctttttgaacaaaaatgattttgaagaccaaatcacagatttcagtgtagtcaggaagtactaaaattttataacaatcaagtgacacagagaaaagagtcattagttttgtgactgtattttaaaaagaagacatcaaaaacctcttctgcatttattgagacaaccatgtggtttttgtctttagttctgtttatgtgaggaatcacatttattgatttgtgtatgttgaaccaaccttgcatcccagggataaggcctacttgatcgttgtggataagctttttgatatgctgctggattctatttgccagtattttgttgagggtttttgcatcattgttcaatatcctatgaggccaaggatattggcctgaggttttcttttttcattgtatctctgccaggttttggtatcaggatgatgctggactcataaagtgggttgcggacaagtctgtcctcctcattttcttaggatagtaccagtaggaatggcaacaaaagcaaaaattgacaaatgggatctctttaaactaaagagcttctatacggtaaacaaaactatcaacagagtaaacagacgctacagaatgggagaaaacttttgaaaactatgcatctgacaaaggtctaatatccagcatctaaaaaaacaaacaaatttacaaaaaaaaaaaaccacaaagaaacaaccccattaagaagtgggcaaatagcatgaacagataatttccaaaagacgacatacatgtggccaacaagcatatgaaaaaaagctcaacattactgattagagaaatgcaaatcaaaaccacaatgagataccatctcacaccagtcagaatggctattattaaaaaatcaagaaataacaggtgctggcaaggttacagagaaaagggagcactgttacaccattggtgggagtgtaaattcattcaaccattgtggaaagcagtgtggcaattcctcaaagacttagaaacagaattaccatttgaccagcattccattactgggtatttatccaaaggaatataaatcattccatcataaagacacatgcatgcttatgttcattgcagtgctattcacaaaagcaaagatgtggaatcaacttaaatgcccataaatggtcgactagataaataaaatgtggtacatatacaccatggaatactatgcagccataaaaaagaatgagatcatattctttgtagaaacatggatggagctggaggccattatccttagcaaactaacaaaggaatagaaaaccaaacaccgcgtgttctcacttataagtgggagctaaatgatgagaacaaatggacatatagaggggaacaccacacattggggtttattggagggtgggaggagggaaaggatcaggaaaaatatcttatgggtactcagcttaatacctgggtgataaaataatctgtacaacaaatctccacatcaaaggtttaccatataacaaacctgcacatgtatccctgaacttcaaataagagtttaaaaatgatattttaaaagtttaaatgtaaatccctgtccaagttcagaagatttaaatttaatatacttaatatataaatgaaatgtttgtaattgtgaacttagaattgggtaacaaagcaaaaacaaaacacaacaaaaacaataacagaaaagaagcagttttcccttgtgaaattcttctggaacttctggaactctaatgaggaaatgctaccttttcttttaaaactgtggttttctcacaaatttcattctaatgctattcaactctaccaaatgtggaacattttaattctgcataattccagtttcttagagacgactctaaagtcccagttccttggggacagtcagtgctaagaaagatcagagaacagaggaatccctgtgggcaggaggggagggaaggttggaaagattttgtgaaaaagggaaatcttgactgggacttgagtgggttgaatttggatggtaagacataaactctaaatatgtttttttttaaattttttaaaaatataagcagaaaaagcccatgcatacagtgagagataaagttagatacattttctgatccaaagaaattctgtgtttactttgtgaacttatactacagatagttgcataaaataatatgaatcaccatgtcactttatgcaagtacacaaagaacttttcatgtctattagcattctcaaagtgtgtcccatggaacacataagatgttaatagatgatctctgaataaagggcttctgtgatcaaattatttgggacccctctcctctgagtaaaacaagactcaacaatttctttttagccttccataattcttagcatcattatgatgtgaatatttattgagaaactctaagagggtgatttatatagggttttgaaaatttaccttatcataaaacctttctcttgggatatttcaagggtttaatggtccccacaatacactgtggataaagctaattcatactatctcatgtgacctccatagaaacgaagctggaattattatctccattttatagatgagaattgtgagactgatatgtcctttagggccctgctcaagtcacatctcttttatgaaatttctccaggccatccaagtcctgggtccttgcattcattttaataatggtcatatttactctttatcctttttccataagaaattgcattgcttacctctttccctgagtatcctgtcttctcactaaggtgctctttaagaactagtattgtgtattgcatactatgcaaccctcattgagccatataataggtatacaatgtgcttatattgataaattaagggcttctttacagaaagcaaaaacacttaaagattaatgtcactcaagatatgtccctacaatgggcagggctctgtgttggtttttcatcccattttggcaatgaataggtactgaagactctcccggaacagactgcatcaaatggtgattgttatacactcaagtggattccttccttcctttatcatgcaatcagtgcagattctcagttcatatctgtccctggagtcttactccaccagcttgtatgaatctgagagcccctcttatgctgggattcagttctattccaagggttcatattgcacattgtattgctccagatcactctgacttttaaaagtgatccaggtcaccagtgtagcaaatattaaatactgtctgtgaaattgttgtactggcttcagagaaaaggagaagaaaatgaacattgtgggatggttttttttgtgtttatgtgtcggggctgtgataagttcttcgcatatattttctcatttgatgcttacaacaattatataaggtagatagtattctattttatagataaacggtgttgggaaaactggctagccatatgcagaaagctgaaactggacccctcccttacaccttatacaaaaatcaactcaagatggattaaagacttaaacataagacctaaaaccataaaaatcctagaagaaaatctaggcaataccattcaggacataggcatgagcaaagacttcatgtctaaaacactaagagcaatggcaacaaaagccaaaattgacaaataggatctaaataaactaaagagcttctgcacagcaaaagaaactatcatcggactgatgaggcaatctacagaatgggggaaaatttttgcaatctatccatctgacaaaggactaatatccagaatctaccaactatcattctcagcaaacaattacaagaacagaaaaccaaacaccgcatgttctcactcataaatgggagttgagcaataagaatacatggacacagggaggggaacatcacacaccagggcctctcagggggtggggggctaggggagggatagcattaggagaaatacctaatgcaggtgacaggttgatgggtacagcaaaccaccatgtcacgtgtacacctacataatgaaactgcacatttgacacaggtaccccagcccttaaagttaaaaataataagacattatgtaaaaactaaggaaatctgaataaaatatgaatgttgttaaataataatgtgttggtcatgaatagccaatactattaatattaattattaataaacaatgttaatgaataagaaatgtaatctcaaagagtttaacttcttaggctttatagtgaaatagttgaatttcatgaattctgcagatagaatattgtgttgaaatctcctgcctcttataaattgtgtgatttaaccactttctgtctcagtttcctcatctgtaaatagcataataatcctacacacctgcaggattgttgtgaagactgaatgattttatatatatatatatatatatatacacacacacactaagaaattatataattatgtgtatgttatatatatatttaagaatagtgcttgatacatactgaatggtaactcttattaccactactatcattactattcccaggtcatacagtcagtatgtggtaaagcttagatttgaaaccaggtctataggtctcgacactatacagcaaaatcagtatccatgtggacagtgacaaaagcagggtatcaattaaagaggaatcataagcagcagaaagaacaagaactttatcatcagacagagttgtgtctgaatcccaatgcaacaaattatttactgtataacttgtataaattagctaacctctccaaacctcaatttttttgtttatatggggatgttagaacctctacttcaaggttatgaattttagagttaatgtatgtaaaatattcccaccagagtgactctaacaaaatgaaaacctttataatgaaaataaatgatgccccttagggtcattctgacaaggaggttgggtaaatcaagaggattttccattagaccgcacctgcatcagagtccctttaaagtcattcaaaaacaaaaagcaaattaagactaattcctcaattaaatccgtacaaaggttgtcagtcactccttctggaaccctgtgctcatttattatcattcaagatattccaaggacagacttggtacagcgatgggccttccgtggggagtagctattttcctaatgttgtttttatctactgtcttctttcctgctactctcctctctgtggtggtttctttttctttctggagcttcacatcaatgtcctgaataacatttgcccattatcttgtgtttcaactatatttactgcaataaactgtaaaagactgaagttgaaatgaaagctggtgatgaggccaaagtgaatgcttctaagcagggaagcttctctgtgcgttgtgttgaccactgacctaataaccagctggaaagaagactggcacttgggaaacatcattttcatcctcattaaccttgctgagtggtctccccaaaagagaatgtttgaagaatggcttatcacctatacattttttcatttgaaagatacaggtccatgatatgacattcagaatgaacaagtaaaaaacccaaactgaaagaaaatagaaaattttttgcctaactcgtctggcaaccaatccaagcctaaactggtgtaaagctatttagatttcttatcccactcgctgttatacacaattaatgctgtgtatgattatgggatgctgccttagactctactagggtgctatgtaatgtatgttacatctgttgtatcacttttctaaaatctgaaaaacactgaattataaaatgccgactgtaaaggattatggatctgtataataaaaaatccaaagttttgtatacttaaccactggtttcttttccccttctactgagtaatcttcaccctgccctcacactgagctaacctataagacactttctgctccctcagccactcgcagcatattgaaatagctgacacccatcaacataaacgtttttttcttgccctttttaatgcctttcatttatccccttggtgatccttattttttcactgctcaggtagctaggctctctattcaccgctaggaacactctctacccactaccccatcaaaacttgttgagaacaatggcatgaaaaatggcacccgaatccctattagggatgaattgtctttcaggggggaaatgaattcttgtgaagaagaaagtgagaagccctaaaaatatgagtattagtaaaaactcaagaaagaaaataagaaagttaagctgtgctctatgaaaaaatgagataaatttgtattttggttcttaggaaccaaagaaccccattctagagggaagaatggggaacatataggactgagaagaggtaaggaaccatttgggaagtagattgtactggggacacttccagtgaaatattacaaagacctaaagcaaatatacaaatggacaataagcacaggaaacaatgctcaatatcattagtcattagggaagtgcaaatcaaaaccacaatgagatacaacttcacaccaaccaggatgactgtaatgaaaaagataacactaacaatagatggtgaggatatggagacactgcaaccttcaaacactgttagtgggaatacataatggtttagctgctttggagaacagtctagcagttcctcaaaatgttaaccagagttatatgacctggcaattcttttccgaggcatatatctaaaagaactgaaaacatattttcatgtctaaacttgtacatagatattcatagccgcatcattcataataaaaaatgcaaactatccaaatgtctgtcacttgatatggtatacaatacaacgaaatattattcagccataaaaaggaatacaattgtgattcatcctgcaacatggatgagccttgaaaacattatgctaagtgaaacattatgctaagtgaaagagcgtaatgttttcaagattcatctatgttgtcagataaatcacaattttatacacaaaaggccacatagagtaagactccacttacattaaatgttcacaataggcaaatctagatatagaaagtagattagtgtttgccagggactgggatgagcggaaatggggaatgactgctaatgggtaaagagtttctttttgaaagaatgaaagtgttctggaattcgagagtgatgagggatgcacaacttgtagtctactaaaatccactaaattatacaccctagaaactttatggtatgtaaattataactcaaaaaagttcttcttttactttaaaaaaaggagtaacagtgcttcaggacttttttaagatcttgaataagtcttcggacttgaatcagtgtagatgttacttttctatgtctcagtggacaaagagaatccaggctggtaatacttgtaaggctttgttcagtaagaattattcaggttagtgcccactttgatccaccaatatttattattttctggggatgttggtatatctaaaggatcagaagcatggattgacattacccacaatttctgccttcccatgttctgactttggaatctaacccctacataagacacaccttattattcatatatgatatctgtataatgcctttgacttttaaggcattgtgacactcatactttcaacaattattaatatttccaatataaagatgaaacaggtgagacaaaataagattttaagtgacacagataggaggcaggccctggaatttgtttctgctgaattgtagtcctgtcctctttaatgcttaccatgtacaatcatttattccactgactttcttatcacaataattacaggttgtgggtggttaatattagtaggggactctttttatcagtctacattatcatactgacaaggccactgcttatcctgcttcctttagctgagctagcctgaatttaagaagctctcattcacttgtgactgcatttaatttctagtaaaaatgactcatgtaagtatattaattcttatgaagtcttcctattggtttgtatatgagatttcaaatcttatcaactataccaatataggaaagttaggccattaatatcctacactttatgagacatttgcttttttttctgagtttgtctaggtatctaaatcattctcactaaacccaaatgtacagcatccttaagttaaaaaatgaaaaagatgactcatgggagctgattgttaggatctcttcccaactccatgttgtggcatcatgtcagtagtatcaaatcagctatttactccaaagaaattggcaaatgctacaaatcatcatcttcattccctcctctgacctggctattaaacatcactcacctagaactttcattggaaagaaataaaaaattcacactaacatcaatggaaagggactaaaaattataacaaagattatacaaaatacatttttaataaagttctgcaaatcacacagcatagaatttgtcagtttcaaaggcatgatacaacttcttaccaacagacagagggtattctaaagcaatggatgtctaaaaggacaatcttcctaataaattaaatgagttgctatttataaaatgcctgcacatagttaattgtagtatatgtatgcactacataaatgaaaaggaattatacttacaaatgttattaactacctactaactaaagaaaccaacaggctaatcctgaaaagtaattcagtcattatagtttgaaggaattctttctctttgtatagcgtagtaaacttactgaagcattatacctgcttttttttcccttgatacaacagtttccagatataaatgagaaaggtattttgtttttaaacagaggagaaatgtgtttaaataatttacgtggccgggcgcggtggttcacgcctgtaataccaacacgttggcaggtcaaggcggggggatcacgaggtcaggagatcgagaccagcctggctaacacggtgaaaccccatctctactaaaaataccaaaaattagccgcgcgtggtggcgggctcctgtagtaccagctactcgggaggctgaggcaggagaatggtgtgaacccgggaggcggagcttgcagggagccgagagcgcgccactgcactccagcctgggcgacagagcgagactccgtctcaaaacaaacaaacaaacaaacaaacaaacaaatacaaaaaattagctgggcgtggtggcacatgcctgtagtcctagctactcaggaggatgaggcgggagaatcgctagaacccaggaggcggggtttgcagtgagccgagatcacacgactgcactccagtctgggtgacagagtgagactccatctcaaaaataataataataataaataaaataacttattcaaggacaaaatttaagtaatttacacaaaattggagttatttacacaaagacaacaattcaatattgattacagttccacaggagtgatggaacatcaattttttttttttttttttttgaggtagagtcttgctctgtcacgcccaggctggagtgcagtggcgtgatcttggctcactgcaacctccaactcctggctttaagccatcctccttcctcagtctcccaagtagctgggattacaggtgcccatcaccacatctggctaattttttgtatttttagtggagacaaggtttcagcatgttggcaaggctagtcttgaactcctgacctcaggtgatctgccatctcagactttcaatgtgccgggattttaggtgtgagccaccgcaccccgcctggaacatcagtttctttgggaagctaaagacaattttaatgaaggagttgttgaacggagtcattttatagtatcatgttagtcctatcttcaaattatatctttaagagtaaaaaaataaaaggctaatataggattcttcaaaggaaaaggagcttgttacttgtaccacagccatttcaaggaaatacgtagtggaaaatcattttgaccatctctaatgttgtgaagacctccatgtgactcttgaaaacaaatataatactgcctagggctggcttcaagtcacactatattttattcatatcagtagaaaaatagatgtttatatgtacagttacctaacactctgtagccacaatttctgaagaagtttcttaattagttgcaatggataaaatccatgcaagcccttaaaccttgggaacctctcagggaaacctctattaactcaccacttgctagaaggcagctacagctcaaaggttaaagatttgcattctgaggtgttagagtcacctaggggctcaccccagctagcccttgtcctatcttggccagccttcctctcagtaggcagcatggtattatggaaggaacatactcgttggaaccagataaggtggaataaaatgtcaagtctgtcatctattagctgtgcaaacttcggcacattacctaactcctcaaagcccaggtccctcatctgtaagaaggtggataatatgctccttgaatggctgctgtgagaattcaattaatttacccaaagcgtcaagcatagtggatacggcacattttaattccccttctttctatccttcctcccccagcccctatctccattcccagcatgagagaattcatgggtaatctcatttaattacatctagcacgtattttcagtgcaatcacttagtgcaaatgagtctcttcccagtgtggtgaagattatccatggtgagattccctggacagtacggggaaggagaacacagatatgctctcattcctggtgcagaacaactcagcatgacacatgggtcaagaaggagcaaggtggattgagcatcctctcatgagccaaaacctcaggaaatgaaggatttattcactgtgaaggaaaacagaacagggaaactcaacttctcctaccagaaggtcacacagctagtgatttttttactccattcaacaacatccacacatggaaggtgagtgttccctggacaccaggctactaggcagaatgtccaaagcatatgccggagtaaagagatgcaaaagaatcctagcccatctcaactataacgtctagacagtagaggtgttcttaaagtgtgggccccagcccagatctactgaatacatggttcccagaaatttttatgtacactacaatttaagaacgtattctaagtgtttatgtctttaaaatggcagtatgatgcagtggttaaaggcctggaatctgagagccagaccgcctacaggaaatgcctggctccccatttcagtagctgtgcaatctcgggcagggttaacatctctatgcctcaatcccctcatctgttaaaatgtgcaaaataatagtccctatctcactgaattattgagaaggttaaatgaaataatttaccagcaaactgacgtctagtgactgcctcaaaagtggtagttattaatggagtccttgcctgagaacaaaggacaccaggtgctgccactgatggacagtgggcaggtttctgaatgaccccttcgagtctccatttcctcatttgtgaatcaccacagtgctattcctctctcattctggggattttatttttaggagagaaagacacagcagaactttatgaagggtaaaaaatatttaagaaacatatgtgatacaaagactataaactatgtttttgccatatgttggtggggaaaggggtgcatcagtctgaactgtttttatttatttatttttttttttgagatggagtcttgctctgtcacccaggctggagtgcagtggcacgatctcggctcactgccacctccgcctcgcgggttcaagtgattctcctgcctcagcctcccaagtagctgggactacaggctcgcgccaccatgcccggctaattttttgtatttttagtagagacggggtttcaccgtgttagccaggatgggctccatctcctgacctcgtgatcccccggcattggcctcccaaagtgctgggattacaggcgtgagccaccacgcctggcccagtctgaactgttctttacccacaccacttctgacaccaaataagtggtttttgtcccacaccaaccaattctccaactctctggataccaactgggcatcctgtaattcctttcgattctgacactatctgaagttagcacagaccccacacattaagggctcagtcccacaagacttcctccatttcagacaccaacagtcagtctgggtcagttttatttctgagtgaccagctgtaaagttgggaactctcacagcttcttccttaggttcaataatttgccagaacagctcatggaactcaggaaggcaccttacttcttattgctggtttgttagaaagaacacaactcaggaacagccagatggaagtgatgtatagggcaaggtacgtgggaagtggcacaaagcttccatgcactttcgaggtgtgccaccctcctggcactttgttgtatttaccaacccagaagctctctgaatctcatttttaggggctttatgaaagcatgattggttaaatcattaggtgtttgtaattaacttaatctccagcccctttcccctccccagaggttgaggagtggggctgaaagtcccaactctctaatcatgcctcggtccttctggtgaccagctcctatcctgaagctacctaggggccctctaacagtggcctcattaggacgagagatgctcctgtcatccaggaaattccaagggttttagaagctttgtgttaggaaccaggaacacctgccaaatacgtatttcttataattacatctagccactgctagctgtagcgcagctatgactaacctgcatatacaaaatgaaaaatgttttgatgcttcttagggccattgactgcttatatatttatgtccagtgagcaaagcacatgcaattcagccagttaagtgtaagaaaaaccagcccatgactactccacttgcctttaatacagtatattttactcttttccagtcagctaacataactcagaaaaatctcctaggggtttttttctcttctcaaaacttacgctctttctcttccagcaacaatcctaattatttagtgcatccacaacagagatgcttttagtgcttcagagatatcatccattgaagttatttccgatgctttcatttgccacataaatttctgaaacactgcctccatgaggaaatgtactgttgttcccgtcatggggtaagacatttcgcttggtgttaatgtgccgtcggcataatttaaattgtttcataaaacaccaatgtatgaaatggaaacacatttgttttgttggcagatggctgttttatgtggggaagtgggtctcatggctacacactcactgatgccctgccagtgtcttcaacaaaaagcatcgagcttagacaccacctgtattacaggaaaatgagcaaaatcacttcaaactattcacactgatacttttcccacaaatgttagagagaagcatgctaaaaagagattttatttgtttcccagggaagaaaggaaatcagaagattgagtgttactgccctggaagacatcttgagatgagtcatctcaaggaaacacttttctagggcaggaactaattttcaacaactacaactactttcagggttcatttgtgtactgcttcgtgatcctagtgacaggtcaatttatatacaaagtccccgttgggctaaaatgatttgtcttttccagcccataccttttgattggttctccttatcccgttacaactctccatttgccattccattgcccgttaacctacagacctggccagacatggggcgcggagatttcattcattcatttatcagatatttattgtttgcctatatgtgacacagacatgggaaaagtggatgattcactcatgctaagtacaaaggtgaatataatgcattgttagatttctaattttcatttgtcattctactgcattagaggaggcagaggggaacatgaaggggggatccaactgtatacataaaaggaaaacacgcagaagtcatttgtcacccccaaattaaaagaaacagcagaatttactggtatttattagatacttgccatacataaatactgtgctccttggtgtaagtaatttaaattgacaatccttgccttgtgggagttttattctaacataagtgacctaaattcaaccaacactcttcacaactgcagccaccccctacccacacaaactgtcatagtctgctcaaggctgccataataaaatatcaaagattgggtggcttaaataacagaaatttattttctcacagttctggaggctgaaaagtccaagatcgaagttctggtagggttttgtttctcatgggggcttctctcctttggcttgcagatgccaccttctcactgtgtcctcacttggtggggagggggagaggaaggggtagggacacagtcctatgggattagggccccatgcttatgcttatgacctcattagccttaatgatctcgtaaagaccctatttccagctggccacattagggtctagggcttcaacacatggattttggcaggacccaatcagtccacagcatgtgtggccatgcatgtgcgtgcacacacacacacacacacacacacacacggagtacactaagccaagagctaatgctgtggtgggagccctggttatgaaatatttacattgaggataacctgagtcaggcgttgtggtgccaaccgtctgctaccaggaggagagatcagcaacacctcttttcatttagctagaaaaggctgtctagaggaattgggatttccagagatctttgcagggcaaaaaagaaagatctgagtgacagcagataggatgggaggagcagagggagcagcagcatgatcacagtcagaagggggaaagagagagagagagagagaggcgaaggaggccagctgggagggttcttgttttccttttgcttttctcagatggtttctgaagtggttttcctttgtgttcctgacatagtaagctaatcagtgttgtctgtgtgtaggtgttcattttccctacttctgctcacttctggaggctgctccccggggttctgaggcatctgcttcttgttcttattttgctccagtctctacccaatctgactgatttactcattcttctgtactcctcctgtttccatctcttttacttaccacccctaatttattcactcagtagcaccctggcccctgccaacacatactgtctttaactactttaccttgaacttctctctgaaaataggacagaggtgatcaactgaaacattctttaaatgtgggaacccagtctttgggtgctttgtgctgttttcgcctcatcttccaagcttgttttgccctatagacaggcatactgttattgactcttctccccacctttccatcctctcctatgttttaggacctgaaaagtgtattatatttatttaaggaattgaaagcaattccgatacatatgtacacatgcatgtgagtatgcatacacactcacacaaacatacaagaacgtgttttcttgggtgatggggaagctcgagtcacattaaagtgattgatttttaaattaccatgagctttgattcatttatagcctgtgtcaattcttcattcccccatccccacagacctgctcacttctagtgacaaagctgacaatgtgatttggtccagagcttcagaggtcttgattttagagccataatatatgaaaactgttctgttgatttcttctgcagttttatagcgtagaagagcttgaaaatagagtaaaagcatcattagtgcgatccctttgatttaggcctgcagaaaatttcctaataaattatgaatatgatgtctggaagcacatgattagctcattagcaaagattgttttcttgcctcagctggaaaggagatagaagacatgtcatcttgaaaaggtgggagtgtcaggcaaggtctgagtgtgaaaggagacatttgcagaatgaattgggaagtgcctaaatatttgctgacatcacaatgttgcctgaggaggtactgggttttagtcctggctccatcactttaggcaccttcagcaagtcatcagtctctctgcatcttggttttcttgactgcaatatgatgataataataggtcctaaattatatgggtattgggaggatgaaatgaggtaatgtaggcaaacatttggcagagtctggctcgttgtaagtactcaattaatgctaataactattatcatgcaaggatgataacatcttttcccccatttcattttgaagctcctccttctaagacacacataatagaaagttcaagaaagcaatagaaaaaaaccttagacccttaggaaatattatctttgtattatccccaaacaaattggactccatccaataaaacactaacagtgttcttaggaggtttataaaatgttctcgagcagatggattctaaagtgccttgatatactggtgtaactcaagcaaaccttacaaagtttcctgacatttctcaaaccttgaaacactgggcctatgtcatcacctaaatctcacccaacttcactcctgggttctccctatctactctccaaaaccaatttcacctcattacaaatattttcttttccttctcagtctcagctggcttatttctccaagtcagttataatgtacaacctcacattcttgggtcaatttactgatatcgtataacaataaattcactatgtaaatctcaaaggggctttcagttctgcctggtaatctttccaccacttccctggtacactacctctcctaatttctatagtgactatttgaaacatcgccaatctcacatcagaaaaccaaagctttttaaagggaccctcttgaaaatgacaaatccactgacctagacaacagtcttcatcttcttctctcctggtagattaaaatagctgttccttctattatctaagatttcagtccctctcctccagtctcctcaagaacctgaggtaggttacccactttcttctcctatgaatcatctaacacctttcaaatggatccttcctgtcaacgtttaaatatgtgcagaccttagtcacctttaagtatgtctctctcatcttcacatcctagtttatcttccagcacatattcatcctcctctcttcaaagacaaacttgttgaaagttctctcattattttgttgtttttgttgagatggagtttccctctgtcacccaggctggagtgcagtggcccaatctcagctcactgcaaccttcactttccagcttcaagtggttcttgtgcctcagcctcctgagtagctgggattacaggtgcccgccaccacacctggctaatttttctatttttagtaaagatggggtttcgccatgttggccaggctggtctcaaactcctgacctcgtgttccacctgcctcggcctcccaaagtgctgggactataggggtgagccaccacacctggccaagttctctaaattttaagtctttctttcctgacccttcatcctactcaaccccgtgagtctgtaatctgtgccatcatggtagcatttgtctaggtaaccacagacctccatattgccaaatccaccgaactctccaccacattagacactgtaaatcacttccttctacaacctctcttctcttgatgttcatggccccactgctctagtttttttcctatcacccccatcatacttcacactcttttgtaggttgatgctgctcttccaagccattaaatacaggagcttctccaggatcagttctaatacctcatatattctcactttttactactttatccactctttactgcttagacccttcaaatcaatatatccaagtgcctaccagatatacagacttagatacttcaaaggcatcaaactcattctattcaagatcaatttttctcttgtgccagcattttctctctctttactagacacctctgtggaaataaacagagcatgcaaagaagaataggaaaaggccactgattcagagcgtgctagagcaagggagtcagccaccatcacttgtgtctggcagagacttgtgggcaggcagaggaaggagaaagctttaccataaaaaacagaaaggctttagaggtagcctgattacaggctgttggaatggggaagctgtagacaggatagctagaagtggacaccctgtgttattggttaggggcatatatttgactgttcaaagttgatcctatcttgaaaatgggggaaaaaatagagatgctgccagttattaatcaagtcctggctgtttagagcctattgttacaaagatattgtttggcttcctggactggttgccagagacagtagtttgacttcctggactggttactctacatagcaggttggcttcctggggtggttactgcagattgtgggtcagagttcatttttatcgatggtctggctgtggttcctttgtatattcagtttctcagctccctcagtccagctatgtgagccagaaatggaggaggcactagagcatgctaacaagaatgtgagctctggaatcacactgtgtttatttcacaggtccttcacatattttctgtgtggctttcaacaagctacataaattttaactttagtttacttacaataaacatgagaggaatgaagacttatctgaggcagatacagtcattgcctgctacataacagccactacccctacttgttttctgagagtgttaaaagcattacccattctaaagttctttctgccaatagcctgaaatttaaattaacagaagttctataatttgaaggctggcagtgttgtaataatgcaattatttggttaaatttgtgtaaacacagagggagaggcaggaggttctgctgagaaaacagtgtggcccctggcatcttccaaacactttctcttaatcacaaaattcaaaggaagtgtcttcccataaaacagaatacactgttttatatagttctaactggattcattaaaataaaagctactgggattagcaggtgaaatgggccagtgaccagaaaacagatattctcaaggattatgcacaacaggggagaaagtgatgtaacaacagaagcagaaattggagtgatgtggccaggagacaaggaatgctgtcccactccaatgctggaagaagcaaggaacagattctctcctggagcctccagaaggaacaagccctgctgatgccttcattttagtcactcaagactctttttgtgtttttgactttcaaaattttaagagaacaaattaatgttattttaagccactacatttgtggtaatttgtctagcagcaatagaaaactaatatgtcatccgtattttatttaccttgcagaatatgaggtcattcagagtttcctgaatctttgtcctaggttctagctttttgctgttgggttatctcaaattaaatgcattttaacatgcagatgtgaacaataaccagcagatgatatggagtaccaaagaaacagaacagagaaatggagaaagtaaaagaacatgagatcacaaagaaggcctgattatgcaattattacctatgggggttagggatagctgtactgcagcagaggcaattggagccaatattacacagtccttaagctaaaaatgccagaggtaagcctgagacccagtgccgactaatttaattaagaagatctctgctggaaggtgtctgggaaagaattttcttcttaaagagagatggatgaaggtaagacttttccctccctcccttcttgttgggtatgtttggtgtgaagatatgccatacagatctactgcacctatttgggcaccatgaggaagaggccaacaaaattctagagaaggcaacccagtgctctggcagtattgaggctccaaaccagccctgggtatgtatatttccaagcttcttgttatgcaggaaatgaaatgtctgtatcaaccaagacattttttagttaggtatttattatttgtggccaaaagcattataattaaatgctgtgtttcttttttaaataaaagttgtcttctaaattcatctaaagtacttgttgctaatctcagttcaacagacaagtgatttctgagacctgactttgtgccagcactgtgctgggcccttttgggaggtataaaaatgaaccagatataatctctgcactcatgcaatctatgatttaacaagggaagggaaacatattacaggcagaatataataaatcttttataaaaagactaacaaagccatgagttggagcgagaatgaggcactgggtggagtacactcaataccctggtataccaaggacaggatggagggagaatatttaaaacaaaaataaagtcaacaaaaattcagtctgctttttattattatcacactctggcagttctaaacaaagttaatgataaaatattccttccaggaaaatatactttgtgggtctaacttctagacaattctgtggttgctgttgggttttaaggatatacatgtatgtggccaggcactgtggctcatgcttgtaataccagcattttgggaggccaaggcaggaggatcccttgaggctaggagtttggagctagcctgggcaagacccccatctttaccaaaaaaaattaaaattaaataaaattagccaggcatggtggtgcaagactgctgccctagctactggggaggctgaggcaggaagatcacttgaatccagaagttcaaggctgcactgagctatggtagtgccactgcacttcacctgggcaacagaggaacaccttgtctctaaaattaataataatatacatatactttaacttcatacatctttattacttatactttaataaatatgcaaacttggttgcatgtaatcatttcaagaacaagtttataataattcagaattgtatgatgctttgagatatttccccttgaatcatctaagtcaagcagacagttcccatgtgaggtggatattattatctccatttcacagacaaggaaacaaagacccagagacctatggggactggcttttggtagttaaattagtaagtgaattagccagttttggaaacagagctatttttcccctaccatattaatctacctctttagcatttgtgatttccccaaaatatatgtgagtaaaatgtgaatgtgcaaaaacagatgtataatctagtggagcctctttagatctctggtatcagaaaggattaacacctcagaggaggacacggtatatcagtcttttattatcatagtcatccctcaaggagtatcgtttaaccaaaagtggatcagtgtcttctgatagaactttctaggtgatggaaattttccatatctgtgctgtatctgtccaatatggtagctttcagtcatgggtgacttttgagtacttgacatgtatctagtgtgactgagaaactgagtttttcattttacttgattttaattaatttacatttacatttaaagtaaacatattcagcagtataggaatgcgtaatgtattatttatctcttccagaaagttctacagtggaactctatcatatgtgcattaaactgaattgaaatcatacgactcagcaaaatcaacataacaactgatgacaacaaaaacagccatataaacaaaaactgttgggcattttaaaaatacagaatggctcaaaacttaaatgcttgatctagtgcttaagtgaagagagtaatgtctattctatccctttattcaattttcaaaaacaattttgattttatgtaatttttgtatttcctgctgaattttgaacacaggctctgcgtaagatgcaacttctatgtggtctatttgatgtagatggtaattgaaacatatggagcatttagacaattctgcttcattcttccatttcttatgtctttttcctaaggtctctaaaatctattttattccccaatattccatgaatcaatatgccattacttttaatggcaaaaaccgcaattaattttgcaccaacctaatagaacttgtgaaaacaagttcaaagaggttctttctgtcatttttatcattctgagaatatagtcatatacatactataagatattgttaatctagtaatcgattgactaggagtttccattaagtagtactgctgcacaccagtagaacaatgattaattctctgttggatcctggaatgtctttggaggtttcaaaacttgtaacactgtattaaagtattcatatatttaaaattatttaaaaattttattttatggataattaataaatcatgcatgtcatgtaaataattaaaaacattccaactatagtatacaacagtggttcccaaatgccagaccttggattagtgtactccttataatttattatcattgcacagaaaagtgagaaacataaagagataaaagatggtcttatattctgtaattatgttcctctaaattttttggtgttaaaatatctgttggtaaagtaagcaagcttatgtaagtcactgaaattctttggaatctcttggaaacactgctattgagcaagagttcttaaatttaagatttcttaaatttcttgagatttcaggctgtggtctagtgaatcagagcctagaaatgaacgcaaagcttgccactgattaaaatacatactaatgtttgagaaccacagatacagagctaagcatataggctttgaatccagatactcttaagtttgaaatcttgcctggttgttttctagctgtgtaacctaagaagccttcattgtctcacctgtaaaatggaagggctgttaagagcataaaaacactaatcattgtgaagtttctaacagcaattcgtctagaatagaaacctaagacagttagttccctaccactgcccttaccctgactatgctaggtgagcgtccactgtatactttcatatgtgtattttggtaggcagaattttaagatgggcctccaagattcccagccagtgattattcaatgatgtgaatctaggtactgctgtgaagaaattttgctcatgtaattaaattcctcaaatcagttgatcttaaaatatgattattcttgtgggcctaatctaatcacatgagccccgtaaaagtagagttttctcttgcttgttgcacaagaggatgtcagagagatgctcttggacaggcaactcttgaagaaaggcagcatctgtgttgtaaactgcccctgggcactacatgggaaggacctgagggtggcctctagctgctgagatcagtccctcactgaaagccagcaagacaaaaggatttcctttccacactacttggaaatgaattttacactaatgtgaaagggtttagagggaggcctttcctgagttgagcctccagatgaggatgcaactggctgacttgatttcaactctgtgataccctgagcagaacccaatcatgctgtgccagacttccaacctactgaactgtgagataatagatgggcattgtcttaagtttctaagtctgtgataacttgttatgtggtgataggacacatacactatatacatatcatggaatcatatgtttatactttaaaaagatgatattctttgaaaaaaaattcctcctgttgtctttttcacaaacacctaagcttatatctataacataaataagaaatgacggttttcattttccaagggacaaatggaaataaaaagagcatatccactattttgacatatcaccaaggactacataaatgtatgcctctttcactccatctcctttagtttgtaataaatcctctacagtgaaacaaccttcctatcttgcccacaggcttagctaaacaatctagaagcaacagcaactgaacttttaacttggtgaaacagcaagccccaaaggtttacaactgtaaacagctttctcccttattactgttgttgacttttcgttttcttagtccttctgtagggtttggggtgggggtaggatggaggttacggtgttggcattttctgcccttctgacctggaccaagatcaaaattttctttgaaaagggaacattaagctttatatgttgttcaaggtaaatcccaatgggtttggagtgtttagattaggaacttgggcattcatcctaattatatcttctaatatacttcaaacaaaaataaatcttgtctctaggctcaattaagttagatataatagaagcatgatgatctcttttacaacctgaagcaactactcatgggaatctctatttccacagaaagcatgtgatcattctcccatgtaaacagtgagaataacacctaacatttattaaacacttccttagccagaccctattgagggcaccttatgtgtgttaatttgtttaactgtcataacatttctctgagaaaggtactgtaaattctaaacttatgccttttgtacaatgaggaaactacagagtatttaaataacttgccccaaatcacatagctaataagtggaggagttcagaacctagaaattccggctttcaagctgtgtatttaatacctattctattctgagacaagatgcactatttctctcaaaatctgctgcatgcaaaatgcagtgttcggtggcagatgcagggccctcgtgtcaaagaatgttgtctctacttggagtggtaaaatgtacaggcatgaaacaacaatacatctaaaaccagtaactgagtccaaacattccctctccttcaccactgttattggcagtaaaaatgaatgagattgcctgctttaaaacttctgcctagagcccagacaattcaataagtcacggtaaaacaaacagtacagtttaagagtttataacaagatagaagctttcagttcaagttatgagataaaaaggtcttgaacggtgattccctagatccctgttcctttatcatatgtgcttggatccaaaacaccctgggtttgaaatgtttgcattaaaatgaaggaaggcaaaattcacttctctcagtcctgggctattttattattatttgttgtttattattactggtgtcaccattttaaactgtgtgtgtgagtgcacacacaggactgcacatacatgtggttaaaaataaacaaaataaaggcataaaatgcacaaaagggatgttccccatccctctggcggaacaaattttagaactactaagttttcttcttgccatgttccaaatgggctttgaaaatacaaccagcacaactgtctcactcctgacataggcttcctgaagcttgcatactcaaagttctgtaaattaaataatatcttaaataaagagggtacctatttatagacacatgtaatgaatcctttctaatataaataactgttgttgcaatgttccattttggaagttaatatgtgttacattgggtttaaaggaactgctcagttgtaggctttctcatctctcacctgaaccagaatgaaatctttctaattgcttgcccttccttcagcctcaaaatatccacctctactctttctcactcccaacttcactcttcatattgcctagagaaggggctcttaacctagattcatggatagaattcagtggtccatgaacttgcataaacattgtctttattttcactaatttattattgaaatttattgtttacatatgttatgaattgagacaacaatccacagtataatattaacagcagttgtgactttgtcaccaaacaaaatcagatgtttttatatctcattatagttgcagcaaatattcccacatatcatttatagtcaccaccattcaaaattacgatagttattagacttgctgctagatcttgttatttagtgtactaataagaagcacatatttgctgtatcataatttttaggaacttgatagctggatttccatgcaattggtctcctttgaaatactatgtgtctgttttttttttttttttttgagtactaataagggatccataggctttcccagagtgttaaagaagtccatggcacagaattaagaaattctgtctagaaagatatttctaaaacaaagtccaccttaagctactcccttaacttaaatttcttcagttgctccaagtccacaccaattagcatccaaatcctttgtggctcatagaaggccttccgtgatctccaagcctccctcagctgcctcatcactggtgtgttcatccttgtactctacattccatctgcttcaaactgtttcaagttcccagatacactgagccatctcagctttcttgtgttctgggcatgctgttccttctgataaaaatgtctttcctcactttactgctggtaaatcctacttatcctttgaggcccagctccaggtagcctccctcttgacactctgtctgacatactgggtctttatgcttttcagactcaggacaatcactcatttctttgctccactccagtacactctgcctgggcacagagtgtcacagttatgcatttacaagttacttcctttaaaagtgagtatgggagctccttgtaccacttgtgctacaatgatgcccagcacattgtggtccttttgtgcatatgggcttgactcttgtctacaactgttaaatgaagaagtaaattttgagttggcctacaagctggtgttctagtcagtgtagggctctctactgtgtaggatgtgggactacctaatttgctttgctgatagcttctttgtgaagcagggcttctacactccaaatattagtgatgaattctcctggtccctctgggtagattaattctgcccccagcccgttcattcagcaaatatttatgagagtctactatgtgctgggtactgtctggggattcagcagtgaatgagccctgttcctgttctcttgaagcttataatgtagagcaacactgtctaacaaaactttctgtggtgatggaaatgatctataatatctgcactgtacaatacagtagctgctagccatatgtgtgtactgagcacatgaaatgtgactagtataacagtagaactgaatttttaattctatttaattttagctaatttaacttaaataaccatatgttggcagtggataccatattgacaaagctattctagagggtgtgtggtagaaatgagtaagtgaataggagtgtgaataaataaatcagaaaacaaccaaaaataaattttaaaaaatcttggatattgaaaagtgccaacacaacagtgatgttgagtcactgaggtgtcgggaaggtattaccttcctttgaggaggtgacatttgggttgacacttgagtatcagaaacattctgcaatgggaagaaatgataggagaactctaggcagagagaacagaaacaagtacaaacccccaagagatttatgtgcttggttgagggacataaagaccaatgtacctggtgtgcagtaagtaaggggttgcggcaggacctgagggcatagaggagctggtaccatattgtaggactctgtaaaccaatgtaaggagtttggattttttccaagtacaatgggaagtcattggagggttttaagtgaggggacatcataattttatctgtatttcataaagctcatgctgatggctgaatgaagaactgactgtggaatggaaaccaggagtctggtcagaatgattacagtacaggtgtgaggtgatggcagttttacattagggtcatggtagtagccgtgtatagaatcgatatgtattctagaagtagagttaacaatattttctaatgggctaactgggagggggtagcaacaaaaagaggaatcaagaacaactcatagaatgggcgctttagcattggatgatcctcctattgactgggataataattggaagaggggcaggctgaaaaatcaaaaggttcagttttggatatgccaagtttaaaataccgattagccatccaaatggaaatgccaagtctggagttctgaataaaggtcagaactggaaatgcagatttgagagttaccaagtcgagatggtctttgacaccaagggggtgcgtgagattatctgtggaaggagcacaggcagaaagaaagcgctccactgcagtgagctgagattgcgcgactgcactctggcctgggcgacagagtgagattccatctcaaaaaaaaaaaaaaaaaaaaagaaagaaagaaagaaagaaagcactccagggggattgaggatgctgaccagcgtttgggtagggtagcaattcccttctgattaagattcctctctcctggggggaaaacaggcaaattgcaagaacctggccatcagagtcccaatgacattcatgtcacagaggcatactgtgattgttgcactgagcaaaatgggtacaactagggagtgagaaaatgaccagttattaacggtcactatgttcacccacaagcactgggagactagtaatagcatctctatttcacagagaacgtatttggaatgtaaataaatagtcatggaggtctgagtcctgattccattctttattggctgtataaccttgaacaagatacctaatctcaaacttcactgataaaataaagctacagagagaatgaactaaatattgtataaaatcccaatacctaacacataaaaaatgcccaaaatatgttagctgttgatacaaaataccttggccagtgttagtaatcccagttgctaggtgacaggcctaggaagcttacccaggtgtatgtaactccaaagcctatgatctttccaccactcactccatgactcctgggcttgaaaactacctgactttgactctattccttatttttcttatatacttctctaaagctccttacaaataatttttaaatttaattcacttttttttttcaaaattggaagttaacctatgtggtttcctgaagctggctctgccttctgctccatggcagggaagtatacacattgatacgtatgcccagagaaattttcccccttcagtatttttccctttctgcctccagaccatcttactctccaggggaacctcaccagcttactcagcatccagggctctccagcaaaatataaatcactgctcttttcaaaacctgccattaaacacgtgcatcagctaaattcctgctgactctgcttttgttgtgcattctatctaataaaccctcagcctctttggatgtcagaaacaaagaaatggcatacagtttatttatccctgctgatcaactggaaacatgaagctggcctgggatggtcacctctaaaactcttttccttgtttcctgcagggcatgttctccatctttctttgtatttgcacagatgattcattggatccatggggatgctcctggatcaacaaccacaagtcacaaaggcaacttttgcaaaaatcagagcatgtaggtcttcatgattccagccgtgtcttctctctctgggtgtgtctgtgtgtgtgtgtgtgcatgtaatctcatcagcattttcttgccttacactaggctgaaaattagtctacaagtctctacagtataacacgtgggtgctgactagtttttaagatgtcggcatttcctaaggttagaagacctaattaactctctttgaacttcctcatcagggtctcctaaagagctttattcaagaatatgttataatcagcagttcaacaaattttctctagttcaggggagataaaaagtggaagacagatggattacttactgcttttaactcttatctttcctaaaagtgtgcatgttaggtgattacttttaaaaaaattctcaccattttgatttccaaacccaaacacactggatctattttttttttaactgcgttatgttttggcatttgtcatccctgcacatctagagtccttgtaacaattagggaaggtatctggtgagactttttgacattttttctcccattaggctgtggcacaatctagtaaagaagagtgagatgttgcttgcctcgtcattcgtcacaccagaacaagagccatttgttttaattagctatgtcagaggttcctagcatctttccagacgtatgggcaagatgacacataaactcagcatgccaggctcttaaaaaataattgctcaaaataaagccatgcaaaacccagttgctgtctgacccatacatacagagtcacacaaatgcttatttacttaactgtcccgtcttggtgtctcaactttggtccctaattgccatttctgacaattctagaaagaaactttaatcttgtcacttttccctctataattccctggagccttaggctttatgtgtctctttatactgtaatgtggaatgcatttttgaaattggcttgggtttattttccccagtggactgagaacagctgaagggcaattactgtgtcttactccttttataatcacagaatctagagttctacacattgaaggtactatgtggttgaaataataaaaggtctttcttaaccttttcaggctaatgtgaataatcaatgatatcttcatctcagaaaaaccgaacacatatttatagaaccagaattctgcagattatataaaggggttaagaactttgatcttcagacaggggctcattttgctcagtttatctagaggataaaggcataggtggtgaaaggcataggtttaatattgtagctgggtatcatggggaatctgataaagaaacaatctccacttttccctactctacagtgacaccaaggtgtcactatgcccatctctgtccactgctagcaaatccggacagtcaaaccaagtgaacaagacactgaagaacacttgttttgttggcttatgaaggattaagcaagctaggatgctaaaaatatggttccacctcacctttacatcccacagccatggcattcagattatgtgcaaggccaacagtgaatcgttggctaaatcgcaatgttaaagtgcactgatttctcacctttagatcagctccctgtctaatttctattgtactgaatgctctctggtttgagagtttatttgaatttttttcttttcactttaacagtagcttcaagttttcttttttggttttctgtctgcttaaattattcccaaagctttaacatttattatctaggattttaaattaactagaaatgtggattaaaatttcttcagatcttatttggctcctatgaacaggtagatgtggggaacacattttggatcacaggaagttttggaaggtttgccattctgtgtcacaaatgagagcaaacttctaaacaaacatgaatatatccttttaatacgagtttatgactcctgtttcttctgtttaagggcttcttctttgaccaacgtcagtatattctctttaataaatggaatatggtttgttgctcgcatcttgagaagtacctagatggacgatatatttcaatgacagagataaaactgatttataacttcagaaatgcacttcatttttttaaatctctctcctcctacccccttgtcacatttttatacttactatcttaatactttttttttgttttttgagatggagtcttgctctgtcatccaggctggagtgcagtggcacgatgtcagctcactgcaggctccgcctcctgggttcacgctattctgcctcagcctcctgagtagctgggactacaggctcccgccaccacactggggtaattttttgtatttttagtagagacagggtttcaccacgttagccaggatggtctcgaactcctgacctcgtgatctgcctgcctcgccctcccaaagtgctaggattacaggcttgagccaccgcgcccggccctatcttaatacttttttttggtttcctttcaccttttcaaaatatgacttttccagattctttcctaggactaccatcttcatttttgttttcattctagcaaatcagagtagaggaatacctaaactgtgctccttctcctaagatgggagactggcatgttttgcagggcgcctaattgatgtctccacatgatctttgtaggccacactctgtagttaatttcaccagttcctcagcgtacaaggttcctgggtatcaacgttaattataattgactgtggatttctactagaaatttcacctttttttgcatgtttgggagggtgaactgttgtatccttcctgatcttcttgtgtgcctaccttctctgaatccatagtaatatacgaagtttcaacactcctctgatattcacttacatagcatccaataagatcactcaaagcctcacaatagaatgtcccacatcccacagcacacagcccacacagtaacaagaaataccttgtccatatgctttcaagactgttccgattgttctcgggttatgggtgttgctgaggatttctgtttttaattttattctttctttatacacaccatatataatgctctaattgtttatatatatacatatatatacacatatatatatacatatatacatatatacacatatatatacatatatacacatatatacatatatatacacatatatatacatatacacacacacacacacacacacatatatatatatatattttttttagtatttttcttacctgacataacctcttttaccaaattttctttggatcactgtcactattttttaagtaaaaatgttactttctagaacaattttaggtttgcagcaaaatggagaggaaggtacagagatttcccatgtatgtcctgcccccacacatgcctttctattatgaacaccccctgagggaggtgaattttgttacaactgatgaacctatattgatacatcatcataacccaaagtccatagggttcattggtggtggtgtacactctgtgggtttagacaaatctagaatggtatgtgtcaaccattaaagtatcatacagggtagttttactgccttaaaaattgtctgtgcccaacctacttgtcctcctccatcactacttcttagttgttttccagtccgttcttcctttccctctccttcctgctgtttacattattcccatgagagggatgtattatttactcctggaactcggattacagcaccatgaaaatggacgatttcactattgtgatctggaagtcctagaactgcatttacgtttattttgtaataatggtctttatgtcctctttaaacttttactttctcctctcttatcccctgctcactcatcatttttatactttccataatttgtgctgcatccctcctctatacaaggcactgtgatggagggtagacagacttaccaagcatggttctagcaaaccccctatttctgcttagctgataatcactaccttctttaagctccttggttcctttcaattttacctcaagatgagtttctcatttttcttcagttccagttgcctttcatagaagagagcacactgggatgaaagcacacagcaaagatgagtcagattatctggcctaccccctacagggcctcactagaaaagaaagaactgtgaaggctagtaatatactgtctatccatccgaagtagatcataggtgtgcttttaactgaactgatttctccagtctggtgaatggggtggtttctggacatccacaatttcttgttcaacctccttcaggtagtaactcaggccagaatttagcatcattcttagaatttactaggacagggcacagctgtacctgggcctgaacgtgatctgaaataataagcagaattggtggtatcaccttggttggattcagaggaagaaaagaaaccttcatgttttatggaatacagaagggtaaagagttcagtagataccatcataggaaatgaaagactggaaactccagtgtattatttctctgtaacgatgcttccggagagcacttggctaccatgcatagtgtcatggagctggcatactttaattgccattatttttggcaagatggcattttaagtttttgttccctaactgcaggatggataaatacagtatttgactcatatgttgatccaaggttatttttattctccagcacctttcaatgtcacgccagaaaaaggtgcagctctttctgggcagtcctcctacaggccatctaaaatatccacacagggagcattcctacggctttcaggagcatctgaaacaatccacagtgtgtttagcagaagtcagttgggggaaagtgtgctctttttctctgtcttcagcattcaggctgtttttaaagtcagaatgctttgcaaagggaagaactgtgccaagtctttattttcatataatgccataacctagtgttttggggacctcacttatcccaagaaagctgttggggatggcccctgcagagacagctgacccaaattgtgacttctctgagggaagggaaacccctctaggacaaacaggaagcgatctttcagcataatgtatcccattgggaacaagtaaacagtttgcttttcagttcaaagcagtgaattcaagacacattcatcggttttggctcaatgtgactctaaaatcaagtcaaatggaaggactttacaattcagaaccttaagattctatttggctgaacactgaggttgaagtgttgaattccaactcatttttgttattattttttcttcagtcatttccaaaatactgctaagttttggaaataaaataaagtgctaaagtggttttcagatccatggccaggcctctgtggtataaaaataattccccaaggtatggtgttcaatgaaaagtaagtgttaacgtatatataaacaacaaaaatcaatctttcttaagttggggtctggagaaatttagatttcccttttcaatttatttgacttttctctggaagttaatagttaaatttatctagttttattacctttagaactaatgaaacacagttcactggttaaataacataatcatctgccaacataaaggagaaggatcttaccccttacttcattaaccaagacccttcacatagttaacaagaagctggcaatacaatgtacatatgctacttagtctatagagctgacactgaaaagtgaggtggagtcattttctaattttttcattagtatccataaaataaaaatcttcacagaatcaagataaatcacaattacaccattttccagtctattagtcctgccattcccatagaaggaactgatattagtctgataagttttgttcccataaattataatgccagctacataacaaccaaaacaccttttctattagaaaagtctcagaagattacatgcaggatacaaaatgatagtttggcctactaaattcctcagtactaacgaattgtcttcattctcatacaggagagattggtgtagcacttgttcaagtggtagttcatgggtgggtgattaagctaattctgatttttaatgctctttgaacccaaagccagttccaagtagctccagtcctgaggaccagagtctaggctggggcaggtgatgtgtggcccaggaacccttgggtctgcccaaccgtaagcccacatggggctcatgtctataaccaattcagtagtcatatgccttctgatccagtttataaactctgggataactaacaaatataaagatacagaaagagacatacacatgtaccattttccctcaggtttttgcatgtttgttctttctatgaaggtcattttaaacatcttaatgtaacagtgaacctgatagttctggtatctcatggttcgagcaccagaagttacttttcctaccgatccaaatgcattctgcacaagcttgctgaattacctatgcaggccttggtaccacacaatgtctattagggaaaaaagccaggaacaacagagacattgtgaaaaagaaaaccactccttagttttcctcctgtaaaaacattgagtccctagccttgaaaaatgagcctttctgatgtggaatccaaagagaaaatcactgtaactgaagaaacatggtactgttgatacacctgtgtccaaacagctgtttgaatttctaaacctaaagggagcatgagacacatatgtcatctattgtgtggtggtagcaacttggaacttctgtcacttttgtttttgcctttgttgcttagttggcagatgcaaatgtgaaagatatagaggctacacaaaatagttttatataacccaaggaacaaaggaaatgcatttgggatggcaggtgtgccagagaccaggtatttggtcttgtgtgcccccttgtggttgacatgtcaacacagacagaggaactacacttagcaatcaggtaaatgaaagatttgctgcctacctttctagccttgtttcttgctattctgctattgcttccctttctgtactccagccataatggttttcttttagttctcaaatttgccatattctctttttgtttctgctcctatgtccttagaatactctctcaatccatccgttcgcctagttaactcttactcatccttcagagttcacctttgaaatcacttcatcatggaagcataacctgacttcatgtactaggtcactgttgtttacgctgcaagcaatgatcagttgctagaaacacttctttaaatcgaaattggagccagcggttttagcttttgaatcttgaaaataagtatctgtctcaggaaactgtctaatacaagtggccacctttctttttactgagagttctcagaagaaatgaaagaccgagtttaatatgcacaacacaattattttacattgatgatgttcctaaaacttcatccagtatattgatcatttttatcctttgactcttttctccttccactatatacgtctactttctagtaacacccctagactccttttcccctatcatacctatagtatcacaggcattcaattaacatttgattaggataatttattatttttaacattattgaaatcgaaatccaaattctaatgaattataaataagtaaaaggcatagctctaacttaaataatctttatttttctgaatgatttgaatgcaagttgtagataagatgatacttcattcctaaatattaaaatatgtacctcttaagaataagaatattctcccataaaaccacaatgctaacatcgcaaccaagaaatataatattgataagtatgatccaatattcaatccatattcatattttccaaaaaggtttgtaataattgtcattgttattgatgttgggtccaggactctatcaagaattactgtatttgtttagaaagcctctttaagctctttaaatataaaactaatctactggcttttatatttctctttttctggtcatttgttacattgacattttaaaagggtcttcgtttcaggtagttttgtacaatcttacttgtctgattgttgctccaagactagattcagtttaaacattttgaatccttttcccttgccttaaaaaaaaaaaaaaaaaacacttaacagtatatcctgtaaatcactgcatagcagttcaaggatcttttccccattttctgtgtgcctctgtgtatatggcactttattgtgcaaagttcattcagtcattcttctatggatgggcatttgggttgtttccagtattttgttattacaaataatgatgcaataaataattttgtgcatatggtttttttttttttgtacttgttaaggtatatttttggggtaaattactaaaattggggctgctgggacaaagagtaaatgaatatgtatatttattagatattggtaaatccccctccacaaggtggaaccactgtgctttcccatcagcaatgtaggagagtggctgtttctccacaaccttgctaataggatgtgttgttgatcttttgaatttttaccaatctgatacatgggaaatgtatctcagtgtaggttgatttatgcgatgcttatgaataaagttcggtatcgttttattttaaataccatttgcagtcggcaaggtggtggaatgaagagccccccgaaatcactccccccgtaaaaatacagctagaaagtattccggaataagaataccacactgaattcaatagaactcaagggagaagtagagaacgccctgggctcacgaaactgacagaagctgaagccagttagaggagtggtcattttagactgtgccacaccctcctccaagatagaataacatcactcacacagaatttccttagacccatggtttctgaagtggaaggagaaaatatgaggttgacatttgatctttccactagtctactctggtcatgtcccacaagaaccactgggagtaccaggaaggctgaaccatctgggttgaattggggacaaaatgcaggggtgctgattgcagtaactgatgtgcagggtagctgccctatgctctgatcagtggagaggtcacatggataagactggccagagccacagtgctgcaagggggcacaatccactgaaaggctcaaatccctggctgaatttcccacaaagctcaggtgctcctttggagccttcccttgacctggaaacaacccaaaggctggtgattaagtagtggcactaacttaagtctttctcagactgggaaacaagggcagcacaacaattcagttcctgtgcagtgtttacattccaatgctcactgtaagtcttccgcaatccgggaagcaaccgcagaatggcggttaagctccagtgttaagtagtaaaagcctaacaccaccaaaaacaccagcaaaagctggaacaggcaaatgggggaggtctcctcctatatgcaggcatcaatgtaaagatgtaaggattatgaaaacccagagaactatgacatcaccaaaagaaacaaacaaagttttagtaatagagctagaaaaatttaaagatctatgaaatatatgacaaaattcagaatagtcctcttaaagaagtttagggaatcacaagaaaatgtggatagataactaaatgaaattttgaaatatccagaaactagtgagctattttacaaagaaatagaaacaataataataaaaagaaattctagaaataaaggatacaataaatgaactcattagaaagctttaacaacagacttgatcaaacagaggaaagaatgaacaatcttgaagataaaacatatgaaattacctattcaaaggaacaaaaataaaaatgaataaaaaagaagagtaaagaaggcttatgacaattatagaacatcatccatcagaccaacttctacatactaggagttcccaagggagatgagagagaacaaggcttaggaagccaatttgagaaaataatggctgaaaattcaccatatctacagaaaggcaacagcattaagataaaggaagtggccaggcacagtggctcatgcctgtaatccagtacttaggaaggccaggtgggcagatcacctgagtttgggagtttgagaccagcctgaccaacatgaacaaacctcatttctactaaaaatacaaaattagcagggcatggtagggcatgcctgtaatcccagctacttgggaggctgaggaaggagaatcacttgaacctgggaggtggaggttgtggtgagctgagatcgcaccattgtactctagcctgggcaactagagtgaaactccatgtcaaaaaaaaaaacctcataggctcataggttagcaaccaaattcaacccaaataggaattttccgaagcacatcaccatcaaattagcaaaaatcgaagcaaagaaagaatatttaaaaaccagcaagagaaatgaaacatattcaatagagtctcaatatagcattcagcaaacttttcagcagaaaccctgtaggctgagaatgaaatgctatattcaaagtactgagaggaaaaaaaaactgtcaaccaaaaatactgtacccagtaaagctatccttcaaacaaggagaaataaaaagtttcccagacaaacaaaagctgggggtttaatcaacaccagacctgtcttacaaaaaatgttaaatggaattatttaatctaaaagaagaggatacaaatgggtaacacaaaaacatctgaaggaatacaactcactggtaaaagtaagaatacagacaaattcaaaatactgtaatactataattataatatgtaagccacttaaattttaagtatgaagactaacagataaaattattaagacaataataagtacaccaattggttagaagataggcaatataaaatgatgtaacttgaaacatcaaaaagtcaaaatgtgaggaggggacgtggtattaaaatataaaatttgtctttgttacacttcttttgtgaccaaagttaagatggttgcaacttatttaaaataacctgttataatcataagatgtttatagttagccccgcgtgttgccacaaagcaaaaatctgcaattgatacactaaaataagtagcatgagatcaaaaattctactagagaaaatcacttaactacatcagaaaatggtaaaataggaaaaaaagaagaatgaatctacaaaacaccataaagcaagcaacaaaatggcagtagaaaacccgtacttatcaataataaccttgaatgtaaatgaattaaattctctaattaaaagacatagtgtggctgaatggattaaaaaaaaaacaagacccaactatatgttatctaagaaaaactcacttcacctataatgatacacacatattgaaagtgaagggatgaaaaaacacactacatgcaaatggaaacaaacaaacaagcaaaatccccacaggagaagtagctacacttatatctgataaaatggactttaagccgggtatggtggctcacgcctgtaatctcagcactttgggaggccgaggtgggtggatcacctgaggtcaggagtttgaaaccagcctgaccaacatggagaaaccctgtctctactaaaaatacaaaaaattagccgggcgtggtggcgggcacctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaatacaaaattaggtgtggtggcgcatgcctgtaatccatgctactcaggaggctgaggcaagagaatcacttgaacctgggaggcagaagttgcagtgagccgagatagtgccattgcactccagcctaggcaacaagagcgaaactccatctcaaaaaaaaaaaaaaaaaaaaaaaagaaagaaaaaaaagactaagtcaggaacagaaaaaaaaaaaaagaaaaagaaagggccattatataatgacaaaggggttaatatagcaagagaatatacaattataaatacacataaacccaatattgtgacacccaaatatataaagcaaatattaacagacctaaaaggagagattgactataaaacactaacagtgtgggtacttcaccaccctactttcagcaatgaacagattatccagacaaaagagacagacaaacatcacagttaaactacattttagaccaaatgtacctaacagacatttacagtaaattccactcaacagctgaagaacatacatttttccattttttctcaacaacacacggaacattctccaaaaaaactgtatgtaaggtcagaaaataagtcttaacaaacttaaaaaaaaatcaaactcatatcaagaatctttgctgaccacatggaataaaactagaaatcaataacaggaggaatgttagaaagtgttcaaatttatggatataaaacaacatgctcttgaacaatgaagagattactgaagaaatttaatagtaaattaaaaaattccttgggacaaatgacaatggaatacaacagatcaaatacttttgctgtatggaatacagcaaaatgaaaatgaatacaaatgaacacagcaaatgaaaatggaatacaaccgatcaaacacttttgctgtagagtttacagcaataaatgcctatatctaaaaaatagggagataaatacacaacctaatgttatgcctcaaggaagtagaaatgtaagaataaaataaacccaaaattagtagaaggaaagaaataacaaagatcagagcagaaataaacaaaatagatttaaaaagtaatacaaaagaaccccaaaacgaagagtgcattttttgaaaagataaataatatggacaaaaatttagttatactaagaaaataagaaagaagacacaaataaataaaactagagatgaaggagacattacaactgataccacaaaatagaaaggatcataagagactattatgaagagctatacaccaataaaatggaaaatccaaaagaaacttatgaattcttggacacatacaacctaccaagattaaataatgaaaaaatagaaaacgtgaacagaccaataacgagtaacaagaatgaagcagtaatatactcccattaaagaaaagcccagaacctgatggctacaccactgaattctaccaaacatttaaagaagaactatattaatacttctcaaactgttaaaaaaaaaatggaaaatgcttactttctaagtcattctatgaggtcagcattaccctaattccaaaatcaggcaaggacacaacaaaaccataaaactttaggccaatatcccagatgaacatagatgcaaaaatcttcaacaaaatactagcaaactgaattcaacaacacataaaaagatcattcatggccaggcgtggtggctcatgcttgtaattccagcactttgagaggctgaggcaggtggatcacttgagctcaggagttcaagaccaacctggccaacctggtgaaaccctgtctctactaaaaatacaaaaaaattagctgggcatggtgggtggtgcctgtaatccaagctactcaggaggctgaggcaggagaatcacttaaacccaggaggcggaggttgcagtgagccaagatcacgccactgaactcccgcctaggcgacagagtgagactccatctcaaaaaacaacaacaacaacaaaaacctttaccatgtcaattgggattcatcccaaagatgcaaggatggttcaaaatatgcaaatcaataaatgtggtacatcacattaacagaattaattaaaaaatgattatttcaatagaattgtttttattggaaaagcattccataaattcaaaatcctttcatgataaaaactctcagcaaactgagtatagaaggaacatactgtaacacaataaaggccatatataacacacccacagttataaatgggagaaagttgaaagcttcttctctatgatctggaacaagacaagggtatccactttcatcactttttattcaacagagtactgaaagctctagccagagtaattagtcaagagaaaggaataaagggcactcaaaacagaaaggaagaagggcacccaaatcagaaaggaagaagttgaatgatgccaatttgaagatgacatgatcatatatataggaaactctaaaatcttcaccaaaaaactggtataactcataaaaaaattcagtaaagttgcaggctacaaaatcaacataaaaatcattaaaatttctatacaccagtagtgaactatctgaaaaaagtaattaagaaaacaattttatttacaatagctacaaaagatacctatgaataaacaaccaaggaggtgaaagacctctacaataaaaactataaaacactaatggaagaaattaaagaggaggcaattaaatggaaatataccccatgttcatggactggatgaattaatattgttaaaatgttcctattactcacagtgatgtacagatttaatgcagtctctatcaaaatatgaaagacattcttcacagaaatagaaaaaaaataaattcatatggaaatataaaagaacccagagagccaaagcaatcttgaacataattaacaaagcgggaggcatcatattacctttcttccaaatacattacaaagctatagtaagcaaaaaagcatagtactgtcataaaaacagatgcacatagaccaatagaacagaatagagaaccgagaaataaattcatgcatttaaagccaactgatttttgacaaaggtgccaggaacacacattggggaaaagacagtctcttcaataaatgatgctgggaaaattggatatccacatgcagaagaattaaactagacacttatttctcataatatgcaaaaatcaactctacatgtagagaaggcttaaataaaagacctgaaactaggaaagtactagaagcaaaaataggaaaaatgtttcatgaaattggactggtcaaggatttttggagtaagacctcaaaaacataggcaacaaatgcaaaaaagacaaatgcggttacatgaaactaaaagacttctgcacagcaaaggaaatgagtaacagagtgaataaacaacctacagaatgggagaaagaagttgcaaaccatgcatcggacaaggggttaatatccagaatatataagaaactcaaatcagctcaatagcaaacaaacaaacaaaaaaacaaaacaacaacaacaaaaaactccaaataatccatttgaaaaatgcccaaaatacctgactagacatatctgaaaagacgacaacaaatagctaacaggtacatgaaaacaaatgctcaacatcactcatcatcagggaaatgcaaatcacagccataatgagatagcacctcatcccaattagaaaggctgtttttaaaaagacaaaacgtatataataacaaatgctagggagaatgtgaaaaaagaggaactcttatgaactgttggtggggatgtaaattagtacagtcatatggaaaacaatatgagcgttccacaaaaaattaaaaatagaactaccatatgatccagcaatcccattactgagtatgtatccaaaagaaatgaaattggttatgtcaaagagatatctgcactcccatgtttattgcagcactatttgcaatagccaagatatggaatcaacctaagtgcccaacaacagatgactttataaagaaaatgacacacacacacacacacatacacacacacacacacacacacacacacataaatagtattcagccataaaacataataaaatcctgtcatttgtggcatcatgaatgaatctgtaggacattattttaagtgaaataagccaggcacagaaagacaaacactacatgttctcactcatatgtggaatctaaaatacttgatttcatagaagtacagagtagaagagtgcttaccagaggctggggagagtatagaagatggggaatgggagagactggttaacaggtacaaggttacaagtttctggtgttctattacacagtagggtaactatagcaaataacaatgtattatatatttcaagatagctagaagagaagatttttgagtgttattactacaaagaaataaatgtttaaactgatggatatggtaattaccctgatttaaacattacattatacatgcattgaaaaagcacactgtaccccacaaatatgtagttatgccaattataaacaaaaaatcattttttaaattataaaataaataaaagagactacttgcacagtattttctgttaactgtgtttttccccatttttatcaaacttttgttatttcatttcctataatttttaagaagttctttattaggaagattagtcattcatctttgttatatctgcaagtattttctccaaattttaatttgattttgaattgtgtatcatgtttttatgtaagaaattttattttatgcaaaatttataaatttctttacttaattgcatcttgattttaaataataataaaaaggctttacccatataggggtcatacaggaattcatccatggtttttttttttgtttttttgttttttttcagacagtatcttgttcctgttatgcagactagagtgcagtgatgtgatagtggctcactgcagcctagctttccaggttcaagcgatccttccacctcagccgcccgagcaactgggactacaggtgcacaccaccatgcctggctaatttttttatatttttagtagagatagggttttgccatgttgcccaggttggtctcgaattcctgggctcaagcgatctgcccgcattggcctctcaaagtgctgggattacaggcatgagccactgctgctggcctatgttttcttttagtacctgtatgttcctctttttgttttatgcttagatctttgacccatttcaagtttattctggtacatggtatgaggtatggattcaacttcatcattttgcaaataggtattgtgttttcccaacataacttattaaaaaggtcatttttagagattagagatattccaatgattagagataccactttttcagatattacatttccatatacatgtgagtttattttttgatttttttatttcattctttggttcacctgtctgtgtgccagttctgcactgtttcaaatataggagctttatagttgttttttttttttaacatctggcagagttaaccttcccttactgctatctcttttagtattttcccagctattatcagatgtttatttttccatgtgaactttacagccaacttgtttacgtccaggaagaataaaatttaatgtatttattaggaaattatcacatttatatattaatttgctcacctctatttttgtgtcttttgtgaaaagtgctttaaagttttcctcatacagagctggcacatttcatgacgtgaaattttatcatattattccttttaattccttttgttttgtacccatgaaagctaatactttttatatatttattttatattttaatattccactgaaattttttatggtttgtgttggcttctttattgagtctctaagattttttagatattatgttatcagtcaatacagacaattttatttctttccagatttctttagtacatttgctcttgtttgatctcattggctgatacatccaacacaatattaaatgatagtaagatactggccattcttgccttgttcccaatcttaatgtgaatactttgtgtttcttcactgatactggtatttggagacacacatacacagatatagatatgtacacatacacgcatatttgtacagatgctacacatatacacacaggtctatacatgagagagagagatggttatattaagcaaggattcattaattcctattttgttgattttggttttaaatcaggaacgggtggtaaatttcattaaatgcatttttttctttggagataatatgacttttttccttagatttacaactatagtaaattatactggtggatttcctgttactgaaacatccttgcatttccgaaataaatctttcttagtcataagatgttttatgatgtggtgttagattttatttattatttttacaattacatctatatatgagaccaggttaatgctttcttttttgtgttctctttataatatttggaatcgatgccattcttatttcgtgagaatactttggaagcttttgggtttttttttgtatttctatgctgtgaaacaatttttgtacatttgggatgatcaagtctctgaaggtttggtagtatttatgcatgagactatctgaagaagtgttgtttggtgaggtggttctttgataactatctctgtggaaaccagtttaagtcttttatctcttaagcccaattttgataaatcatattatcctaagaaattacccatttcagttagattttaaagtttatttgcatagagtagtataaagtggccttaatgatttttaaattttcattattccttggtgtttatccattgccatctcttgttttgtacatttgtaactttccccacaaatatatacattttccccttagttttgataatcatttgtctaattgatgacctatatttttaagaactggcttttcacttatttcttaattctactgttctattttctgccacattcattcctgctcttatagttattattttctcccttctgctttcttttgatttattcccaacttccttacggagtgtttttggattggaaattttttcatttatttataaatttttttactggcataagtattggaggctctaaactcttccttaatcactacttcagttatattaacagattcagatatatagtgtttttaacatcattattttgtaaaaatcctgaaattttggtttataattattatttcaagaatagtttaatagtgagttttatatttaaatttccaagtggggcatttttgttatttcttgttctatgaattgtaagcagaaaatattatatttttgcatttttccactttatttctcagaatgtcatgacctaacatataacctaatacatgattatttttgtgaatgtcctatgtatattctctattattgtggtgcaaactttgatatacaaaaaaatccaccttgttatatagaacttttatatcttattttttatctgtttgacttgtttgtgtgtgagagtggaaaatctcctgtcattcatatttctacttcttgcatctctctgaatttctgctttacaaagtggcttactttttgatagatattaattactaagggccttcattgtgtatcgtggcctttagcattataaagcatccttctttgtttcatttgggccctgaattctatgctgactaatatcaagatggcaattgctgattccctatggcttggaattgcctagtatacttctagttatttatttttagcctttggaatcacttttaggcatatattgtatacaacattgagttgagttttgcactgtgagctaatatgaaaatctttttttcctctataatttgtgagtttaattcatttacatttatggggatagcttatatgttttgtctcaactttgtgatattattttatgctatacttattggtaatttgatgatttactatatttctttctccatataatcagctttctcttttctttcacttcttttgttatttaagaaagtttcctttttttcagtatttttctttgcactaatgccttttataatggccttatgcacctggccaattctttaaaaaagtaatgctataagtattattctttccagttacatttcctcagactaacatgagtcagatgggctcactctcctgttgcatttggtacctgaaccatagatgggctactgtttaaaatactgactccctctatttaaaattattgtacctttaagactcaaattgcatgcaaattggtccttcagttgaatgctctcagttcggtcgctttgacaacttctcataaatgttgagacactgagcacctaccttgtaccttggtagctactcaaaagagaattttctatcttcctattagttgtaggtaatgccaatgtggaggctgaaatgctaagcagtgaattataattaacacttcagccaggggttggaataatttcccatgttccagataaccagacttatttaaagtcatggaactctgatggaataaatggtttggacaagataaaaatcagtctacattgatctaagaatgtgctataagcaagtaatggcataaacacatttattcaagtggttgtaaactgctatacttagaagacttattctgttttgatgacatttaaagagggtttcccttatcatttcactttgaattttattaattgggttctctcacattcattctgtgttctgaattgataatccaaaacgttcttttttataatagggtaaatgaaaataaactcaacgaaccagagttctttaataattttattcattaaagattttggatagatttttgttttgaatggaatattcatgtgtcacactgaggatcaggtattgggcagttcccttgacagggtttcctttagcctaataataataattcacaagagaggtaaaaaaaattctaggccgggcacggtggcttacacctgtaatcccagcactttgggaggccgagggaggcggatcacgaggtcaagagattgaggccatcctgttcaacatggtgaaaccccatctctactaaaaatacaaaaattagctgggtgtggtggtgcgtgcctgtagtcccagctacttgtgaggctgaggcaggagaatctcttgaacccaggagaggagactccctctcaaaaaaaaaaaaaaaaaattctgaagatattaccaaatgtgaatgtactacagatctcattgaaatcctttaaaaagttgtgattatacatgtgtggtgtgtgtgtgtgtgtgtgtgtgtatctgtgtgtgtataatgtaatgttttccattttaaccatttttaagtgtacagtttgctggcattaagtacattgacatcattgtgcaaccatcacaaaaatccatctccagaacttttttcatctccctaagtaaaatcatgtatccaacagtaagtcatcattcctccctccctactcccagaccctggcaaccaccatcttactttctgtcaaatttgatgattctcatataagtggaaccatatacaatttgtccttttatgactgacttaatttacttaacataacatcttcgagatccatccatgttataacatatgtcagaatttccttcctttttaaagctgaatgatatgccattatgtgtatattccacattttgtttatccatttatctgcccatggacacttgggttgattccatcttttggctattgtgaataatattgctatgaagattatgatacaatttttttttcctgttttcaattctttttggtatatacccagacgtggaattggtaattctatttttaattttttgaggaacacgttctgttttctacagtggttacatcattttatatttccaccaacagtgtacaagtgttccaatttatctacatattcaccaacacttgttattttctgtttttattttttaaatagacatctaatatgtagaaagtggtatctcactgcagaacatgactttttgtgcttgtatttatactacaaagttataaatgtaagattcagatttaaccacttgagcattgtgctatgtgccagatatgtctatatactgttaaaaatattttcacatttactgcacataagaagctcagctaatctacttctcacataaattcatcagagagactttccaaaatgttcccaagaagacatgtataggacaaccatgatatatttctgctttgctcagttttcttatctctttggagaaagattaaccttttaaataaaagagggcaagaaaggagagaaaaaaggaacttaaaagatatagaatgaacagaaaacaaatagtatggtggcctatttgaaccaaaatatacaaataattacataaaatataaatggacaaaaattaaaagaccaatattggcatgatggatggtaaaaacaaataagaaaacaactaaaaattccccacaaaactaaaaaatgactatatgctgattacaagaaatgcacagtaaatataaggatgtaaaatgtttaaaatagaaagatggaaaatatattccatacaaatatgacacaaagaaagacaggctaatatcagacaaaataggatttaaggcaagaaacattgttacaaataaggttatttaatgacaacaaaaggccaattcacataagaaaattaatgtgcatatacttaattatataatcttaaaatttataaagcaaaaattgatagacccaataaaagatagaaattccataataatcatcaaaatacataacacacctttctcgaaactgatagaatacgcaggaaaaatgtcacaaaaaacataaaaaataagcaacagatttgacctaactgacatacatagaactctatacccaacaatggttgcatatatgttctttccaagtaaaaaataatacttgccaaaatatttcatattctgggccatgaaacaaacctaaataaaattttcaacataaaatcatgtaaatgttatgatcacagagtaactagcaaggacttcaaataacaaaaagataactgaatgatcccccgctgtttaagatctgaaaaatacatttctaaataacccattgttcaaatataaaatcaaaatggaagttaaaaagtgtttcagaatgaattgtaatgaaaatatgacacgttataacttgaagaatatctctaaagctgtacttccagagaaaatttatagctttggttgaatatattagaaaagcaaaaaaaatgcctggaaatcaatactccaaggtctatctcaagaagctaggggaaaaaaagttaaatcaaaataaaaaagaaaaaaggaaataatgaagataaaagtaaagattaatgaaataaacaaatagacacaatagaatgaaagaagcaaaaggtggtttttagaaaagacaaatgaaactgataaaatcctagcaggactgattagaaaaacagaaaagttgcaaaaaaccaatcttgtaaatgtaaaaatggtcatcgtcatatagccagcagacattaaaaatagattttataattatttgtatgccaataacttaaaaactcagatgcaaagggaaaatccttagaaaaataagactcaatgaagctaacaaaataaaaaacagtaaagtatgaaaatcctatacctttttaagaaatttcatccataatttaaaatgtgataaagaaaactctaggcctagatagaatttcttccacatatttaaggaaaatataataccaaacttaaccaaatacttcagaggacagaaaaagggagaatatttcccaagtcacgatgaagccaacaaaccttgatactaaatcctgacaagaactttatgagaagataaatcacaagccaatatcttaaaatcttaggtaaaatatcctaaacaaaatgtaagtaaataaaactcagtgatatataaaaagaacagtacattataaccaagtcaggttcatttcaggagtgtaagaatggtttaatattcaaaattatattaattcaccacattaactaaaataaaaagatgaggatgataatattaatatgcttatgtcaaaaatgcatataaacaactaagaataagagaaaatttctttcaaatgataaagtttatctacaaaacaaacaaacaactaaaccctacagcaaatatgatctttaatagtaaatattaaaagctttcctctggagacctggaaaaagatagagatgcttgttatcaccacttttgttcaatatttattggaggtcctggtcagtgcaataaaataataaaattaaaagaatattggaaaggaactaataaatctgttatatgactaaatatagaaaagaattgtagcagtacaaaaagactccaaataaattataaaaattaatacatgaatctgctaaggtcattatctaaaaggtcaatatataaaaatcactttatttctgtatatcatcaattactgagtaaaattttttaaagttcctgtttgcatcaaaaatctttaaatgcctaataaaaattttaacaaaagccatggaagtacccagaaaaatacaaaaatattgacaggagatttttaaagacttaaataattggggggaatatatactagattcatggattggaatattgatattgtaatgatgccaaatctctgcaaattgacctatagattcaatgcaatcagaatcccattcccaagaggatttttacaaattggcaatctgattctagaatttaaatgaaaatttaaaggcccacaaatagccaaaacaatgataaactagaatgcttacacaaccacatttcaagcattcatataaagctagagtgtgtcagtgcaaatagaacaaggcaacagaatagagggttcagaaatagacccactcatatatggaaatttgctttatgactaaagtttcactgtagaactgtagggaagggatagtcttttaaagaaatggaaccaaattggttggatactcacatgggaaaaatatattttgactactacttcacactatacataatttatttcagttggtctttgatctaaatataaaaggcaaaacaactaagcttctaggtgaaaaattagacaatatttctataatcttgggagagtaagatatgttttaaatgggggtgaaaaaaaaaaccaagccaaaacagaaaagttgatacactggacaacattaaaaatgtctgcctgtaatcccagcactttgggaggctgaggtgggaggatcacttgagcccagaagttcaagattagcctgggcaagaaaatgagaccctgtctctacaaaaaataaaaataaaatcaaataaaattaaccatgcatggtggtgcacacctgtggtcccagctatacaagaagctgggcagaagatcacttgagcccaggagattgaggctatgctgaaccatgtctgtgccactgcactcagcctaggtgacagagcaagaccccgtcttgaaaaaaaaaaaaaaaattctgctcacctagacagttttaagaaaatagaaacactaaaaatgggatgatttatttgcaaaacacataagcagtaaatggatttacatccagaatatacaaagaactagctggaaaacatatgaaaatgtattcaatctcattagtcatcaggaaaatgcaaattaaacccacaatgagataaaaacatctactctcaaactggctaaaattaaaacaactgcctagaccaagttttggtgagttaattgatcaagtagaattctcatacactttggtgagactatagaacaggaaaacttaggaatactgttcaacaatatctactaaacttgaaaattctcatagtctacagtaatttgcacagtaattgcacttctagcatatgcccaatgggaagtttatatctatgtactcaaatagaggtataagaatgtttatagcaatatattcacaataagctaactaactggttaaatacacccaaatggccatcagagtttgaataaaacattgtgctattttaatacaagaggctactttgcaacaaaaaaaagaaagaattactgctgaatgcaactatatgaatgtctttcactaacctaatgttaagtaaaagaatccagaccaaaagactaatattgtatctctcaatttatataaagttcatagccaggtaaaacaaatatgtagtgtttgaagtcagaataatggtgacctttgggaaagaacaagtggtgactgaggtagtacatatgagattttgggaggtgctggtattgttttatttatggtgaaaacttattaagctatgcagatataatttgtgctttttaagtatgcatgtgcttcactaaaaaaattccgaaaatattgacaatttataactcaataaaaagtgtgttaactcaagtgtgaagtaatctgaaatgtgacataattttgagcaattcatggggataatcgattttaacttggtattaggaacctttgtattgaaatagacaaggggttgttacttagcacgctagggaaatgggtaatgagatctttttcaattttaaaaatctagtaatgtctattgaccttcaacttttaaaatcaaactataaataaacaagacaattatcattacaaaacaatgtaaatgttgaaaagtttcaccaggtataagacgaaatatttgaggtcagatttggggaagcagtaatgtcatacaaagtcgggagatcaagagatgaagcttccaggattccttgaaggtgcacaggtgatcagtgaacaaactggaaatcacagtttaaccagaggggaaggaagaagaaggaatagagatgaactgatttcagtaagaccttatatatcacagcagaaggtaaatgcataatattcaaagttgataaaccaagaggtagcaatatatcattgagagataaataggcaaaaaacaaaagaagctaaaatgcaaacaagtaaaaggtgttgcttacaggaggttggaatgaagatggtgactggggccaaggctgttgctttttattataaattaaaaatctataggatagaaaggcacaggtttcaaagcagctaaagcaaacttgaaaaagatttaagtgggaggattcattctacctggtagcaagtcttacaatatagctacattaatcaggaaaatatgatgtcagcagagattgatacacacatggattaatggaacagaataaagaacccacaaatagacctacacaaatatgtctaaccaatttttgacaaaggtgcaaaagcaattcattggaggagtggatagctttttcatgaaatgatgctagagtaataggacatccataagaaaataaatacatgaacttcaacctaaacctcatgtgtcatacaaaaaaataatttaaaatagatcacagctggtcatggtggctcacacctgcaatcctagcactttgggaggctgaggtggaaggataacttgaggctaggagttagagaccagcttgggaaacacagcaagactctatctctataaaaacaattttaaaaaatagccaggtatggtggccactacctatagtcccagctactcaggagacagaggtgggaggatattttgagcgtaggagtttaaggctacagtgagtcatgatgtcaccattgcacgccagcctgtgtgacagagcaagactctgtctcaaaataaacaaaataaaataatatggtacagcataataaaataaaataaaaatggtgcagcaaactaccatggcacatgtacacctatgtaacatacctgtacgttctgcacatgtatcccagaacttaaagtataataaaaaaataaataaaataaaatggattacagatatatatgtaaaatttaaaactataaaagttttagggaaaaatgagagaaatctttgaggtcttgggctaggcaatgaattctagccttgaaaccaaaagcagaacccataaaagaaaaatttgatcaattgaatcttatcaaaattaaacatttttcttctttaaaaaaaccctgtgaagaagctataaagcagacttggtaaaaatatttgcacacctcatatctgacaaataactgttactgagaatacataaagaactctcaaaacccccaagtaaaaaaataaacaattcaattagaaaatctgcaaagacacagacattttactaaagaagaaatagaggtggcagataagcacatgaaaagatgttcaaacgtaattcgccatcagggaaatgcaaattaaaaccacaatgagctgtcactacacatctgtcaggatggtgaaaataaataatagcaataatactaaatgctagtaaggatggagaaaaaccgggattcattgcagatgggaatataaaagtgcatagttactctggaaaatagtttgtcaatgtctcatagaactaaacatcagctattatatagactaacaattgcattactaggtccttatcctagagaaatgaaaataagttcacccaaaaaaacctgtgcatgagtattcacggcaactttattcataagagccccaaagtggaaacaacccagatgtccttcaacaggtggcatgttaagccaactgtggaatactacttagcagtgaaaaagaaacaaatttttgatgtatgcaacaacttggaaatgtctccaggggatgatgctgagtaaaaaaaaaaaaaaaagtcaaactcaaaagattacattctgtatgagttcatttatattaaacatttggaaagacaaaactttagaaatggagaacagattagtggccactaggccttaggggtagggaagggaagatgcaggagggagagaaggcgtagttataaaaagcgtgacccaaaaggtccttgtggggatggaactcctctgcttcttgactgcggtgtggttacatgaacatacacatgataaaattgtataaaactaaatacacacacaaatgaatgtaagtgaaacttgggaaatatgaatgagagtggtggattgtacaatgtcaatgtcctggttgtgaaattatactatgattttgcaagatgcaaaatgtatcattgggagaaatcagggaaaggatacacgagatcttttcatattatttcttacaattgtatgtaaatgtagaattagctcaaaaatattaaaaaacatataaataaaaacacaaaatactttctcaataaatttgagagaaaagatgtgtgtgcatatatacatgtgtatgtatatacacctaggcatacccattgggacagaggggccaagtatcaagaactgagtcactatcaggatctggaaaagaaataataaagtagatgcaaagaataaagtagatcagagaaggagaagtagtactgggtgaggcaaagggagatttgaaggaggtgttaacaagcttttacttaagcagggataaaaatccaggctaggtatatcatgatgtcttcttgagcagaatacatcactacccaaaatatgtggtagagtataattcttacgagtgtgagctctaaaactgacttgctgagattcaacatcgactctgtttactcttagcagtattactttgggcaagttatcgaaacttctctatgcctcaggtcttcctaatacatgaatcacctagggttttgttaggagggttaaataagttaatgcctataaaaagcttagaaaagttcttggcattcagtcagtcttagccaactgtattatctgccagcagctcatttatcagagatgatagcataacggtaagtttcctactttttccttgttatttattgtgttctgatgctttgactatctgaaatcatcccacagtgtctggaggacctgatcctctgtatctctaatttctaaagctgtttgaaaaaaagggaaggagcacagtagtgtgtaggtggctgcttacccatccagatacacacaatgctgcttggagagggaaactggttcaccaatacctctcactgaaccctgtctctttgtagccttgatttacaacataccattgtaatgtgaatctaacacaagttagtaatgattctgtagtttcttcacccccttggcaatgtatttatttcttaccaaagtaaaaatgtatcataggtaatgcaatactcattcccccaaatagaagctataataatcactttccagcctccttgattaaatttcatcttattttgcaattccctttactaatgaagattgacagatagtaatgatctagacagatgttgtcagctctaaaacatctacagactcgttctgcttctccgagtggtgcagaagtagctagctactgaagtagccctgaagtctatataacaacagctgtgaagaactccactgtgcgacagcctgagcttcactggcaaggaacacatgattcatcggaaagaagtaattttcttaaacgtatgggcatgaaatatgtaagactcatacttcagaatgaactataatatgatctctcctagggaaaataccatttctgtaataccgtacatttcttattaataaagacaagcattgatttagcagccatcactgttggtacaatatacacaatatgtagcgcgcagaaacaaaaagccagatggagggcaggtaactctgttctggaatttcagcttgcatccaacagagaaaatgagtttgggtttttttcctgcttctaagatagtagagagcagtcttcagcctgggccctgttcctaagagcctgctccaagatgtccaactaaacacagccaggaggaacatctcccactgagggaacaggacaccaggaagactggtgaactcagaggaaaggcattgagagcagatgaagggaagacatagatgctgggctgaagagggaggctgccgggaactgaaactcactgctggtccccagtgactactgcagaaggggtgagctgaacaggcaaggagcaacctgctcttaccatgggcctctggaatcccagcaggaggagacctctaatctgccatggacacttgtactggcagggaaagttgcctagagaagtagtcggggcagaactgcagccagtgcagagtccagaaggtttggtgtgggagtatctatagtggagcatggccaggagtgcccattcccttaggcacaacttgctcccacagaagactttagccctaggggatctgtcagtcctgcactctgcagggcagtcttgcgcatcagatggggcaggtctgacctgagcgcccctccatctgctggcctctcccagggccccagcctggctgcacctgcatgcagtgcagccacctggtacctcctgggggcccacatcatagctgctgtgctggcagaccatgcttgaccagcagagtgctccagcagagcagccccgatgaacacgcaccagcctgcccattccctctgctgcctttgccttcatgtactcgcccatggccaccacccacattgttttcctggcagccatgtttgcagaggaactcttccttcccttccctgccatcatgtgtgtgcgtgtgcactctgccatgccactgctgggcgtaaatgaaccccaccattcctcctatcacctcatagccattgccatgggagcactggtgggctcgaagcccaccagccctgcccactccagtgctctgcccctgtgctgacgctgacaccggtgcaaagaaaacagtggactcccctgcaccctaagcggccaccactgccagtgtgaatgtgcacagagggagcacacaatcctgtgcccatcagtgtcccgccatcattctaacaccaccactggcaccaacacacacacagtcgcaggtgggggaccctggccccccaagttgtactgccaccacagatgctgcatggtggctggggctctggcacctacagcaccctgctgctgctgctgagcacgcaccctgctgcactgctgctgccactgcttgtggcacatgcaaacaaggatgaatcctgctgccaccaccctatgaagtactttgtggctgccaccacccatcaaagtgttgtgaccagcagtctgggagcacctcagcccctccagtgcagaaggttcctaacctcaaggagctagataacaaagccagggcccaatatcagtcccccagagtaagagcatactgtctaggagccctgagctgagccttgaccccctcaaatcttccagtagtgaagctagtccactgaccaccttataccatcatcaaacccccaaggtcatggactagggtaaaagaaaaataaaatccatccaaaggacagcaacttcaaagaatgaaggaacgtctgcctacaaagataagaaagaaccaccacaagaacttaaaaagccagagggtcttcttttctccaaacaaacacactagttccccagcaagggttcttaactgggctgagatggatgaaatgacagaaatagaactcagaatatggataggaatgaagataattaagattcaggagaatactgaaatccaatgtaaggaagctaagaatcacaataaaatgttacaggagctgacagacaaagtagccaggatcaaaatcaacataatcaacctgacagagctgaaagacactctacaagcatttcataatgcaattgcaagtattagcagcagaatagaccaagctgaggaaaaaatctcagagccttgaagactagcttttggaaataagacagtcagacaagaagaaagaagaaagaatgaaaagaaataaacaaaaactctgagaaatatgggattatgtaaagagaccaaatctatgaatcactggaatccctgaaagagatggagagaatggaagcaacttggaaaacatatttcaggatttcagccatgaaaacttccccaacctagctagagaggccaacattcaaattcaggaaatgcagaaaacttctgcaaaatatgtcacaagaggatcatccccaagacataatcagcagattctccaaggtagaaaagaaagaaaaaatgttaaaggcagctagagagaaagaacaggtcacctacaaagggaagtctattagactagcagcaggcatcttagcaaaaaccatacaagccagaagagactgggggcctatattaaacgttcttaaagaaaagaaattccaaccaagaatttcatattctaccaaagtaagctttataagtgaaggagagaaataaggtccttttcagacaagcaaatgctgagggaattccataccaccagacttgccgtataagagcccctgaaagaagcaataaatatggaaagaaaagattgttaccagccactacaaaaacgcacctacacacatcagtgatactataaagcaaccacacaaacaaattagcataacaaagagctaacagcatgctgacattatcaaatccacatgtatcaatactaaccttgaatgcaaatggactaaatgccccaattaaatggcacagagcagcaagttacataaataaccaaaacctagtgatatgctatcttcaagagacccatcttaaatgcaatgacacacataggctcaaaataaagggatcatgaaaaatctaccaaatgaaaaaaaaaaaaaagcaggaattacaatccttacttcagacaaaacagactttaaaccagcaaagatcaaaaatgattaaaaagggcattccataagggtaaagggttcaattcagcaagaactaactattctaaatatatatgcacccaccacatgagcacccagattcataaagcaagttcttagagaccttgaaagagagacttcaacaccccactgacagtgttagacagatcattaagggagaaaactaacaaaagtattcaggacctgagctcaacactaaaccaaatagacctgatagacacctacagaactctctattacaaaacaacagaatatacattcttttcattgccacatggcatgtattctaaaattgaccacacaattggacacaaaacaatgctcagcaaatgtaaaaaattgaaattataccaaccactctcagaccacagaacaaaaaaaaaaactttttggttaattatgaaattaaggcagtaaccaagaagtcctttgaaattaatgagaacgaagatacatcataccagaatctctgggatatagctaagaaattagtgtatttttatcactatccaaattcacagacctaaacttaatgcttaaaatatttgagtgtctgaggattccagataaagaactcttaacctgtaataagaccaaagtactcacatgaagagagaataaaagataaaatactaataaaaataaacttaaatggaggaattatttaatatgctctgtgtatgcttggatttctagtgccaaagatgtacccaattcagtgtggagtaaaggctacatcttgaaagatgaacaaaaaataaaataacaccaaattaagatataaatatttttctcaataagaagtctgagatttatttgttccaaatttaaatgttacatgaaatatgatacaggaaaggaaataccatgataatgtatagacaatctaagcttatgacagaaagaagaaaatcaatagatatttcagtacatatgttcttgagagtagtccttcaggcattataaaatctttatgaatcaacatttataatgatgtaatatgagagaccttcagcaaaaaactgtatcaagttttttgggtccttatatagatatgtgctcaaatgccaatattatagatattaataacaaataaacagataactggaatttaggaaagaatatttcacaggaaaattataggagaattagggcaatgacattgctttggtggactgctcatatttgagtcaggtaccagtacacagactgacccctgagccaaaaggagctactcaaggggtccaagtacgtgaaatcacatattgaggatttctataaagacaaaatgtcagattcacattctctttcaactgactcatatacctttaaataaagtataagatctctaagtatacacagacaaatattaatatatattcatcgtggttatcttaggctcaggaaatatatttcatttcttacttttgcttatattttgtaaagtttgtttaataaacatatgctacttttatagttagagaaagttgtttaaattatttaaaaatattttgccattgcaaattatttcaatcctaaattttaatgaagtttaaagattgcagaccaggcactgtggctcacacctgaaatcccagcactttcgtaggccgaggtgggcagatcacttgaggtcaggagttcaagaccagcctggccagcaaggtgaaaccccatctctactgaaaatacaaaaattagctaagcatggtggctgatgcctgtaattctagctacttgggaggctgaggcaggagaatcgcttgaacccgggaggcagaggttgcagtgagccaagatcatgccattgcactccagcctgggcaacagagtgagaagtgagaccccgttccaaaaaaaaaaaaagattgcaaaaataacacccaggtatcctttgactaatcagatgctaaatgacattttaagaatataaaatattattttatatagataaggttattaatttgggaatttagtgcagcaattatgctagctttgtcacaacaaataaatgtattaatctgtaaaagcaaatttatgaatccacacttaggatttagtcaatgatatttggcagttttacctgggctacaaagactaactaaatttaaagctatttctcccagagcttttcattttaattcttgcatttattatgctgatattgacatgagacatatgaatcaaaattactcagggtattcattggttatcaataaaattatttgagtcaaatgttgaaatgttgaacttatgggatttgggggtttatttcagcatttctgtatattttagccttttctagataatatcttgggctgctactgctcctcactgcagaattaaaatgctgcaaccacattaagtcacatggtctcactaaatgtctgaaaaattaacatttttaatattataattctcactttaaagatgaaaaaaacaagatacttaatgagagtttaggaaagatgttcattcattctttcaactcacacatatacattgaatgccaaacaaattattaggtgctagatatagtctgatgagcaagaccaacatggtctctgcccttgcagtgcttaaaattagattgctatagtagtaagacagcagaattatggttagcctcatttgagtttgaatatcggttctacctcataattctcactaaacttttctaagcatcaacttcttcatttataataagatagtgacaactccttggtcaggttgctatcgagaatggaggcattacagatgagatatatagcatagtaatcagcatgcagtgatacctaagaaagccagatacctgacataaagtagatatttaagaaagcatgcccactattgctatgtttgtgttttctgttggtaatatttttagtaatattaaaaaatatcatgccaatttatattccactaagaccacagaatttcccacttctgagatcatgggagatttatacattccctttttatatgtaaaaatctcaacttcagggtcaaggctggagccattggggtaatcctaccctaaatgtgtttggccactaatattttcacagaatatatttcatgaatcataatttgaaagccattaaaatttgacacttcatacttattgtcctagagggaataatacaatattgggacccatccaacatgtatttactaatatctggttatatttgcaaatatcaggctataaatccaccattaaggttaatatatatataattatatatatatattatatatatatatattatatatatataattatataatatataatatatatatataatataaatatatatatatatattatatatattatatatattatattatattatatatatataattatataatattatatatattatattatatatattaaccttaatggtggattatatatactatatattatataatatattatatatactatatattatataatataatatataatatatagcaagctaataggacaaaagaaagaagcagaaacactgcagaagtgaagagcagaataagaggctagtcattctaaatctacatacatttaataacactttattaactagagatcacataaaagagagcatgatgaaagatctggacccacaggttaaaaaagtgatttcctgagtccaattaacccacctgaaaatgtatacatttattttttctaccactacactgagctgtatgtgtctatgtgtgtttcaaatctgttttataacagtttttcagtgaggatccttactattagttttagcattttaccaatgtattttgaggtagtgaggtatttcatttcttaataagcaaagacatgctggattaatcattgagtttgcattataaaattccactgggaataaacacacatctaagttttaaattgtttcaataagaacttaattggggaggtttggagatatatttgttgattagaggtagacaatttctagtgtgtcagaatattgtcctttggtatgttattttgtgtagtacatggctatgcataccaccatgggttctcaacaaatattcattaactgaatttctagaatctgcaaggaagtaacctttctgccagatgtattttatatatttggattaaatgtcacctttctttttgaattacactctattatttcctggactccatttagctacctacctattcatcatagctccatttaccttgattaaaactccctgctttacttagtgccaattattgattataagcagagttaagtaatcagattctatttccatctgactcttttggcacctatctgatagttcactgagaagtcatctctccatcttaagtgggctggggcttgtagcccttgaagcaagaggaaatgtggtatttaaaaagaaagggtcctagatggttggggcttgtagcccttaaagcaaaaggaaatgtggtacttagagagaagtggtcctagactatcagaaagtcaaacagccagactaaagcgtcctaagtaagatacaagttgtactgagagcaaggtccctgggacacggctgcttttaatatacacaagccagcacagtacttcttcacttaatgtcatagataagttcttgtaaacttagtttaagcaagatgacatacataaaaatcaattttaccacaggcgaagagatagaaataagagttaagttcctatggtatatttctggtcacaaaaacatcaccaaacttctaaataaagactcaaaacacttctaataatagacactgaaataaatttgaactatacatacatttaagattaataaaaacaagtaagagtattatttacccaagttttggtgaaaaagtgagtgatgatgatcacagtggcgatggattaaataaaagaataaatgtttgcaaagtcagaattgcaccttctcctaccatgcagttcaaaaacaagaaccaatatggcaggcttgctgagagctttggggttgcatggtttgttgtacatttctatgattatcatatacttgatgaatttttatttgataataatttgcgtgcattcatttgttcagtttctaactcacttattccagctcagggtcacgggtggccagaacctgtcccagcagctcagggcacaagtcagaaacccacagtagtcaggctgccatcccatcacagggcacattcacatacaccgacactcactcacactgggactgtgtagacatgctaatgaaactaacacgcacatcttagggatgtgggaagaaactggagtactcagagaaaacccatgcagacatggagagaatgtgcaaactccacatagacagtggccccagctgggaatcagtttccttttcttgtcaatgttacaacaaatcgacatggaacaaaacaatgttatttgaagacctactgtacttcgaagccgcaatctctgactgccatgatagcctcatctcagctctgcttggcatagtagagatccaggcagtactgaacttggtcaggaagtctgggtcattggctaaatgacagaaggattggtggggagttcacatttattgataatatttattaactgaatatgtttctttaaattgagcttattcccaagaagaggtaaatcttactgttctattgagttgactgaaacatgggaaaaaagagaggtgaatatttcattcatacaattttaggtgatcctatactgggtttggggtcacttctatgtgtgatatataggattcaatatctgagatgttagaggcatcccatacctctaatatctagggtgtaagggtggggtgtgcagcagttaaatgatatacttgggggtggaggtgggcagtggtttccttgagctggctcgattcagtttgacagctgactctgtgcatttcttcccaattctgtgctcagtaacatcatctcggtagcttgaaatcagtcatggtgggagtatttacatcatggaaatcaacaatgctaccaattggggtctttactatttttttttttttagagagagatgttgggttgttgaatgctgttgggttgttgaatgcttatcaacacatcattcagtgtgatgtatatatgtatgtccatatatatgtatatatgtatacattctagaaattttatttctgaaaaattcaaaataactttaaattttgttctacctcacacgtgcatttaaaaaatggtcaaaatatataatttttttttgctacaaaatatcttaacactgtttcctcgagcttattccttgtttacagcggcaatttgtaactaatcccatcctgttggaaattccagcccaattctttcctttagcaggccaactcttttgttgtagttaatcagaattattccaaaagctttcttccctaaattcattgctttttcgtaattagtaaaaacatgattgacaaccattcagccaactgcactcatcaagtaaccagcaatttatagagtttagattgttaaaaaagagaaagatgaaactaccaggaagaccaatggatgcaaactttacaatcttcccagaaattctcctaataacaacaactcccacaatctagaagctacttttagagacttaacatatgttaagaagaggcactagaaggcataaatttagtcattcatatattgtataaaaacacaattaatgtactctttggcaatgtgcggcagctcatgcctgtaatcccagcacttctgggaggccaaggcaggcagatcacttgaggccaggagtttgagacctacctggccaacatggcaaaaccctgtctctgctaaaaatacaaaaattagccaggcttgatagcacatgcctgtaatcccagctactcaggaggctgaggcatgagaatctcttgaacccgggaggcagaggttgcagtgagccgatattgtgccaatgcactccagcctgggtgatagagcaggactgtctcacaaaaataaataaataaataaaataaaaaataaaacaaaaaatgtactcctttatcaaacttttactgggacttgctgtagtaaggacctctcagaaaaatttcacagttactacccttgaagaacttatcattctagtgaaggccataaaatatatggtacaaattattaaatagagacaagtagaggatgttatataaagaaatctagtgtaactgaatttactgtacaccatatgaaactcaacttggtgatgcaaacataggcttttttttttttttttttttaattttgggatttttttttcagttgtagtaagaaaagaaacattatcatcagccctaactttatgatctggaaatggaagattacagattggagttttaaagtctctatcttctaagcatttaagagatttctcctttgtcatgctacattttgacaagtatgggcattaatttattaaccctcaattgattggaagagtcagctaaatacaataccttattccctcatggaaacagcaacctgaagtgtgactgtaattgcttcttatccagatgacagaaagcaatttcagtgactgctttacttaattaggatgcatgcagcatgaacctccaggtcacctatgtctgtaaattctgcctcttcaattttcttgagaaagcactccagcaccttgacatggtttttagcaagcacatataaactcagcacaaccaaatttcacttatttatggatatattatctacactgccttctggttttgccacagaccccggttcatttcattacccattttcgctttctgggcattcactgaaaagttaacagtgaaaaagcttcattacccatttgttggcacaatatttttgaaggaataggggaacccattgtatttgttttgcatgaggagaactctttgaaacaaaagcttttggccttttgcccagattaagggaagatttgaaagacggccaagtttgcattagtctgaagtagctgcctaccatcatgaagcaatgtgcaacacagagttgtgcaaaacgacagcatggaaaaccggacaactgctttgcacctttgggatgtcaactaggtggttcaatggaaggtgcagatcaagagacacatgtactcaaatatgagtaaaaacacatttcaaagacacaaatcagagatttttaaattatgtgatattttggacaacccactacaacatgattgtaggcatttttcaagcatctatgatgatacaaagctattattgagataataaaatatacaagagatagttgccacactaaaacagcttatgaccaagaacagtggcaacagtaaaagtaacagtagcaaaactacaaaaagcatctcatatgaagtgtgtgtactatgttatataaaaattcatttatttccttttagggttattaattgagaattaactgtatcttgatcatccagtcttgatctattcttattatgattattttcaacttatagcagcgaggaaagtttcaacatatgggtgcttaggtatataagaccagtctactttaaccaattagtaattagtccatacacctcagagttaagtcttggtatctcaggaaatactaaatttaaagtttgaatatgtaacacaaatccaacagtttgactggatttaattttactgggttacatccaagagtttcctaaaactcagtagggttacaagtgctccatgaacatttttatgtaaatatgtgatatgtgtgcatataatatatggcttcaaaaggaagacacttatacgtgtgtgtgtgcacacatgcgtgtgcgcatcctttgcccatccattcagcacagctcctccaaaattgagttacacgactgcacttcttgcttactgcagtcttacccattgtagctgactgtgtgactgtgtggttcacttcacttcttggctaacagcctgcagaacatcggcatgatgaagaagacatgcacagaaaccactcaatgaaatgtatcacagcagatgtaatcagtaatatgcaagagcctatgagctatataatacctgtccatctgccattcttcctgcctgtccactcacagttctatcaagtatggatgccacagataagagtcctaatcaagaaaaacctggataacatcagtcttagaaaatgacatttatgcattcaaataagtggcacagccattgttgctgtgcagttcttgctgctaaggtttttatatacttttattttcttcttcagtcaaaacacagtagtgcttactgattacaaggaagcagaggtctaagtattgattttaatgaacctactgaattttcaacagtcttagcttagtaaggtaaaagatggagtgacagagtctaaagtgttttcaaacaaatttgttttgttcaggccatggactgctttgcactttagagagttggagaataagtgaagaagcgcatattaggcatttgagaacacttctccactaatgaatgtagatcaggagcatgatagaatttgaagagatctgagatgcctcttgtctttaagttcaaaccttaattttactagtaacgaaatagaagtccagacaggaaaaataacttattcaaggccatagaaaatgtaaatgcaagggctaaaatcatttttactggccttagttagatccagtaatcgttttcattatgatgtgcttattatataacttggctgagaatgttttgtttcttccctctcttcctttctccctctcttctttcctgtccacttttctctttctccctaacaatatctttccctatttctcttcctcttcttccctctctccttatcatcttccctttcttctttcattttcctcttttgctttcattcactcattcattcatatatttaacaattatttactgagtacctattatgtgtcaggcacagtgttagaagccagggatacagatggaacctggccttatggaacttacagtccaatagggcacatggacactgagcaggtcagggaaagctttctgcagaagtcatatttataactgagatctgaaggatgggtaggagatagctagttacagaatgaggagtggggatcacattccaagcagaggaaacagtacctgctgatgtcccacagcagaaagatgctcagtcagttctaaggctagaagaggcagaactgacccacgaggcagtggtaaaacagtatcactatttgaccctgtcctcagtgcattaataaatcaggaagaaacattctaaagtaaacttaaaaaaacaaaaaacaaatagagggaaatgtatcatgtatcttgctaagacaatgttaccatgacccatgaccttgcatattaatcacctttttacccaccgattctggcactctcatggaagccagtgtggtcagcgtggtgtatggacaatggactctgaaatcagacaaatcacggaactgaaccttccctctgaactttctggtgcttcagtcttgagcaaagctttctgtctctaagcttcagctttctcatgtgcagaatcaagaattcaaaactactatacagaaggctacacagaacacatgtaaagaacccaataggatgccaagcacattaagtacttaaatatccaataagcaggttaaaaggtctatgacatttaagttttaagtcatagtatcagtagatgctttttaataggagcaatggatttttcagaaatataaaatctatactctgtacctagatactgccagagatggaaaatgtacattttcaagagaacatattgggtatggaaatgccatatgtaaccttctcacaaaagtagagaaggctaataagcccttgggccatcaacatggtcaactcagtctcaagattattcttactaatgcagatagacataaacaggtcccaattctcagcattaatggatagaacaggactcacaaacattggaaataaaatgaagggcatttaacttttctctgtctcagttgtgtcttctgtaaatggaggtaatacctcacagggtgactttggactataattatcattataccctgtatcattatcattatgtatcattgtatgctatagttattagtattacatcctgtatctgggccataatacatgctcaccttttgtattcatggaatatgatggtcacattttataatatgggttcaaaattataatatttgataatttcattataagggaaatagtttttaaaaactaaactgtttccttgttcaataaatttcatagatgttatgaaaaatcaattttttgtcataatttttacataatgggaatgagagttagagtccctatgcagggaaaagaaagcctgcggctctttcaaacaaggctttactggttccaaatctgttttcaatcttacacaaacaagtttattgcttgagtgaaagcaaaaaccaaaatctcttatgtctttaagcagaaagagctcctagcagctagagctggaattctttataaaaatagtttattgcaaagcacatactatttctcaatatttttaaaggtaaatattagtgaatgaagctctctctataacagaagttttgaaattcatagctgttcatcaacgtggtattgctttccatactttctcagcagtgccagcccccaggacattaacagttacagtgggatgtcagagatattttctcatgctgtatataaaacattttactttcagagtggcatttggtaaactagactaattcacatagagtagcatctctttgaataaacacttttaaaaaattgcctttgattagaattaaaaacatcagcatttggcaaccatcatggttataattgattcagaaataaacatcaatggatgccaaaacaagaggaataggatatttacatcattgcaaaataaagcagagaagaacagaagacaaatctagcaagcatcacctcaacttagggatgaaaactgacatcagcaggaatgagaaacagacatcaggtgtcttccgatacaagccactgggacacacaccatggcacttctggggcaaaaatgcatcacctgaatataatcatgaggaggcatcagacaaactcaaatattgacagagttgaccaaaaaactgtccagtactctttaaaagtgtcaaggtcatgaaagataagggaagactaagcactttcctagactgaaggaaacggaggggacgtgacgactggaggcaacatgggacctaggaatttcttttgccagaaagacattttgggatgatggcaaaatctgaatagattacataatattgtattcatgttaatttcctgaatttgatcactgtactagtgttaggaaagagaatatccttgctttggggaaagtcaaagtattttagggtagaggtatactatgtctgaaactgttcttaagcagtacagaaggaaattgggtgtgcatgtatgatgtatgtgtagagagagagaaggagagaaaagggggaagtaaaaatggaaacatgaaaaaatttggtgaatccaagtaaagtatatggtgattctttataatattttgcaagtatttgggaattctgaaatgatgtcaaaacgtaaaaacttaaaacaagtatttttccttcaaaccataataaccctctctgtcatgacatggtttctttctggtattgggtttgattatgatcagcttggtggagaggtacaacatatcagtgatggtggaaaagaagagtaaatatatatgcataagtatgtttttctgactaactccatttgatggtttcttggcaatgtccaaatcgatgcatagaaaaaggctgttatttcccactcgacccagctcagagaaaagaccagactcaggtacgagccattcacaaaaaggtttagttggcgaccttaggttggatgagggccaactgctactgtctttgatatctatacttccaggcagcctttattttcccagtttcttctcctttgtccttaattctcctctctcctctgaattaagtcccaaacctgttcaggtaggatttagccaatctaatcccctctatattcaaaacagaacactttaccctggacaggccagtctcctcgttgccctcaaatgatactcaatcctgcctcaatattttctcttatattgtcccctctgtataaagataattaaaaataataataatagcagctactaattattgaataccaatttcatgtgaggtactgtcctagatgctaatcaatacatacacacacacagaacctaatttaatccatccatcttccatgcgagagacattattattcccagttttggagctcagaaatctgaggattaaaagcttagacaactttatttttagcagctggctttgtctgttccataaccatttcctaaagtatgtaccttagaatattgaagttgttatttgaaaaaaaaaaggtgagggaaagggcaatggtcaaatatatttgggaaatgctgcattgaattaatttatcaactgagcctctgctgtgctaatttgtgttgcttttcttcaatgtttacatattacacagcatttcccacttcatgtatatcatgccattcaacaactgctttaaaaaattatttgttgctgttttacatcattttgtcttgtcaccaaaatagatggcatttacatgaagaacggaatgtatcttgtatttgtttccttcctatgttaagcacatagtgggtgttcgataaatgtcccataagtggcaggaacacgctaagctccctacaccatctcttttcttcttacaacattctttagtagttctccttgaatttccatgcctccaatttcctatgtccaagctaatatttacatgtaaaagaagtgacctttggatgttctgaagttgacttctaatcagcagtagaagtttctgccctctgacagcatttgattacatttgggtaactcttcattctctttttacccaggtaagagtcaatttttcaaacagcagagtccttaaaaggttttgaataagaaaggaaaaacgtaatttaaataagcattctatacctggcagttgggaagaatgaaagggccataaacagttcatcagaaagcaccatggtgtgttaaagtataggtaataaaatcacagtatcatttaagaaagcactatagagactttgaaatgactttgctaaactgcaagagttgcattaattcctgtttcttgcgattacacatgagcatgactgcatttggaggaaagcagtcacactatttctgccaagtccttgcagatttatgtgaaaattggaaatttctgtatctttgcaaaactgatcgtgagcttttaagcgcctaaatgtaagaacgtacacatttttgcatttttgaggctaaaaggctgtctgacatattctctctcaattccttagtagccatctactttccagagagcttcaaaccttgctatattccaactctggtagttagtgggtgattgataaacagctgctgtattttggatatgaggttgaaattgggggcagtttctgggaagaaaagatggaggagcctggaagagtttaccacatttaaagctatatttaagaagtctcagctaccagagcaagtagcaagaaatgactagtgattatctttaatgtatagaaaatccctgagtacataaaatataaaagctacagttctgggtacaataggaaggaaaactaggacccagaactacagctttttctcatcttctcttcataggcaagtattttggactttcctccatttgctgcatagacctcttgattatcatgtattcctatatcctcccacatctattacaaccacccatcattctattgaaatgatttccaaaatttgcgcctggactagcaacatcagcatcagctgggaattttttagaaggagaaattttctggcttcactgcaaatctgtgaaatcagaatcttggggtgagagaatggggactgacaagcgaatctatgtttaacaagcccttctaggaatttcagtgcagtataccatctgaacacctctgccctcttggaactactctctcaaggttcagtcattacctctgattcacaaagtctagtagtctttccttagacctgatcctttttcatctctgcatcatgtcgcatcactccttgagacttcccctgcttattttctataattttgtactaccccaactgattctctttttatctcacaatattccattatctttttcatgaactcccctcccattttctaggcttttccataattaaatctcacctttttccactgtgtactttctctcatgagcatctgattcatctctatgatcttaattattaagtttagtcacaagacttttaaaattttatttttcatccaagcccctctattaatctccaagtttgtgtttccaattgcttgtacagaaatggcatctctatgttccatggactcttaaaagaaaaacatcaaaacccaaacacccggtcctcaccacccctaagcagctgctcccatttctgtcaccagactcgcagagaagaaaacccaaagactcaggctcatctttggttttcattcactccatgatcaattacttgccaagtctcattgagtctgtttatattctttgcttttccaccaattttcttgtatgttcagcttccagtcgtctttcactttagttctttctagttatttctactaagttaatattctgagtattaatacgatgtttttattgtatcattatgaagacattcaattattcaatatctgccaccatctcctacaaaaagtcctacttcattagcttgacatttaagatgatctattatctatgatgtgactccaaacttcctttccagcattttttttcgttttttgagacggagtctcactctgtcacccaggctggagtgcagtggcgcggcctcggctcactgcaacctccgcctcccgggttcacgccattctcctgcctcagcctcccaagtagctgggactacaggcgccagccaccacgcccggctaattttttatatttttagtagagacggggtttcaccatgttagccaggatgatctcgatctcctgacctcgtgatccacccgcctcggcctcccaaagtgctgggattacaaccatgaaccacagcgcccggccatttccagacttaactgttattgctctctgttgtattttggtcaatccaggagacactccatcgaagagtctctaggatttattatcacttttaatactcctgtagttttatttttactatttattattattattattattttggagatggagtctcgctctgtcacccaggcttgagtgcagtggtgcgatctcagcttactgcaacctccacctcctgggtccaggtgattctcctgcctcagcctcccgagtagctgggactacagggttttattttttaaatgctttcacccaatctggaataccatctcaatcctccttccatgtcaccttcttaggttgtccccatctgaatattatctttcccttattttcacctccttagtatttttcttatggcaggcaacacatcacaagttattacactaaaatgatttctcggccacactgtaaactcctgaagacagatactgtgctggcctctaagttttctttctcacatgagtacccggtgtacaattcgttatatcacagatacttaataaatatttgtgtactgaataaattcttcctgcagattgcttatgagatggttgatgggtctcattaaagaagcagcaatgaggatgaggcagggggacagatgaggcataaaaaatgcagacaagaaatttttgactgggagaaagaaagaatagagttttcctaaaggagagacttgggaaagtaatgcagatttgttttcaaattgtgaagagttctaaacacaggctaagagactcagaagactactcaatccggtgcttcccacagagtttagcgtactatgtaacattagttctgatgaaaatgttcaggttctaacccataaaattggggattcaatagccaaataattttggaaaattaggcaaacaaaaataaataggattatttattgtaacacctcctagacctttccatttgctaatgtttgactttccaggagtgtctacagccagtggtattgcctacactttttttttttttgagatggagcctcactctgtcacccaggctggagtgcagtggcgcaatcttggctcacgatcttggcttgaatccacctcccagattcaagcaattctctgcctcagcctcccgagtagctgcaattacaagcgccccacgcccggctaattttttgtatttttagtagagatggggtttcactatcctggtcaggctggtcttgaactcctaacctcgtgatccaccagactcggcctcccaaagtgctgggattataggtgtgaaccaccgcgcctggccttttctacacttttatgaccactaaactcttttatctcagagcattctgtgagaataacatttctaaggaattcatgctgggaaacatcgcatgaataactcttcacaactcaatattttgtgaacttttaaataagtaaaggcaattttaatattcagtatcttgtaaatggaagaaataaattagcaggcccataaagtatcaagggaaagggcacttctattttaagtatctaaatattgttatctgcttcagatagccctccaaaaggatttccaggttatcagctatttgttgcctgtctccggatctatcctccccgacctatcacccaccctccttccctattgtcacttattgagatatttttttcctggaggaatcttcttaacaattaaaggaaggtaggaaaaaagaaattaattatacacacaaacccttgaggcccttataatttaaaatggatttactatgacttgaaagtgttgtaaaagcaacatacatattgaataggtatttgtataggagaacagaatgaaaagctgatcaggaggaaatggagtctacctggtctttggcctttcacagttgtgttccattgtttttttctaaatgccataaagttcacttaaggaatgttcaacgtaataagcaccaaataccatatacctgttccagagttacacatatgccaaaatagtcttacctttgtaatccctaagaacttgaccattgaaatatcttgagggaaaaacacaaggttttcttatagtattttataaagatgaattcctccagatcataagggaaataaaagagtgtgtgtgtgtacatgtaagtgtgtagaaaatgaacttaatgaaatgtttttccagtagatggaaaaggtcccaaattaatcagagaaaggagttcacatgtgaatatcttcttgcccaatttggaattattaccactagagattattaggaattaccatattctaagtttgtagatgtataataaatagagtatagtcattaatatggctcttcaattttttaatatgatcctactttttctagattttcttctaagcactcatatcctctagcctgaatttatcatcaggtaagaaaattttaataattttttttctgaaattcttatgaagtattttacttgaatgtcccagaattggaatacatcattaagaatgtacgcatgtcacatagaatgtttaaaggaattccaccgataggttgatttgacacagggtttgaaatatggctgaagcaagcctgtggacagcccctgtaactcaggctatcctctggataagatgaacatgttgctcattctattatttcccttgacatgattggatctactcctttaccataagcaagaactcattcctttgtcatcagcaaaagctagaatggctaaatatgttccatagtagaaactacaaaactgtaagtaggtacatatgcaattgccacagaaaatcattgctttcaagatacaagactactggctgcatcacacacacacacacacacacacacacacacacacacacacacacacactcacacaacaaacaaatgaaaaacggtatggtaagagcagagtctttgattctctcatttaccagtgactcaccaatgctttgtagagtgtctgacgtattaggtacttcataattatttgttcaataaacgaatgaatgtaggaatgtatgattttattttctactctggtcatatcatgattcaactttagatatatactctagcatattactaggttggtacaaaagttatcacagtttttgccatgacttttaattactcttaatggcaaaaccacaattacttttgcaccaaccaaatattaacacttttattaaaggaagaagagtatacattttcatcattccatcccctacacagccaagactggtgtcctgttgggaacaagtactcaatatatctgttaaacagaagactggttaaaaaactgtctcttaattttttagagtacttaggtatttgatcacctacctcattttatgtcaaagaattcagtaacccctctaatctacactgcccagcaggtagcctttcactaagctacaggctgaatggccacaaatctttatgtccttggaaacacttgactcactggacatgcatgaatagtccaatccgtcttccccaagcaagcgtgctgggtggtatgcgctttcagcaacaatactgtcattctcacttaccatctaaatcaggagaactcttgactggttctgttccctctctaggcactttgtttattgctccggccagaaggtagaaccatgttccactcaccccatttgattctatgatttgaatctactctgtttgatgtgctggttagagctggagtcttgcttgagaaaggacatgaaaaattgcaggaaatcacaatcaagcctagcaacatcaggtgagtgaaaagcagtgtccaatttctgagactacctcagaaagcaaaacctcacctggatgctgatgtgagaggaatatctggatgtatttctgtgagatattaaacaactcaaggtactagaaatcacttaatggaaaagggacatgatttctcatgaggagcctgagctatggctccattcttgcccacattagctattatgagatgaaagcaggtggaaattattcattcccttcaaactcacattcttaaatgttatcttataaaatagctttatcctaatcttctgcttccagggaaatatgacaaatgactcctcccccagagaaggctgaggaccctcacatacttcagcacttctttgctactctatcatcttaggtacagtcattgctcgagagtcagcaggcattatacatgactccattgacttacctttattattatgaggcacaacccgactccctcaccccaaggctgctctaacatgccttagcaatatgatcccctccacacacacggctccacatcagcccaaattctcagggtcagacttgtaagtactcatctttcagagtatgaggaaaactctccaaaatatatggtatgcatatatactccaaatcctagaacatatatactgaaatatagtatataatatcaatactctccaaaatatattgtattaacactactctcacattatccatatctgaagtgagttttagatctgaaagcaacattttataattgtacttaaaccaaattaaccaagttcatgagaggaaagggggaaaagggtggcctaaggagcccaagccagtaaggaggtctgtatgttgcctgggtttgcaggggaagagaagacatggccagatgagaaggtccctggaagcaattgacacttggccatttctaccttgcctggtcattgtgggtagtttgtgttgtttctgctgggctgcaactctttgagggcagaggaggtactgaggtgtaatggaggatgggctccagagtcttgggagactagattaaaatcccatttcctctgttttctagttctgtaagtttgggaaagttcccttactttcggaggctcagttccctcacctgtgacccacaagctaataataacctgcttccaaatctgccatacaacactgttctgatagtcaacaataatgtattgtacacttaaaaacttgttgagagggtaagtcctatgttcagtgtcttaccattcacacacacataatataataataacaaccttcttgcaggttattatggaataatgtgaaatgaaataacaactggacccagaagacagaaggtgctcaaaagccttattgtcttctatgaagtgctcccctcagtatcatgcacatagcaggaatcaatacatagagaaaattgttaaatggggattatgacttattcaccattgttttgtgggtatggaatatgatgctggggatggaggagactcctaatttttatgcatataaataaaatgtaccaattatttattgagagattcatgtagatctccgatacaccttggtaatagagaatttaacaaataaatattaaaaagtacaatttgtatctttaactaaggcagagataagatacagttttgctcacagaaattaaagtgtttcctagactagttttaaagtccctgccatgtcagacagaaatcacaagaaaaccaaagtaatgagtgggcatctctcagattactgaactatatttcataattatctaataagaaaaattatatcttatttgatgttatgtatatttttccacaaaaaaataaaatctttatatactacttgttggctagaagtgtcacttttagaagtgttactttccttaaacacacttctgtttatatatcaataacatacctgtacattcgaaactctggtgcacacccatttttcagagaatttttactcatctgcaaatgggcccaagcccacggaatgcaggtcatctacactgaatgaactaacagtaatcacagccctcatcttggcctctcttcaaatatctctggacctcacttcaaagaagagggctccccttagtccagatgcatttataatacagtgagggcacctgattaatgggaggggagaaggactgacttatagattgactagcaattgccaaggaagacgttgactttggctcacaagaaataactctccttcatccctaaactttagtttactcatctgtaaaacttgtcactgttttgaaaactgtgtctcccagttcctgaggagttctaggggaaaagagggagatgactgggctaaacactgggtttcttcttcaacttgagcagcttgttttcttcatgcattttaaactttccattgcagagctttctttgaacaaagtattactctataaagaatctactagatttgtggcctcagcctctacttcgtaactggttggcattcattcaaaatgtttttaaacatctcttttaggactcaaaaacatgtttaagtgctaaacagtttactgcagtttactaaatccattactaaacatactaaatcacattcattatctcatttcaacattactgtgagttcaagattaccattctccttcatttcaaagagaaagatgctgagtctcatagaggtagccacgtacccaaggtgcacaagtagtcagttatggagctgacacatgagcatgtgtctcaagtccaatcatcctccacccatagcatgccacttcactcatgttaggggctccaggctaggctgtgcaaaatatggacagaaagtgaaaatggcggcggggtgggggggttatatagtcttattgtacattccaaatgtgctctgaatattcaggccaaaatattatttagccgtttctttttatatcaccatagagtactgcagaacgtagttttggtgttcatttcagtttcatcatctaggggaatatgaggacaaaatattatttaattttacgccaattagtgttgaagtctggcatgccttatctagttctatacaacatcttctgatcaaatatatatctgaaatcagaatagcccagtcagagggaaaggaaactgggtggggtgaagggtgaagaacatacaaaagcagcactatgttatctctaggggggttgtttccgtatctcgaagaaaagaaaatttggcacagaatttggcttcatgttaaggggacctttgtacatattattatctgcacttcatattagagaaatctgaagttcaggtgagttaatgaaactggtaaagttcacacaggtagttaatggtagatcaaagattcacagcctagtgtccccaaaaatagttttaagagatgcagttaaaattaaaccacagtaaagagatatgatctcattaaaccaaataaagcaaaataaatgtattatatttagacaccatatattttccaaagtaaatgtttgtcgaaggctattataaaagggctggacttttattgaattctagagcttggtgaaaagagtctggaagacagctgtatcttgaaaacccacgaaggaagaaatgtgggatggcagttgggttttgagtaccagttctcattagctggctgtagcttcctgaatggctgttttgagaaagtattctgaggccttgacccaagtcagcaggaaagaattccatattcaattagctatgtgtgcaaggggtgtggaaccacagaagtggtggcatgagtgctgcatgtttcatgacgtttgctctatctactgaaatcagaaaatcacttacgcttcttgcaaacaccttataatcatttttaacaatgaaaggcattttgagacttgctgccacgtccattcaaacaaaccagataaccattcaaaaaaccctacatctctaggtatcattccaaaacaaacaaaccagataaccattcaaaaaaccctacatccctaggtatctaggagtttgctgaaaatggccaaagtaccatcatctactatcttcagtgcacaagcaaagcgtatctcactttcaccaagtaaaattaacttcctgaaagtcaaagaacaggagtccatgtgagataattaattattcctctttttgactgaaatggccactggaagctatatttttatggcaaataaaatattatactactatcaagaaaatataataacaaaaacacttttacaaccaccgaaagtggatctcagtaactcttttgtcaccaatagtgcatatggagtttcctaaccagcgaataagtatacttcttctttagaaccatcctaaggaaaaaaaaaaaaaaaaaaaaaaaaagcagcagggagagaaattgtctcttaaacaagtcttgccattcacaacctggaatggacctcaggattataaatttcagtttcctgctaaacaagaatgtggttgaagccagaaccagcctgactggtgtagacgatgacgccatgctaggctactaagctaactcaccctgcctcagtatcctcacctgtgcagcgctagtcatctagtttcccagcaccttcttaaaagtgcctcttgtgttatttcagctccatgcagattttgaagggaaagtgtcccagaaatgaaaaggtatattattaaacacacacagagtttgtggccctgagaagttaaggtcttctcccaatgtcatccagaaaagcagtggcagagaatgagtgtcaacccgctcaatgtgtatgaaacacaagataatgaaagaggtacagatgccacctaaaattccactgcccaattttgacaattgtgttatttttcagctctgttggagattagagaggttttcataaaatgtaaaaatactgtaaaatgtctaagggtctaactgtctcctggtgacatggacttggcagcagatgcttctttccggttcctggtctgcctcctcacactcctttgccagcacatttccaaaaggtatgagccagaccagcggatgcaatgactgagatttttctcgaagttactctaaaggctagcagcatgagcatcattaatacatattactggccaactatcacaaaacagggtcgggatccttcagacactggagtacaaaagcctccaggcaactcaagagcttcaatgtaaaaggtaacttgtaggagaatcactggagcacagagctggaagaggccttacatggtatggtgaaggctttaaattcagcacgactttgcaggtttagatcctggctttgccttatactaactgtgctatccaccattgatatatgtatgcctttagcatgatgtgtggtacatggaaaactgtagctggcattggggcagaaagatgacttttcagcttcctcagattaaagataaggaacttggtccaaagaggaagcagcttacccaagaccacccagtggttgtactgattctaagcaaacatcacagttccaagaaggctgattttgtggactggcttgagatgcttcccatgtgcaggggtgtgcatctttggttatcattcaggatgcttgctatgaaactctattcccccctttagaaggccacacatcagcaattttccttcataggtatgaactcataaagttcatagaatctgttgatgctgcccttgagataggttattgaggtagttacgaagtgaaataaaatttaatgcagctcagcttttgtttatgtaagtcagtccatccagtagtccagtagcactaggtgccacttttgtttttactttcattgtctggtttatctgaaatgacctgtttcatctattaattcatcaaacatttattgaatattgactgaaggctaaaaccacgccatatcttttaaggaataaaaatatatagttggcatccccatggttctaataacaaaggagcttgcaatttcactagagaagatgctttggataaacctgaaggactgactggcaaatctgaaggggcaggattggggcagaagggttgtctggaatcaggtaaacctcacctggtcactagggctttgatgacctcgggaaagccccttaacctcttcagtccccatttccattctataaaatgaagacaataacagtagcttataataacttacagggttatggtgatcattttttaaaatgatgcatataaagccttctccacaatgcctggctgctaggcagcactcaacaaatgttaactatgtttgtagtttaagcagtgggttcagagtagatttggagattctggttcattggaaacaagtgaggaagtgaggtattattaagtcatgttaaggttagagcttaggttgtatttcgaccatttgggaggcagcttagtgactgaatatttgtgatttcaagaggtggttcggacagggtacattttaagaaatttaatcaggcaagtgagatggatcaaagaggagagcaaatcaagtcagggagactggttataaaaataataatgtgggtaagagttagtagaaacttaaagatagtgcagtagataatagaaataatgaagaggctgtctgaagataattagacatcactggagatagataataagatggaggaaattataggtgtcttcaagatttcacacagagtttggaaaagtaaagaatgatgagtaatagaatcaagagggcaaaaacaaggtgtccagcttcctagttctcagcatatatctttatagccagagcttgtgagtggcaggaaagtattcaacacacatcatgtcttatattcaattggaacattttttaagaagagtagcctcagctctcagaattcaaatacatacctattatagaatctccagccttgctgcttgctgtcttaaaggaattggtgatgtagacagaagtcctaagagttcagatctttatgccagttccttaaagacaatattatatgtgccagggttgctacagttcaatgttagtgtatctttctgagttcataaataaatgttgttttgaatgaatgatttgggagtaaaccagaagaatttctgcctttgacagacaatatagttttaaggggaccacccctttctctctgttgctttcccagcccaacatctagaaatccagcctctttcccatatagtctgtatacaaataacctaatagctttacctaccatgtattgggcacctgctatatatcaggccgtgtataaagtattttagagccattatctcctctaagacacccctatcaggtaattatcatcccaattttacacatgaatggactagacctagagcaaatttttccaaggacattcaagtatctgacggcagagcatgattcacaacaagtttaaagcagtatcaaaacaacatccttgagggcataattgggactagaaaaattgaggaagaatatattaatattatattctagtgtttacaaagcactcattgtctgtgaatggaaattaacacaccaatcacagtatgctgcctcttgttctaatcttttcatattatgttcaaaggaaatctggttttattaactttaaaacttcagagaaagatgatttaactctgatccttagaatacactgcagagatatggataatgagacactcttcataaatataaagattaggcttcttatgtcctgttagagtgtcacactgtgaattctacctttccaggaggggtcaataggcatgtgttgtgggctgagttttgtctgccaaaattcatgttgaagtcttaaccctagtactgcagaatgtgactgtatttggagatagggtcttataaaaattattaagttaaaattaagtcttcagtgtgagccctaaaccaatatgactggtatccctacaagaagaaaaaattaggacacagacaggcatagagggaagactataagacatagagagaagatggtcatctacaaaccaatgagagaggcctcagaagaaaccagtgctctgacatcttgatcttgaaattctagtctccagaactgtgagaaaataaatttctgttgtttagaccacccagtgtatgttactttgttatggcagccctagcaaagcattgtagcatgcttggattcatccacactctggaacttgtttggtcttgagaggaaaatcgtatcaatgtattgactaagatggacaaaacaatgagaggaaatgttttgggggctcctgaaatttgatgacaagcatgggtgctgtgttttagatttcaacaaaatagggaaagaggataaaagatttggtctgtagtgttactttcattttgttaagtctccagacacccatgccatctgctcatgaccccctcgacacagagttggatttctatgcctttcttactgcttttccacttgcccaggggatcctatggtcattttttccctttcctctgaagggccagaggggcagtccattgctcttctgggcacatttaactgaaactcttgggacactttctctaccattgagtctatttttttgtagccctagcttgggcttggattggttgttgtcttctcattctgcttttgtatttgaagctagtgtcagataacagagtgctcttaacagcattagctagactgctgtttagttagactgatgcagcatcatggatttaaatcgttttctgtttttattccttgacgctaggtctctacctttcattctcatcttttctataggtgtgccattgtgttctaagagatctaaagtactaaaagcaatgattgctatttaaagagtgcctatgatgtgtctggcatttcatattattagctctaatcctcagacctatcctaaaagttaagtgttatcatttgccttttataggtgagaaatgtaagaccttaaggagatcataatgaagccaaaatctgaaccaagttctgatgataaagtacatcattttcccattggtcatgtattttccaattttagtccttctcatggcaatttttcaacttttccatacctgtaatattgtctgtactgttactttttaacatttgatttaaaatagactcaaatttttacctttacatgttttaagcaataggcagttacatgtctgatgcaataattatgcttttaaaatatgcattcaaatgaataaaatcttacacctcattttataagaatatgcattaaaatacataaacatacaagtctagagttaaaaaggtcatccatggagtacctaacattatcttgtgtgttatcaatggtacagatagtatccctgtaaaagaatgcactagaaattgctaccacttcagcaacagaaagaacccagggcatagtccaacacaagccttgatatttcccgaataatattagatacatgttttaagcaagttgtgcagccacatggaagtagctttgtaaatataataaaatctatagctttggctgatggatataaggttgcatactataagcctgcatggcttataccatttttgaagctccattctcttgttttctcctgctgattcttcagctgcccaggccctcttgatattaatatgggaattaggaagccaaaccagggacggagactgcacagctgcacagctgcaggagggttggctctgaaggttaatcaaatggatacagtgcttggtgaagtcagtctcttgacggagacagtggacagatttcagaaatggagagtaggacacagctggtctacctgatgtatcttgtaccagtttccaaaaatattgccttccctgcctatctttggagacagaagttctgctgcaatgaatgcatttctatgacatgcttttcaaatttctagagtcatcttttaggctgtaaataacctgtaatagacataacgccataagtcacgttaaattaacttaaatttggcctgaggctgcctctgtacctcaagtccctatatagcaaactgtaacctaacatgctatgtaaataagccaaaacctaacttggactataataaacagttgagtttcagccaatcacaggcagccaatttatcacaccatggtagtcactcagatgatttgtttactttgcttctgtatccagactataaaagctcactgctaacactgctgggtggtgctttctaaacctccactggtttaagatgttgctccattcatgaattgttctttgctcaaataaactctataatttctctgaagtttttgtttgttcattttttttttttttttttttttttttttttaccagtcactattaatccatactatgctagcagctctaggtggcagggaccattgaagagaagggctggaggagaaagacttgttaaaggttaccaaaaccaaagaaggaatgcgttaaacataatcatctccactccctccaggcttcttgaaagcatctcttcctcaccctcttgcctacaatctcgggatttcccttgttgccaggctccctctgcctgaacttctctaggagatttcaggcctcctgctcgcaagagtagtatatatgcccaatgcaaacaagtcagtatagtctggctatttattaaaaagttaataaaaccttaaaacatattcaaactagtttctagaccaaaggacctaacagtctccctgggttggaccccgatcagagcaaatgtttcctgtttagttctgagtaccatactttaaggatacagcctgtgacagctaatgttatatcaacttggctgggctatcgtacccagttatttaatcatattaattttgctgttgctgggaagatgttttgtaaatgcgatcaacatctataatcagttgactttaaataaagaagtttatccttgataatgtatgtgggacttatccaatcaagtgaaggccttcaaagcaaaaactgtttccctggaagaagaaattctgccccaggactgaagcatcaattcctgtctcagtctccagcctgtcaacctgccctacatattttggacttgccaacaacatataagccaatactttaacaaattatacgagccaatcccttaaaataaacctttacacacacacatacaccctattgattctgtatttctgaagaaacctaataactggagcagccaagactacaaggggtctggaaaccaggagggtgtgaaaactatggtatgaggagtggttgaagatgttgcagatatttactctgaaggaaagaagtctgggtttgacctgagagctgtatacatacatttgaaggtctgaaatgtagaagagaatcagacttgctctgtattgcccaagaaaacagaattgtagtccaaggttagaagttatagcaggcatatctgggatcaatgcaagcaagagcttgctaatcatcacagctgaataggattccttttgaagcagtgacctcccagggaccagctttctaccataactgtgttctgtggaagaaagttagaaaagggactccttgactgggtgagaggaaagacagtgtagcctcaaagctcctatccagctggacagtttcaagaccacagctaacatttctcagcatttcctttgcaccaggcactgtgctcagcaccttatgttcaactactgaggttggacagatgatgctgtaagatcaaatgtataacatgctaaggaaaaatatgattcttggaagttcagtaacatgtccgacatcattcaacaagtagaagcactatgtttcaaacccaggcctgtcagactctcagtgctcccctacagctattaaggggtaaccctatgtggaaaccttttatttactgtgcaattgtaagattcaaaatcacaagcatgggccatgagttgtggtctctttaatctttagcatgtgtcctaatcatctgtttgcttgactcctttctatccaatgtgacaaatccatatgggacagggcaagcccttatttgtcaaagcattgacagtactctttgaaagcattgaatgtattctttcattaaactaacactggttgaccacaggtactagtcatctagggatatggctgcaaacaacataagcttggtccctgcctagtcaagctacttatacttacctgtgagggcaaatattaaaatatatttaaaacattaattgtgtgccttcattaattgcaattgtcatcaatgctgaggaggagaaaagcagagtactctgaaattaagaaaaaagtgggtctttatatcatctgggtctttatccctctaaaaagagggtcagggaagatatttcttaacaagtgtcggccagggtgagagctgaagaatgcatggtactcagccaggtgccgtgtacaataagactctgaaatagaaagccacctggagcactggaagaattgacaggaggtcaatgtggctgacttgttacgagcaaagaggtcagtagcttactgtgtggctgaagaggtggacagaggccacttcctgcactaccatggggaatatgtaatctttttaaatgaatggataaaagatagagataacttactggcttgggacatcccaatcatatagtcctcaaatgcagttgcacatggggtttgtgtggtgtggaatcaacagaggtggccagagactgttattcctagaaagttctgtctgcaaaattcacccctggctggtgtcaggaaagttggatattgggaagtttcccaccattcccaggacagataagagtgacttactgtgcctaaaatgtttgaaaacaatatggtttgtgataaacacatgcattcctcctgggagtctggaattttggtatgtactaggtggagagtggccaatttttactgtaaccagtcccaataaaaattgaggtactcagtctctagtgagcatccctggcagacagcatttcatatgtgctgccatacctcattgctggagcaattaagcacatcctgtgggactcagaagggagatctcttggaagcttgtgcttagtatccttgaacttcaccccttgcatcattttgctttgctgattttacattgtatccttactgtgtaataaacctcagccatgaatatgactgtaggaatcttgggagtcttcctagtgcatctctggacccaaggggagaggggtaatggggacccctgacatagatcctgtgaccccaatgacctaaaagcccatagtgaccatggaatcaaatcttcccctttgaccacagaagacctcagaaatgtggattggaatggccccactgctcccaggtaactctagcctctgcagttgctatactaccctagaacctagaaatatcttccgtggtccacagctgggtaataaaaatttaaagatatatagcaactttcaatgaagactcataataagtattaaataaccacctgcaacccccaatgctacttccctagattttccaggaatatgtcatcttaccttcaggagttcagaaagccaattgtttaatgctctgtggttttaatccaccttccctttattaaaatgcaagatatgccaatgagtctttagggcatttcagttttatgtcttcatattaagccagccaatgtgatggtctaaataccctcctttctatgccttcaatttgttattcaagagcaagaaaaattttatattctgctcattgcaagaacatcaatacaaacacagcataaaaccatacaaaaacagatttttcaaaacatatgccaacttcactacagccagtggagtgatgcttaaaactgctgatttgctttctaaatacttttgtttctttgagcaaatgcaaattcaatatacttactgctatgaatttaatgtatcccacaaaattcatgtgtaggaaattttatcctcaacccaacagtgttgagaagagggacctttaagaggttattaggtcataagggctctacttccatgaatgaattaatgccgttatcatgggagtggattagttatctcaggagttggttcctgataaaaggatgagttcagctcccctcccctctcactcacaccctctcttggccttccgccttctaccacagataatacagcaagaagactctcaccaaatgtgggcccctccacctttgacttaaaacttccagaactataaagaaatacatttcttttctttataagttacccagtttgtgatattgtgttataacaacacaaaagggactaagacactcttgcattctcaggagagaaaaatggcaataaaatattgatgagacaagaactgacatggaagacaaaccttgctttctgaagtaacaactaaataatactgtatctcctatctctagaatccagccatactggtcacatcatcaaagcaatcatcaaagcaggtcttgattcatgtctatcacagcactcaccttcctcccatgagccatttgggaaagtcacaaagctcttaaacctgacatccctgaggagcctggaatgctgctcctatgcaggtgctccttgatggtgatcaatagcttagctgagtacagttagaattcttttatgaaatcagtaaatatttattgggtacctaattcacacacggcacgtgctgtgtgttgaaagtgacatggtccttgatgtttagaaactgtcaggcctggatgtgtaatcgcatgttacaatataatgaaatggcaggactgtgttgttaagtaacaaatgtaaattaatgttataaggtcagtgaagggagaatgccctgtggactgtaaaaatcttcatgggaggaatctatactgaaagatgaggattggagggattcaatagtcagaggcaggagagcatagctaatggagttaataatgagcataaatgcacattcaggagacattcagtagacaaagatggctgagggggctgaggggagggtggctgtagggactattgcaagataaagctggaaatgtagactgagaacacctgagaatgcagtataaaaagactggcattcctcttgctgataaagaaacaccgccaaaggtgtctgtggagaagtggacctttttttccaggtgacatttccagagttaaggtgtaagaagagagatgtggaagagactgaaagtcattgaatagagatctagaaaggacccagaactaaagggcaccatggcatgcctattggaatgagtcaaattaggttggaaacataggaaggggaaaaacaagaaatgtatatgataggcaacatgagtaaacagccaataagaatttgaaactcatgatatggagttcccattaaagaagtttctaaaatatgattttaatactaccctctcatattatgctgaacttctagctcataaccttcatcctaattgtcataaagtaattcttttcggtaaatccttttacctgggaatttattctctcttttgtatttctgatagtgattacaaagtttttcagatttttatgttggcaagttaacactggaggtccaatagtttggtgaagttgttttgagtctcttgctaatggtttaggaagtagaaatgcttggagataaaattgacttctatacattaccagtaaatctagacgtactttaaagagcttaaaaaattgtttacattacacaaggtaagtatcaccatggtttttttttttttagccacagttttacttaatagagagttttcagtagaccagtagactatcaagagatgcatgataaagacatttccccctgtagttttcaaattttatactcaagttcttatatttgattataggcatgagccactacacccagcctcaagtgtttaaaattcagttttctttacctaaagacatgaatgcatgaattataagagtggttatttaggaggaaaagcatgtaaaggtaagtttttagaatttagactgtttgaaactttgaattcacgtcagtcagtagccattttaaaaccctacaatgacttcatgttccttgctttaatgtttctgttgtagtgactaaatatttgagccaaaattccattagttcaattgtaataaagtaatttttacagacattattggtttattgctatcttcttattagcccagaaactcttgcaggctgagattatgttcaagtgtctggggtaggttgtggcacattccagttattcaaaaagttgaattaatatataggcacattaggaggaggcacattggaaggaattagttttgaacaaggtaaattagaggtgaatgtctagcaggagttgattatttataacacactttattgtagctatgggattgggcttgtaagcaattagtttatcagagcttccataatattttatgagtgaaacttgtccaaatctctgtacaatgaacaatgccacaaagttgagttttattgtagaaggtaatagacacttaagaacctcaaagctaatggatgaagaaaacatgttcaatcaagtgggactgtcaagtaaagatgaattttcacgctaagttattaaaaatgccactaattggtttaaagttcctttagcgttatatttctatgaagctctgttctttcttaatactgaaatcattaagcatacaagaacaaaattattccttcttaaataccactttaatgagtgaatcaatgaattagccctctgaacacgggagagttaagggaccatctgtgctgctactgaccagctaatacagtcaaatcacaatcacagaattctgtgactcagttgctcatcttacatttctaaacaatggggccaaaatgtattctaagtatttttagggcatattattaagtgaattcattaaaagcatctattgatgattacagcaaaacataacttacctaaaatatcactcatcaaatcacttcaattgtccaaagcaatcctggtaaccaggagattaaggaaagcaaacaaaatttgtatcacatgtctgtgcactgaaactcatgcattttatacacaagaacacactccactcttcacacagagtctaatttgcacacactttcttatcagctttctaagtccacagtaggagagcagcaacacaatacgtgtgagcctgggcatttctagagactgatatgctagaaaaacaagcgatgacatatggcagtgggatactaagagaagagatcaaaaatccaacaaatgcagacataaaactgaaccagcacagccatctgggacttaagtgtaggggaaaactgctgtctatgcatcagtacttctcaagaatgaggcattgtttatgtaatgatggcccctagtcacccagattgctttgcttcagaaaggacagaaacgtatcacatatttgagaaatgttcctacctatatgtttaaagttagaaaaaataagcttcaaaactttacagttataaattctatcttctgaaacattcactaaagtgaaatacttcatatcttgatgacaataatacctaaacaagatttgacttagtgacctttattattcaaatatcggcaaacttggctatggcatagtttgacacctgagaaatgctaagtttcctgagaaactgagatgtggtctgattttcataccaagagataaaatcataagaaatggattctgtgcagactttccaagaaattgcccattaacttgatatttgaaattgtaaaaaattccatgacacaggtcttcccggtcataaataatggattctataaatgtttgtgaatggggtcgtggcagataggatgcagtcgttaagttgttttaatactgttttgcaacagcttagaacagagagggcctctgatggtcttatatacagagtggggtcacatttcatgttgctgtataattaacaactctgagttttggcatatcaagatgtacactgttaattactgctgactagcactgaaggctgttgaatattaaattattctcttttttatgagatgtagaatcatgactgaatgcagtttattcttcagaccaccttttcctatgtggtctatccacaggttttccccctgtcagtctctcttggcccctgttccctctttttatctagtctcactagtgtccactctttgttcatctctctgaaatcaaaagttaacaccttataagctacacattcataacccatatcagttatcattctttttgttctacagatagaggtttgggaaaaaaactgtttccttctattgattttagggttagtgccacggtaccacatttcaacccatgaaggcattaatacagttctgtcagctcttgaaactcccacatgcataaaagcactccaacgataggcaagaatatacccccacaggcctaaaacctgacagtgaacatgtacagaagtcaagatggcttcagacaaaacaaggaggcaattaacttctaggttccttacactgtgtatagtattttcaaagaatttttttttttaactagcaaggcagcagatatactttgtagaaaatttggaaagtggaaagtaccaagcaaaaattaaattccactattgcatgatccagagataactgctgttgatcttttagtatataaccatctagtcttttgtcattgaaaaacatatgagtggtgtttcttcatttgagaactcatgttgaagtgcagaagttagcaggaaaagactccatagaaagaaacagcatggcacaatgatgaagaatatgggctatgcagccagaatgctggagtttaaatcctggcgaataaatcatctgtttatactttattttcttcacataaaaaaaggatgaagataacaatgacaataacaaaatttaacaataatatcacttactttctggggaaattaggaaaatcaaatgagttaatatataaagtacttaggacagtggttagcataaattaaatgctcagttaatatttcctaatatgaagattgcagttcctggtaactgcatgtttcttgccaagggctcttacttggtcaccttcatgtactatttttaaagtcctcggagatatcaatgaccacatactaagatctccatgttttggccctgtctctgccactaattataatgtaactttggcaagtcattagattgttgtttcatcactggtgaaatcagggtgctaggcaatgttggtgattcttaattgttttgaggagctcagaaactctcttgatgcaacactttgttcatgatttcagggcttccactgacacctggaagccattctggggtgttaggttaagaatctccaacttacatgctctctgatggttcttctggctctgattgtctatggtgtttagtttcatggaaatggccccattcttatgattcctgacctatcaaaaaggggaaagataagttcaggaagcaactcttcttcatggaagatttctctgttttccatcttactggagactgagtttcctaattaaatgtcttgcacatactttcaattcttggtacactcaggaattgggaattcaacagaacttatttatatgctaatttgctacagaggactgtactttctcaattccaaaggaacaagagatactctgcttcctgctttctggcatccactggagtctaaggtggcctgaacacagccagggtgccaaatgccctggaaaacaaagcctggcccagagcaccacaatgaaccaggtggcagtgggaccaggatggtgctaactaccaaacatgatgtcctacacaactagtatgtgcttctagaaactacttacagctgtgtgtcttagagtgtggcccgggaattactgcccccagatcatctgggtgtatgctcaaaataatgattgccaaacaggacctctgtgttacatgctatgtgagtggccatgctgaagttgggcaacctgggataacagtgttctggtgactgactccaagcatactagtgagaatttatgaatgtggagcctaggaatctgcattttcaaaggcatcaaatgattctcatgtgttctcaagtttagaacctttgttatccaaaaccttgcttgtgaacatatggggaagggatatgtcactaagaacacccaatattttagaacttacagtattgcttccatcatggtggtataatatgatccaatctatcagatcttgaaagatagagatgatcatggaagcactatagaaagtctcagagctttggttttctctgcaaattgagaataatatgcctatctttcagggtagttgaagatttaattaaacaatgccccttagactggttaaataaactttgccacatccatactgcagaaaaacatatagttctatgaaagaatgaggaagctgcctatgtactcatattgaaagctaagatatattatgtgagaaaaacaaagtgggcagcagtatatgtagcaccaggtaagatggagtctcactgtgtcgacaggctggagtgcagtggcgccatctcggcccacctctgcctcacaggttcaagtgattctcctgcctcagcctcccgagtagctgggactacaggcatgcaccactgcgcctggctaaattttttgcatttttagtagagtcagggtttcaccatgttggccagggtggtctcaatctctggacctcatgatccgcctgccttggcctcccaaagtgctgggattacaggcgtgagccaccgtgcctggccaagaatgtgtaattgtgtttatatgaaagtgcaaaaagaaatgaatacaaacggttactatgggggtggcatgacggggatagataggacaggtaggaataggagggcctgtatgccaaaattccttttttcttttttttttttttttttgagacggagtctcactctgttgcccaggctggagtgcagtggcacaatcttggctcaccacaacctctgcctcccaggttcaagcgattctcctgcctcagcctcccaagtagctaggattacaggtacacaccaccacacctagctaattttgtatttttaatagagatgggtttttgccatgttaatcaggctggtcttgaactcctgacctcaggtgctccacccgcctcggcctcccaaagtgctgggactacaggcgtgagccacagtgcccagcgaaaattaatttttttaaaaaaggtactttagtgacttccctcaacaccaatctgttctgagcaagaaaaagtaggtttaaagccaccagtctaatactttaatatgccaagttatcattctgcttagtttttattttaatgagtattgaccatgaaattctatttcactagaacagttgccaaaactctcatcaccccaatcagcatataaatcaaaggagaaatatctggtcaaagtgtcattatcaaaatgtatcagtaatttgtttctgaaatgggaggaggaaatatccttgatcagcagaaaacaaaatcggagaagtctataacctactggtgaactttttcatgcggcagggtttctgcatcgattgttatgtactttgtctactccatcaggtcatgaatgatgcatgctgcaacaagaaattcagctatacagctctctgctgctgattgaaacagagaggactgttcaagagcagagaaacatatctttactttgcttttagctctgcaccaggttgtggaacaaatccactgcaatttctgtaagctttgttctctaaattctcttgggccagatttcttatcagatgtattttccttttttaaaaaaaaatctaaacaacacaaaatcataacaagatattttagaagaacaacatttgcaaaattctgagttgctgaatattcactgtcaactgatacccatgcaaataaaaacgtattcactttttttaaaaatgatgaggtttggagaggatgacaggataaaaagagatgtttaatttctgaaattatctttttagtgtggtgattatgtttgtataatataaacataaatctttgtctctgtagctagtctgaacagaaatctaatttttctcatcgtatctgcagcactctctatcctagagtggggctggagcttttttcaacacaactgatgggcttaaaatatacagactattattcagtatatgtcaaaaccataactgctgctttaaaagatttcttatcagctctaaggttgttacaaccctgtattagtgagtctctagagaaaaaatggaatgagtccaatgggacctcatcatagagggcatgggagcctggtgaccttcaatctagtggacagcaaggagccttacaaggctttagtttttagtcttcaggggtgatgagtcaaagagcactgattgtcccccagtatgtaggtatgagttagtttgagccaatgagatgtgagtggcagtcacatgtacatttctgggccatctccttgccttggtctccctgtttctcccttccttgggaaagaggccaccttagaagccgtgttttgagggtaacggaacctcctgcaagccctggactgttcctcaagaaagaaataaaacattcttttatttgaggcactgtatttgggaatcttttgattacaaaagtatagcctgcaccttaactaataaaaatggcttcatataagatagtgtttaggaaatgagcttagctgtgggtaattaagaatgcctggggccataaatagcaaatgatgagagattgttagaaggctatctacatgagactacaatcttgacaatgaaatgaataatattaaactgcccagaaaatcaagaaatttacaacagggaattgtaatccacatcccacatcctttgctaaagattcctaattatgcaagaccaaattagtgcattctagcaatctttgtccactgacttggtagtagagtgattagagatatggaacagaaagagaattgactttagtgccaaacagagctgggtttgaatccaactctgccacttagtaaatatagggtgctgagagattcatttaacactcctgaacctgcaatgtaagtggagatactaataaccgcctgtgacatgaggatgcaggtggagcctctagaacaggatgtggttcacatagagggaatcaatacacttcaggtctttctctctctcctttactccttcaaggagacatcacagaagtcctcttagtgccaggaaagtaaaaaagaaatgggtaagaggaacaagtaggaaatgggattcagatgtttttggtactgggtctcttgattaggtattgggtggtagaactcataggcccagacctgtaagagatattttcagagaggagctaattgaaaccaaagtcataaaacatatgtccatctgatttctttatataggaaagcccaaacatttcagatctagtttccaggagtttatggaacaccttcattgatggcaaattctacatttttgagatttctctatttgtcattacagttggtcagcatcaaggccacagtttgcttttagggtggtcatgaattaatttttttaagttaagatagttaaacctatcattatttctacaaagcattttgtcttagatttgcctatttatatttccctgtgagcatgtctttccattcatctcttcgatagttaacacttattaagcacttaccatgtgccagatctcccatttaaatcacctagtaaatacaatattaactcacttaatcctcccaataacccaagaggcaggtaccattactgccccattccatagacaggaaaatgcaggatagatggattcagttgtgggtccaatatcacacagttcttgggttgcagaatcaagagctggacccaacccgtctgactccagagcttgtgcagtaatagtgcctaaaataaggcacaatatcatgcattgttgaaggccgaaagagtgagggtcgtaatcaactcagtataccactggaggctatgtgagtaaacagcaaactgctctcacgaaagcaggatgttggaaaactgacaaactgcatctgctgcccacaaggaatgctgagggcagtcacaaccaaggcacaagtgtttcttgtgattagacacatctgaagcctgttagcaataatgtgaacttgtgatcaattaagcagctgaccagtcattacctcctcctccctactctttctacccagtaaaaaagaagggctgaagaagctcgaggtggctgcctttgctcactagaagcagggagccatcttccccggccccttcctttaaaacagtttcctttgtcttaagttttcatttctgtgttcattcccctttgttcagtctcataacgacagtctcaagtagtaacagtagtaactgtcgtagtgatggtctcaagtagtaattgtggcagtcagacatagtgcatgaaaacaaaaataatactaaaacttcgaacagaagactataaaagcagaaatcaagtcataaagatgagaatgaacgggaggaggagaggtgagacttggaaaaacaggcttaatgcaagaccctaaatttgagccaaagtcttacttttgaacttcttggctatcaaggccaaaaggaaagtaggacatgtgacggttcaaactacatagtaaaaggaagaccagtagtctcaaagaaaaacatattgtatccttcttagccctttatttaattttccagttctgagcttgagaaagtgtagaagtctcatcagtgattagttcctgacaactatctaattactttaattttgctggccagagatggagcttcagctactgctgatgttccaaaatgcccattgatattttcttgagtaagaaaagcaagctacaatattcctccctgttccattccatagattatcaataaaaaaaaaacccaatttatttagaaaatgttatttcttgcattgcgtaatattaaagcacagagctttgcttttcaagctggcagcttatatatgacaggaacgccatgatgcacaaattaattatttaattaaaaaaaacagaaaaatattgctgagataatgtcaagaaaagaatgctgaattttacagtggtacaaaggcatttatgattatcttacttttatttccctgggtagttatttaaaaagctggaaaagcactaatctaaggaaaaggatatacttctatcatataaaattattcaaatttcaactttcattgctggatttttttctgtataaagaatacatcttttgattctattaaattggagcttttcagtcataataagtaacttcaagagttacaacacgcatttttctctgactaaaagaggctagcggaaccatgattattgttaacaatataattcaccagcccgcaattaattctattttagtaactaccagaacaggtaaggcatatatggttatctcttatttaaattattgtccaaatattttactattttccgtgcataaggcaagcagtctgtgcagctgtttctcatagtcttttaccctgataggtatctgaataaaccagttactaaggagagaatttcctgttaaagatctttgcttattcctgttcatctaatatttattttatgttttaaaggagaaaagaatatgacttggggtcattttactctctgactttgaagagttgagagttttggttttcttgggccctattatgttaatgggaacatgggcagcagacttcagcatcagattcccagtgtccacatcctgctctctctttagcgaggtattaggctggtacaaaagtaattgcggtttttgccattacttttaatggcaaaagtacttaacaccctcctgcttcaggtacttttctatctaaaataatgatgatagaagtttcttcctcacagggtggttgtaagcattaaaagagatgacacctgtaaagtactcagaggagtgcatagtcatagtgaaatattacatagtacattctcagtaattattcttgttgtacttattactaaaaacatagagacctggcaattctggatgcaaacagaattcatcagtaggtcactgtgttcatttaaggataactcttcctgggaaaggctaacttgaaataaccctttttaaggagaaaaaaacattttatcataaaaagtgagggtgaaaagtttgaatgagactttaaccaataataaagaaattcaaattatggaaataatttattttatgctatatgtcagaaatttaaattataattacatctatatgctgacttctagaattcaacaattctagaagtcactgtcattctagaagtcattgacttctagtcattccacaatgactacattgcacttgttttgttttctgatttgttttaggtttttgtttctggttggttgcatcaagattattgatattcaagtaattcaattttgaagagtctatccttagatttcttttctccttcaattcttgactcagctaactcaaacagattatcatttgtttatggctttgcacaagattcgagcctttcaccaacaagactgccatcagtgaaatttcacatattgaagcatttccaatttaactctgaaatttgtttgcattgcattttgttctgtgtttaagtagataagatgtcaagtggagggggttgagtaggggctaatgttagaagtggtcagctcatttttgaatatttgtacatatctttacttctctatgcaaacttgttcccatgtggatttcgataataaatcctctgaaaacaactatcccctctcctgtgctatttggtagactgaatttaaatatacgtctgttgtatctttaaaaacctataaacatttgcacatcataagtcaagctttacttgaaaaagccatctaatgagcagcttgtgagtcataagtaaatcacaaacaatagatacctgggccatttatctaaataatatttgcgcaaaagtaaatattaaagcaaaatgttttcttattccaatttagggaaaactgtaactctattggcataaggtttataataggatcttgatgaacagaaatactgtacactattcttaattgtaatgttcatgtcaacggagtgcattaagagtaaatattagctagaaacatggtaacttgttcctctacatgaaacacaaacaggacagagatggaaatcactggtcatagcaaaaggaccaaactttagtcccaatccttgatttttttgttgttgtagttttatggtttcattgagatatatttaagatacagttaagtaccaactgtacgtttacgtaaaacaaaccaatgaaaatgaagaatgattagaatgtgcgggggagggggaacaaaaagacataactagtggtgggctggagtctgctcacacaggctcaggagagctaattgttcagttttcggaaattttgcaagacggctgtttgttaaactgcggtcagctcgaaatcagacacaggagagtatttacaccatgaaaccagaaaaacgctatgaatcagggattttgtatttttcagagctggctgtcaaacatttactagcatattactgaattttgtaataaaaaccatgaactaatgtgccacagaatgaaactgccatccctaggaagagaaaagctttcctctgctcttgggttcctggattgggtggacagttcttggcagcagccatcagctgggaaagggagggctgccacgcacccaggaatatacctctgccagtcactgaagatcagtgttctgctgctgttagcattcgccacttagcacgatgaacaacaccctccctcttccatctcaaaagcgtttgacaagattgtacctttccctgcaccagaaatcaggggagaaaggcagctgagttgggagaggagaaaagctggggaaaagctaatgtcctttcctcaacctcatacaaatctatatagggttctcaatatcacagctcttgagctttaaaaagacagcaatgctcacggcccatcttggaaatgtgaattgtatctgtggctggatcccaggcattaggtacagtgtgattgagaatcactcacaaggatcactgaatagagcaaaaactagactacaaactcaaaggcatcagggacctgccttgtttaccatcctttctctaataacagtttccagggcatacactttttcaaaaacaggagaatcaatttccctgagattcaaacacacattttctacactacaaacacttggcctaaacaagggtttcttacgccattaacaggttatagtctttcttccctttcaactccaggctgtagagccctctcctgtagaggttctaaatcctggccatgcactaggatcaaccaaataaattcatacacctaaacaggaaaatacagattcctgggctccttctctaacttcctgaatcaaaatcccgtattagtgcccaggaatccaggaatctacgtttcgaagtttccaaataactcagaagtacttctaggtttggaaatcactggtttaaaacaccagacactaccaaagcccatcctccctccaaagattactgaaggggttagggacaaacgttattacctgttggccagttcgcaaaactctttctctaagcttcatcatttgactcatcatcacacactcctcaatcccatttcaggtcatctctttctcacatagatatacatatcctatgtgaattcatttttctttccactctttcttccaggaaacagtgggtgtatcactttgttctgaattgtacataaatgctataggctagaactgcaagatgtttgaagtttgaggtaccaaaaagtactataaacatgagttcctctttagcaacaccacacctaactgaaagcttctcacctgtgctcctgtaacacccgtttttacccacactctgcccgcactagtggacggtagagaccgtgaagacagagagagaggcatgcagccacactcacctgaggcaggtatacacaacaggcactataggcactccatatgtgcttgataaactgaactacttattgttgctagattctatgtaaatcagtttcctttatactttcaatatgttataacatattaattcaactcataatcatttgtttttgtctttttttttttttttttcctatctcagcacagtttttcaaatggtagccaaccacacaagcttcttggtgtacagctggctggagtatactggtcaaaaattttaaatgcagatatcttttgagctagcaactccgtctctagaaaatcatcatacacatatatgtgcgcttgtgggcaaaaacatacttgggaggaatttttgtattggggaatttttaaaacaatattgtttgcaaaatagtacagataaactgcaaacatctagaaaccatcctctttagatgatttgttacataattaagaaacatctttgaaacgaaatatacagatatgctaaaaaatgagacagagaagggtatctttgtgctgatatgaaattttctcctaggtataattttatgtggaaataaaggaagatgcagaacaatatgtaaagtatcttcccatgtgtataaatacacacttttgtttatacatagtaaagtttctagaaagacatgaaaggaatttttaatagtaattgcttcttgggagaaagcatttggaattaattattggtgatgagatgttaacaatatttttcatggaatgctttcttatcctctaaaatttttgtcatggcctgtattacttcttcaattaattatgttacaaaaattttagaactcaccataattaaaaacagagttttaaagtagtgagtcttgtatgcatagatgtaggtataacattttgttaaataagcattttcaatgttaaagggatcacaaaaagcatcttcccctaataatcttgctttttaaatagtataagagtctctctgctggcaaggcctaatgagtataaaatttagactatgtgcctagaattttagctaaatattttccaatttcatttcaatttagagcataataaatgcagaaagaaatcaaatcaaaacaagaagctaagcagatacaaaggtaataagtgccatgactgtcaccttttctgccctggcatcctaggaagctagtgccagtggtcacagcctgctttccccactgatcctggatgcaacctcagaatccttctcaaggaactcaccaccagttgaatagaatgagcactattttttttttccatatcagacctaaactctctaccttcatacctgccttgaattcttggggaggcaggggtgacaagctgctgtgttgaggctagctgttgcgttgaagattgttctgtttgcacaatccaaacatctcaaaggagagagaatgtttgactatatctatcagagttggtggctggaacttgggtaaaccactagagtaatgcacaagatgagaaaacaaaagtgctctctatgggaacaaagtacctcagtttgatctatggacagtggcaagttgcagtttagagtgaaggaatgattgtgagggtagcattctgtgctgttccctcaggatggcttctgtcataaggaacttgtgccaatctttaaaggaaaggtgtgctgtaataaagaccaggccaaatcaaaactgtatctctggaggtgtgtgatctcagttaagtcaaattaccagtgacttccaggagatttgtttatttatttggtaaagtacctgggtgtgaagcagtgatatctaaagtccctttcatcttgcatattcagaactgtaccctctggttggagataagctggaaagtaaatagttctttattaataatgcatatgagtcttcccaatggaatgtagtgcttggttgtgcaaattgcatccatctgcttccctccagctggcttagtagtcaacagggtttgtcggagagtccaggggatgtgctcaccaagtggtgcaagtcctctttctggggttggattagaaaggctcctatatcctgaaatggactttccgcactgcccacattacccccagtggtcttctggtcaccttaggagagctcagaaggacttaaaggagaatctttgagccaggcatggtggcacacgcctgtaatcccaggactttgggaggccaaggcgggcagatcacctgaggttgggagttcgagaccagcctgaccaacatggagaaaccccatctctactaaaaatacaaaattagctgggcatgttggcggatgcctgtaattccagcgacttgagaggctgaggcaggagaatcgcttgaacccgggaggcagaggttgcagtaagccaagatcgcaccaatgcactccaacctggacaacaagagtcaaactccatctcaaaataaataaataaataaataaataaataaataaataaaataaaaagggagactttgttctctacgattcccagtctagtaattggaacgagacaacagtaacactaaaggatgctagcaccctaatggtggcaggacccatagataactcggaaaagttttagctatagcttccgtaagctccccaacccccaaccaaaccaaataaatattacaaagggccagtttcaagggtgtgccaaccatgcattgcaaagatccccaaactaagaagggaagccttgttcttgggctttaaaacactgtagtagccatattgacattcttagtaagtttattttgtgatgtggattctgtgtttgagggatgataggacaatgaggtaaatgccaggtccttggagcctaggttcagtggcagtcttatctcccactgcctccttgggatgaattcctggtcatccccaactccaactctacccagcaacagccctctccccaagtctctccttcagggtcctaggtgcactcagctagtaagtattcccatgcttgaggaagtgcaacattaaatagcaaataaaaacaccatgacaggttgagggagatactacagaagaaagaaactttttttcccgctttctgaataaggggcctgaatttttgttttgcatcaggcccggtaaattatgtagtaggtcttgtgtgtacacagtaagcatgaacgtccttaagtccctccttccactgggatggctaatgctaaactccttctatatacacattctggaatcaactgtgtacctcataaggacagtaccaaaaagcaggagaaggtgaggggagagaataaaaatacctggcttgttggaggtaggactgtccctctcagctctcatcttggcaagtccaagacccccctctcctcgctcccacctcagcttcctggatgtgacgctaaattgacatttatcaaattgaaatgtactctgcctttacaagtataaagaggagcaatggctataatatgtcaacagactacctggaaagacaggatatagtcacagagaatggtaatgaatagtgaacatgcaaggcaatctgtggacctaattaggaaggtgggctctcaaggaagactgcctggattccactcctggcttatctctcacaaattgtgtgaacttgtgcaagctgacctcagtttcttagtgtgctcatctttaaaaaatgggataataagagtggctcccttagtaattgctgagaggattaaattcttacattggtgcccagcacgtaaaagtgcttattcaatgttagatataaaggctcaaacaagggaagttttttgagagacatagaacagtcaggaaaagatttgcaagatgccaagacaagaatcctttatggaagatttttatggcgttactaagaaaatgtgactttaattttggcagaatatctaaataaaaatgctttatgccattgtttgaaattacacacacacatacacacacacaaacagacacacaatatgagcccttagaaataagaaacttggtttaactacatgctttgtatcctatttctgaaatcattaccctctgcttttcaaatctcaccgagtcttgttttggcattaagcaattctaatgaaagtgtacaaacatctgtcttacattctggctttttcttagcaacattgccacttggattcattggacttacaatttatgataattataagtaagataaaagccacatttacctacccaccaatcttttattttatttttttactagcagaactgtatgtcctcgcacagatgtaacaacctcaatgtttttaaacaaatccatattgaaaagaaagtagaaaaagtgaatctgactacaaatgtttacatgtagcaaatagactttttaaaatatcaatttagttaagtgtgtgttcagttatcagtcgaatactctcaactgaccccagcgccaatctcaaatcttgtaggaatatatcagatgtatgaagtgcattttccttggtagttactgaaggcaatttgtttgctttagatttgattatgtagtggtcattgctaggagtaaatgcacagatggccaaatagctgatgttgaaaataaaagttaggaaacacttctcatgatgccaattttcctcacactcatgacatgttgtctttttagcaagactgtatcattttactgttctgtaatgtcttctcatgtaatacctactagcataaggaataaagggaggatccccctaaggtaagttagagctgtgttctaacttcattctaggtaaataaagggaatctatgtttgatgttaagacataagtcacaaacactgttaaatgatagttcacaaggtaccttaacttctcagaactttttgtgcaaagaaagatgtgaactacacactccataagatgcattctattctaattctctatgatcctatcgttagtggactaaattatctcacacagccttatatcctgtcaaatcaaggttgttactgaagttaaagtgatctacatcaggaaaaacaaatcaaatggttaatgatgtaaccaagggggtggttttaccaggaacagtgcttctgtggtgatagagacacaccacaaggagaatcatgtaaaaacacaatagatattaagttttacttaaactgtaagagactttagaatagcaaaaaggaattgtacaggcaggaacagaacagataacatcttagaagacaatttgaaaaagtctttacatagagattgatatggagatttctagcatgtcccaaatagagaaatattttaaatatttctatgtgtgtgtgttccagggaatagccttcatttaaatgatataatgtgataggtaatgcatttcacagaacccactgagagcttaaagacgtatgagcctgaattccaagtgaatctcttggaacatacagagattgaaatggctgagtgactgtgtgagatgaaaataatttcataagatgtaattattttcagtctcataatgataactaccatttattgagtgcttatcatggatcaggaactaccctggatgatttacagacatcatctcgtgaaatgcttacaacatcacagtgggaaaatttaatatcggaaacaaatgttcagaaaggcaagcaacttgcccaaggttacaaggctggtaaatggggaattaaaacccaagtctgactgatttgaagccagtcctcttcccgatccttcatcctgcctctgtctgcattttattggatgagccagtcttaagagccacttattctgaaattgcaaatttcacaatgctctgactatacactaaaatgttttgatggatgggaaagtatgaaaaaaggggtgaatatattccttatttttaatgactattactttatgcattaattatttttttgctgtaatcagtaggcctgtacattaaagggcatttattgtaaccagtgttgcataaaagtccccaaaatgtattattatgtacacacacacacacacacacacacacacacacactgcacatatgtatgctaatgttgtgccaggtactttctgaatatctcctatgattctcatggcaaccttaagaaactggcagcctgtatatatatgcagtgtgtatatatatctatatatgtatatatagatacatatatatagtttttaaccaactttttcttccaagtagtagtgaaatatattaaagtcagtaaatttcctggcatagggcatccgaacatactttagaagatttatcttagcattgaaatcttgaagtgaagtgatgtgtactcagtctatgtgggagacagggattctacagaagaaggagatttttgaaagaagggaagaaggcaagccagtctttggctccaaggacctacaatgtgctaatgttgtgataggtacttcctgaatatttcctgtgattctcgtggcatccttgagaaatcggctggctgatggtagttgaatagatatgcttggtccagtatatactaattttaacaatgagccacgtagtatatttataaaataaaaactgctctaagaatctgtaattgcacatggcttcacatagccaatagggaatgaattagtaatagcatgaagtgatcttgggcatgaatgagtaaatgttctgtgacacctacttcttggttttaaaaagatttattctgactttggtaaagtttcaggatacaaaatcaacgtacaaaaatcagtagcatttctatacaacaataatgttcaagctgagagccaaatcaagaatgcaatctcatgtacaatagccacacacacacaaaaatacctagaactacatctaaccaaggaggtgaaagatctctacaagaagaactacaaaacactaataaaagaaattctagatgatacaaacaaatagaaaaatattccatgctcacagattggaagaatcagtatcattaaaatggccatgctgcttaaagcgatctacagattaaacactattcctatcaaactgtcgatgtcattttttgcagaactaggaaaaaaaaaactattctacaattcatatagaaccagaaaagagcctgaacagtgaaagcagtcctaggcaataagaacaaagacagtgacatcacgttacccaacttcaaactatgctgcaagtctatagtaaccaaaacagcatggtactggtacaaaaacagatatgtagacccatgtagcagaatagaggacccagaagtaaagccacacacctttagccatctgatcattgacaaaatcaacaaaaataagcaatagggaagggactccctagtcaacaaaatggtgctgagataactggccagccatacgcagtagaatgaaactgaacccctacttttcaccatatacaaaaattaactcaagatggattaccgatttaaatgtaagacctcaaactacaagaatactagaagaaagcctaggaaacatcattctggacataggacttgggaactaatttatgactaagtccttgaaagcaattgcaataaaaccaaaaactggcaagtgggacctaactaaactatagagcttttgcacagcaaaagaaactatcaacagagtaaacaggcaacctacagaatagaagaaaatattcgcaaacagtgcattcagcaaagttccaatatccaaaatctataagcaaatgaaactattaaacaagcaaaaaacaaataaccccataaaaacctgggcaaaagacatgaacaggtacttctcaaaagaagatacacaagtgaccatgaaactaggcaaaagacatgaacagatacttctcaacaaagagccaacaaaccatgaaaagcagccaacaaacatgaacagtgctccacatcactaatcaccagagaaatgtaaatgaaaaccacaatgagataccatctcacacccgtcagaatggctattactaaaaagtcaaccaacaacagatgctggcaaggctgcagagaaaagggaacacttatacactgttgatgcaaatgtaaattaattgaacccctgtggaaagtagtttgaagatttctcaaagaacttaaaataggactaccattcagctcagcaattccattgctggttatatatccaaaagaaaacaaattgttcaaccaaaaaaacacatgcacttgcatgttcattgcagcactaatcacaatagcaaagacatgaaattgacctaggtgcccatcaacagtggactggataaagtaaatgtggtacatatacaccatagaatgccacacagccacataaaaagaacaaaatcatctcctttgcagcaacatggacacagctacaggccattatcctaagcaaatgaatgcaggaacagaaaaccaaatactgcatgttctcactcgtaagtggaagctaaacattacatactcaaggacataaagatggcaataataaacagtggggactactaggtgtgggagggagggaggagggcaaggtttgaaaaactaactattgggtcctatgcttagtagctaggtgatgggattattagtatcacaaacctcagtatcatgtaatatactcataggaaaaactaaacctaaaataagagttgaaaaaaaagaaagaatttttttaaaagattcattctcattttttctcctcttctcagcaaccttaaaaaatgaggtataagtctagattatcataatggaccactgacataaattcattgcttagatttagatgcccatcaccaaccagctgaagatgtctttttctccattcatgctgaaaatctaaccaaaagaggtcaaagtatcaaagacctgcatatcctgtcaggataagagggaacttcaggttgatggagagtaaagtcttctttttctaattggcctggttctctgttgttatttcattgcagtgcaaactttctatgcaattcagctgttcctcttcccttgcagaagctgaaaactgtgcctctgcctaaggaaagaatctaatctgccacttcactactcataggaagagatgggaaatgtgatgaatatttttcagggtgatgctaacttaatattctaggcagagctaggagtaggttaggatgagtgaggcaccatttcatgtactttgcactgagaattagtgcctcttgaaatttacactctcggcacttcacatgcctttctctagtcctggccctgatttgagaagatgagaattatgcctgagcattttatttccttatgaaactaccgaatttcctgctgcttatgatctcaatagccattgactccaaagtctctgattcttgaaaatttttggacaccattgcttgtctcttcgtggcctcaaaaacttttatatatctctggtgactgggaaattaaagccagaccctcatccctcagcaagaactttttaacccaatcttacttttcagccttatctcatatcctattactattcctcgatcccatctatgcccatagaatagcttttcgccttgctacttctagccttgtgtccaagttgtgatttcctcttggaagttttactctctttatgcttatactgtgcttatacaggaaagttcaaagctgaattcaaatcccatttcctgggaaagatcttttcatatcccaccaatacaaattcatttttttcctcttgttctatcactgccttttgtttatgacattgagcaagcataaatcttactgtgccttttatttttaaaaaattatttccatttatgtctgttctatgaccaccctttgaactcatggagggaagattctattttgtttgtcttgatacccttgtagaacccagcagtgaaactgcatttggtgggccctcaatatatttgtacctcactgcatgactgggtacattctttattaatgtaaagtgtacttggcttaataagcttttggcaagagaaaggaagaagcagtacaagtttatttccttattttaatcagcacagtagatttttaaacataggctgttgcatgtttagaccaactctactgggtagaaagactaaaaaaacacttctaactaataacggacttcagcaagaatacatggtataattgtactttgaaaattataatctgcatgaatacaaagcaattaagtattagaagttcaaatatttggaaagctcaaaatatgtggacatgatgtcccttgaattcaaatgttgataggaagaaattgcatctattcatccaccttaacccttacattgttatttatgctttaatgaagtgtttattatgagtccccattgtgcttgatattgggctaggtgctagaaatacaaagaggatgaaaaactctgttctttaatgagctcttgtcaacaatcagctacagtaaaaaacatgtcgggttacagtgattcctcagcctactatggaagacgagacacttgagacaagcactgagagacagaagtatttatgaactaatattacgcagagtacagaacacttgattatacccgaaacgagaaaatggattttgggatggaagctgctcaaatagattttgaaagttgactggggcatttgcagatggcaaggaaggaactgcattttatgaaatgggaacagtgtagagaaatacctggaagcctgaattagcttgttgtaccctcaaatctagtatatcatattttaaaagactgacacaaaatacacttgggaaccaacataatctttagacataatctaatgacacttaaccatacaaactaaactacttggttaacaaatatttccaaatatacatatgctgcttctctctggctctagactcaagctaaataacattacttaattgtagaaagtccaaaactgtctgtgcctaccaagaagccaattgacattactaggtataagaaacagaatttcaaaagcgtaatgaggtttcctcatttttatctagttcaaggtaacataattagtatgtggatatacatgaggtcatttccagctgtaaaattctgtaaatctgcttcattaaactttcctttttttgaaagactctccatgatccattggttttggatgtcacttcatccaaactttttattcacacttgcacattgagttgagatgataatctacttaggcagagaggtggaaagagagggagaaaagggtataatggaaacttggggtggtgaggaaagaggagatagcttctgatagaagctctctgttttcttctttctctagtacatatctctgaaaaataatcatggtgctatattagctgctctccagggcagaaggcaacctcaaataccaagccaagcttgtaaatcacatatatgcaccatatatatattatatatatgatatatattgtatatatcatatatattatatatgaatatatattttatatcatatatgaatatatatttttatgatacgtgaatatatattttatatattcatatataacattatatttgcttatagtgttatatagtttgctatatagtctctatatcactataaaataaaacaacttttgcaaaagtgttttataagctccaaacatgctatacaaagatagagcatacatggcaatatatacaatacatatttttcttagatagcgtttctacctccatataagtagtctagttaaggagagaaaaaagacaataacagactgtgtctatattatctgtatcttcctttatatctcttgaaggtgtttctctgtagctagaggcatctaggtactacagagccagaaattgatttagaattttttgtcagatgtataaaataatatttggacaatgatgtgaaaaaaaaaacaccaaagaatcataaaattatgtgataaatatcacagacatttagaataaaattgggtcttggaaatcatataatatactttccattcagtccaagagttagcaaccataaccatggtcttcagttctctgatgaagacacccagagatagaagaagctcagtgtctcgtgaggaaggccactcagcggatgtcctgagcatcctagtgtttgcatctttgaggtcatatcctgaaagcttataggctgccatcagagagaggagctctacatcagggtgtccaatctttcagcctccctggaccatactggaaaagaagaattgtcttgggccatgcataaaatacactaacacttaagatagctgatgagctaaaaaagaatggcaaaaaaagtaataatgttttaagaaagtttacgaatttgcattcggccacattcaaagccatcctggactgcgtgcagcctgcaagctgtggattagacaagcttgccctacattaatacaggacagcatagggcaggggcggtgtctgtggcacagtagagtcttagcactctgggagttactgggaagagataaacctaccttgatggtgaggggattgaacaaggtcttgtggagtaagaggcatttcaagctttcaaggacagattgaatgtagacatgtaaagtagtggagaagcattatggacagaaggaatggcatgtgccaagggacagttgctaagaagactttccttagctgcaaactgtctctctgaaacatgcagcaactattctactatgcaagaaaacataattccgtatctttaagctagttctcacaagcagatgaagttgttatgtcccttttccttgatataaatcttctcatccaacaatttccagatccaccaccaacctggtcaccctccacatcatgccctcatctgtatcaaggtgtcccctaagagacgcttcccagactgttgcagtgctctttcctcttgccttggccagtacaaaagcagtgggacaacagcttttcttgctttgggttatttctgttaatggaggagtccggcagcacagactaagtcactgtctctcaaactgcacttaagttcaaagctggctctagcagtcatccattctatcatcttagacaagttatttaacttctccaagcctcaaaattttcatttgtaaaataagaataatgactacctacttcatgggattactttcaagattaaatgaatatttaaaactatttagtactgtgccgggcatataggaagtacttaaaaaatgttaggtactattagtaatacaatcagtcatatgtagtgatttttaaggctccaataaaattttcagacccttgatttatatccacagtaggacatttttcaactcctcccccaccatttatttttaacaggcttcataaaatttactgcctttttttctgttctaaattaaattgtacttaatgttgctggggtcaggagcattactacctttggactttggcttgataaggaacaacttgagatctcaaagcttaaacacaccatgcttaccattctcttacagacaagacattttattctttggtatgctgacagcttttattaacagaagttgtattgattatgttaaaggataaagaagatcaaatttctctttatggtctttgtggtggttatctatttttctgctacccaaaattcctttcacccactgctggtaaacgaaacccaaacttttaaagaaccacccttctctcagtcttagtcattagctggggaatccatcccagttcagggttggagaaggtaatatagatgtaaggggtcagggcactgcctaccccttacaacagtggctgtttggatttgccatgggacttctgatcagaacctttgaaatacaatgatatgaatttggagttgttgccgttaccttgagccacaagaggggatcttgccgagaatgaatacaacgcagatccagggagagaaacccaatatttagcaacattgtgcacctgaagccaaacaactcctggggtttccagttactccaataaatttcttctgtgattttaaactggttgagattgaatttactgtcattttcagcttgcaaccagtcatgtctaatataaatgaaatcaccagttacatgtattgataaagaaaatcaatgatataaaccctagaaaagatcggttttcgagcatcatctagtatttgaaagcccatagagaaaggcagctttgactattgtgaatgattaaggtatataggagaattttgtttgggtgccccaaatttaaaatatcataatagtcttggtttctagctatccaagcacaagcatgtattatttatattatctttgtatctgtatcactacatcatcagtcacatctgtctatacataaagaaacagccacatcggtttagtagttttcattctaatggatagtgagtctcttttaggggtcatgtcttattcatttgcaagcttctagcccagcctctgacagagatacttaataagtactaaaatgaaacaaataggaatctgttgctttggcctaaattgcctttatagagaaaagaaaaggcagaggtgttgatggctgtaaaatgggagcacccctaatcccagagctctattcaaatagattcacaacactatgaatggtgccctctggaactctgcagtggagcaacctgaataaagtttttaaaactatacaaaagaaaactcactgattaccaattttcataagtatgaggagacatgaatttattgaaatttaattgtgatttcttgtaaatttgtttttctaatagcagtaacactaacttcttcaatttactaagcatagatttttttttagcttttctttcttaatacttaataaattgtaaaattaactcaattcgaaattttgggatctggttaggaaggtatttaccaacaataacaattagatttctttggaattgttaagaataacaaagacagaatacattaggtattcaatttcttcctgctgtgattctaaatttctgattccttaagcccaacatggcaacattcatttaaattgacaaaattaatatcttctactttttggtcattgttataatgtagctcttacattaaatgttgtgataaatttatgaatgtcacaacatagacattcatttgtttaaaaatatttggttgcctcccatcatgctacctaacttcaaattacactaaaaagctacagtaaccaaacagcatggtactggtaccaaaacagatatatagaccaatggaatagaacagagcactcagaaataccaccacgcatctacaatcatctgatattcaacaaacctgacatgaggaaaggattctctatttaataaatggtgttgggaaaactggctagtcatatgcagaaaacagaaactggacccctttcttacactttatacaaaaattaacttagggtggattaaagacttaaatgtaaaacccaaaaccataaaaatcatagaagaaaacctaggcaataccattccggacataggcatggggaaagacttcatgactaaagcaccaaaagcaattgcaacagaagccaaaattacaaatgggatctaatcaaactaaagagcttctgcacaacgaaagaaactatcatcacagtgaataggcaacctacagaatgggagaaaatttttacaatctacccattagacaaaggactaatatccagaatctacaaagaacttaaacaaatttacaagaaaaaaaaacaaacaacccatcaaaaagtgggtgaaggatatgaacagacacttctcaaaagaagatatttatgcagccaacagacatataaaaaaaaatcttatcagcactggtcattagtgaaatacaaatcaaaaccgcaatgacatatcatctcacaccagttagaatggtgatctttaaaaagtcaggcaacaatagatgctggaaaggatgtggagaaataggaacgcttttaaactgttggtgagaatgtaaattagtttgaccattgtggaagacagtgtggcgattcctcgaggatctagaaccagaaataccatttgacccagcaatcccattactgggtatatacccaaagcattataaatcattctactatgaagacacatacacacatatgtttgttgcagcactatttacaatagcaaagacttggaaccaacccaaatgcccatcaagatagactggataaagaaaatatggcacatatacaccatgggatcctatgcagccataaaaaagaatgagtttatgtcctttgcagggacatggatgaagctggaagccatcaatctcagcaaactaacacaggaacagaaaaccaaacaccacatgttctcactcataagtgggagctgaataacgagaacacatggacacagggaggggaacatcacacactggggcctgtcaggggtgggggtggggggcaaggggagggagagcattaggacaaatacctaatgcattcagggcttaaaacctagatgatcagttgataagtgcagcaaaccaccatgacacctgtatacctgtataacaaacctgcacgttgtgtgcaggcatcccagagcttaaagtaaaatttttaaaataaaataaattttaaaaaaaacttaaaaaaatatttggttgcctccatttgccaaccattgtactaggtgccagggatgtaagaatgaaaagaaaagacaaagtccttcctcttgtagaaattatttctgacagaatttagaattgaaaatttgaatcgtcttctagtcctgcatatcctcattttattctctcgactgcttctctacttcttttctatttctatatgttgtgttctgttttagagaatccctgtaattccatgagaaatagaagaggaatataggaggagaaaattattgggtaagggcacagattaggttcaaacctcagctctaccatttactagcagtgtaaaatctagctctataaacttaattttcttatagggaaagagagcaatcttatatataagtctgttgggagaattgaatgcattcggtgcataaaagtatcacacacagtgcctggcacagtgactactctgtggtacatcagatattattataagggtaggtactaaaaatcaaactgtgcctctggtttaatcatttacatcattaaagaaaaaaaatccatcctctatgatcacagaatacacacactcgactcggcaatataatgttgatcttatgggatacagttagggtttacagcaagggtgagaaaaaagacagtcataaggctctccagttttgaaagcacgcatagctctagaaaggtctaagtcctcttagcatactccatccaaaacaaccactttgtattcagaagagcagccatatcatccccacagatgactatctacaaaatggactgtaatccaagccctgggaaatgccttcgtttttaactggaatagggatcacaaggcatattactatttccctttttgtttcttggacttctgagtgtctgattacatttggctgttaaaatttaagtgaacaaaaactctcctgtttttactaacaaaatatttgcttattaaatgaacgcagaaggggtaaaactgactccgtcgtcatgtataaaagatgaaaccattttttagattcccttctttttcttctctcatgaaagaacatgagattgagaggtgaggtggggcacgacgggagatcctctatttaagatcttgcagtttcttatgagctcttaccacaaatcttaaacaggtagaagactaaattacctcttaaagaatttgaggccaggtgcggtggcttacgcctgtaatcccagcactttggaaggccaaggagggtggatcagctgaggtcaggagttcgagaccagcctggccaacatagcaaaacctcgtccctactaaaaatacaaaaattagccgggcatggtggcatgcgtctgtaatcccagctactagggaggctgaggcaggagaattgcttgaacccaggaggcagaggttacagtgagctgacattgcgtgactgcactccagcctgggcagcagaatgagactctgtgtcaaaaaaaaaaaaaaaaaaaagaaagaaagaaaagaaaaaagagagaaagagagagagactgacaaaatttccatttacctgtattatcttctaatagctgtaaagatttatcccttcttcacccagatagctaccagagacagagtggacatggagttttcatcagaaaaacttataaaatcacaattctcttcatctatgatcacataggtcaattgtaaaaatcaaagtgagtctgtggttttgtggagaccaccttggctttatccatttaagggttaaacaaaggtgtttattcaaataagatattttccaaaattagtttttcttgtttctggaggacgaagtatgattttaagtgaagttaatgtttcaaaactaagttcatttgctcccatcttaaaatagaccagtgatcagaaaaaaaatgtaaattcagaacaatgttgcaaatgctatacttccacccagaattgaaacagcatagactgtgagtccctcttatttcaatcaattttgatatctagttgcctttaaaaaaaaaaactactaaaaattgctgaaactacccttctaggacctgaaggaacaaggtaatcatgtccatggttaaatttttaattgaaagtcattagaataatgtgattctgaaaatcagagacaaaacaaagaccacatactatgttgcctctgggtgctatggagctcttccagaggcttagagagaaaatgagacccagtcggtgacaagcttagaggacttcccaaatgactgttggaacccccatcctgtgagcgcatgcacacacacacacacacacacacacacacactctctctctctctctctctctctctctctctctccccctctccctcaaataaaatgttgaaggaggtacaaggtacaagaacctagcatggcactggcagattttatttacctggggtgttgcaatcattatctgtaaacaaacagtccttcataattaaacattaacttccacatccacttaacagtggtggtcaagtaaatttatgtttctgaagcttctgtgagtgaatgggaacagactatttggcactatttgcaagaacataaaaattcagaattcaaaaataatcagaatttacctctagaacagctgctggagtctatctgatcatcccatggcagtcatttcattgatcacatgtatcaccctggctcaaaattgctggtgcttcagagaagaaggtgggggaagaaaccaattcctgtgacctatttggccagcgcccaggcaacactagcggtttcctatgtccttcccgactctggcagctttcatggtttgctgtcagaaagactctaggatgggttgctttataatgtttgtttgttcctttttataaaaatgctctatgcttattaaaaaaagagaaaactcagaaaatatataaaacaatagaaatggtttgtaactctgtcttgtagtgatattcagaacacttaggatatatggtatatatattaggatatacagtacatggatatcctaactttaggatatatactgtatatacaactggtgaacattttatgtatatatacacatgtacatacacatatatatgtagtatatattaagggtatgtttaatttatgtttgcatagtatttacacttaatattatgtgcatttaacatatttatatgtgaaaatatacgtacattttttagtttaaaggttcttccaaacttctcttagcttaaaacttacttatcacagagaactttctgatacttccaatcctgtattcctctctcattggcaccagtgaatttcctctaaaaccaaatatattccatataggaccaaaaaaaaaaagtcccactattccagcttatgtgatctctgcaatttatggcttaaaaatagctataaattgaattccaagtgctcaacagtgccatacagaagagagatgattatctcaacatcctaggtgacaaaatcaccaatcagtggttttaaaatactttgccaacagatgaaatacttccagtttcatccaaaccaatagatgttggggccaagaggaacttgggatgtaactagcagctgccaaatatcacagatggcacaaagttagagacatgtggaaaggacaggatctatgattaaatctgtccagcaagggaaagatgtagataagaaggttcctaaaaccatccaggactctcaagtacatcctgccatgaagaggaaaagaaaaggatgcaaaaattcacccaataccagcatgtatttgatacatgctcaggccatgggaatttcactgtgtgacaatagctgtgcagtcaacactgggccatgtgcaatctatttacttatctcttattagcccctttattaggaccatgggttactctgatatctactactgacacaaccccaaacagaaaagtaacaaaaagaaaatgaaagcaaccactgagaaataagcagtaaaatccaacaattctcagtgtgaacctagtggcacctcaacattaatttatttagtgtgtaggaattaatgaagcctatttttacatcatctgttagctggagaccaaacttgaagagaggtaaaggagcagatatgtgtgtggaaacagagcaagccaggctgctgggaagttcctactggtgttttccggtttaacataactactttcacacactattcagctgagtcgcaatttatacaatgctagtaagtagtgagtatatgcagtggtgaatgctcccctatcatccaagctttgttaaacagatcatgttatatgtggtcttgcaaaatcacttagcctcgctagacctaaggataatgaataaaattggaccagatgaccagttacattcttttcagctctaaaattctagataactcccattccctgaccacactggcctggaagtggtaaatgtatggatataattgtagcataattctctatttataacctcaaaaactggaagattactcctccccctcaagtgttctccaaaggtttcttggagccccctggaaatttcagtggccagtgaaacctatgacagcattttgcaaatgtcactacatccagacccaccattgagggactgatactcatgcctccctaggcattgctacacttccttctctcccagagccatcagtatggtgtcattgccagactgggctactcacacgaggaggaagtgcttattccctaatactttggcttcacaccatgacactgaagccaaagcaatattagctgatgtcttagtccatctgggctgctacaacaaaatactgtaaactaggtggcttataaaaatttatttctcacgtttctgaagcctgggaagttcaagatgaaggcactggcagatttggaatctggtgatggtccactttctggtccatagatagtgccttctcactctgtcttcacatagtggaagatgcaaggcagctttctggagcctcttttgtaagggcactaatatcattcaggagggctctttctttatgacctagttacctccccaaagattccaccttctaatatcaacaccttaggaattagaatttcaacacataaattttgggggggtatacacattcagaccatatcagtcagtacttgcaatatcttagacactttatagaaaaagagctctctcacgtctcaccattatatttaactcataatcctcgcctcctttaagtgtacagggtaggtacaatgttatatgccagctcacccctcctctctgttgtgagacttttttaatgattcaatagcttgtttgtgattttacctttagatgggttccccccctcaaaaaacctggggcaagcccattatgccaaccatccacatgccaggatagaaaataagaaaatacaacttatgctcaacctgagatccattctatacttgtgttataatgctaagctttcttttattcattcaaagttaagctctttatgttactttatttgatcttaacaaccctagaaaggaggtgtcattattactccctttacagatgaggaaactgaggtttaaagagagtaaatcctttacccaaagtcagcagttattgagatgagaccagaatatgcagtgtaaccccaatgactatgatatcctacctccctattgacgtatactgattgttttatgtgtttgacagtgtgctgtagtctcttatttttacaatgaaagaagttgtacatgccttcattttagaagtttttcctgacacagtctgacttcagatcttattggtcacatctcaagggatagatatatttctgtttcatcatgttttacaaaaataaattcttttctgatttttgattctgatttttagatctcaaattttaactccattgattaacaagtaatttaataaataaatatttaatcaactacaataactcaggaaaattttgttagtctctgagggagatttgaagatgccaagtcaatgtctttaccctaaatgagtagacaatccatctagcaataaagatacaagcatgagaagataagaaaccattgaaaaattagaagtaaaggatgctcaaacatccagcctcattccttcactctcaggaagtgacagcctctggaggcagaaactctaattttaaatcccagctcatcacaacagttccttcagtctaattaaccctaggaataattctagttcccttaactatgaattatgaggatactaacccacactcacctgggaggtatatacaaagtaatataagtaaaatgtataacatactacctggcatacagtaatcatttcctaaatcttaactatgattatcttaagatgattaaagcataagagtctccacttcccttccttgcccatcagaatccttgtgcctctaactgctctgcctttcgtctttgaagatgaagttcactccttgcccactgacttattcaacgaatatttatattgtacttcccattagacttctcctttgcaagaaaacccctttgccttacacaaagtaaatgcttaataaatagtagctgttattaaatttgaatgaatgaaaggaagcttagagtcgtaacacaaatgcaccgtggatctcaggttgagtgtaagttacattttctatcctggcaagtgacatgacttattctttcttcttcccaaatcatggtagcatttttaatctctctttctctacttgctttttctcatgtatctaaaacctaaataaacctttcttctgggccatgccacaccagatgcccacctgctaggttatctctcctccactgcttattctctcgaaataatacacttactgcctctacttctgactaactcatttactcattcattcaggaaacaaatgagcatcagtgatttcaggattgatattgtggaataaaccataagtatctctgctcttgagacatgatctctgctcttgagatggttgtggattttttttcctcttaaacacccacaatacctccacagtcagtcgctcttgatcaaacaaatcactcaacccaagtcttctcttagtcctcactgatttccttcttccatggaaactaatgtaggaaaatgtgccaaagcaatctgaaatgattattaagactgtttctaatgaccgaagggaaggctgaattttgtgtgtatgtgtaagtgaagacagggctaggagagtacagggagtacaggtaggatgggatgattaattcccaaggatttagttcaaactcagttaaagaactctaaaaattggcacatagctgtgttgtcaaaggtgaatatcacacaaaaagtctttcattggaagcaatctgcacaggaaataaacttaatttcttcaaggtaatgaaaaccaaagacatcactttctatgctgtaaatgcactctttgtaggccttctgacccagtttagtgactagtttaatattcaaagagtagatatgtcctcttcactttagaaagtttgatgtttgaagacaatttaggtcattggctcctgtgacagcatttcccctgtgagaaagctacatttaagcatccatctcttgtattattgataacaaactggtaaaggccatgaagtccaacagctttgtctctgggccattcagaagaagcaattaaatcaaaactattccagctttccttttagaggaatacctctgtgctctgaacaccaaatctgtgaaggtggagttccagcatgcttttttcttttcaaatatattttaatcatcttctccataccaaagcaaaatcagaaatgacatcatagatacattaatttttggctaatcacataatcactattaccttggtagaaaataaaatgtgttctttcagatgcagagcaaacacagctttcctccatgcttcttactcccatgattttgaaaccacccgtcctggaatcaccattgtttctatgttagtctagctccacttgggatttctaagggctgagaatgaatttttacttgtcattgagtttctagttcctagtccagactttgtcacacagctgatttctgcagatatttgttgaacacgttttcccctaagaacatttcaaaatgttaaaatgtaaaagttcgaactactgagcattgcacatgaagtccttcctgtttctggtcctagcttatgctacactgcctacttttccctcatgcctactttactcaggtaccctgatcaacttaaaatcactcaacatgccatgcttcttcacaccacactgcttctgcacatactctttcctctccttggaatgtcttttatttctttctttccttattgaaatcttaatcaccttttagatttgcccaactcaaatacaatcccttttatagttaactttttcctcaagcaaaattagttgtttcacacactgctttcttgaatatctggtatgttcttctactacatttttattagaaagcaatatgattaattattcatgtcaatttcctcccattagttggtcagatcctagactgtaaagattatgctattttcatctttgcattgctaacgtaacacatggagcttgaaacatgggacatggtcaaaaatatttattggattgaattgatttctagttctgagtccattacacatatatgctttgccatttcctgataaaccagacatatttaccttctttcaatatttgtttttgaacagaatttggagggataaaaattttttttagttaatcaaagaagttgctttttagtttaagtaaaaaccactatctcaaatcctttttggcataagattcatgtaaataaataaaatggatagtcactgtggtcattttaaaaggcccatcctcaataaattacatgctgaattgcagtgtttgaaactgtatcaaacacttgtattatttttctcccttgaattctgattacaaccaaagtaaatacccctattatgctttcttattgataaaaggaaagaaagttattaaaaatagaatggaaaaattgaaagaggaaccttagaacaaagtattgagtgcctgctctcttattacctgagtatcctgtgaaagctagtctctcaacctgctgaggtcaaaatatgatcatttgaaaactctaccaagtaaggtctgagattttagaagtcaaagttgaaggaaaaattaatattaaatattggtaaactgtgtcattgtgatatttaaaatttatttagaggagacaaaaaatatctcactgactacagagtcctggaacaaagagggcagaacaatgacccagtaagtcttcaaaatcactcaaggtggtctaaatataactgattaaagaagtaaatgtggatggatagggagataaagcatgttcccaaagactatcttttcttcctataactccacagaggataaccacaattacatacaagtttttatctccagcatgcagtatggcatctcacgcatagcacgtacctggaacatttttttgaaggcatgaattcatgaatcaacttatgacagactatgccctctttctgaaatgtggacacttttcatcaaaaccaagctctgtgaaataatggagcagatgatctgacccatgcagcaatcctttttttttttttgagacagagtctcgttttgttgcccagaatggaatgcaatggtgcaatctcggctaactgcaacgtccacctccctggttcaagcgattctcctgcctcagcctcctgagtagctgggactacaggagcgtgccaccatgcccatctaattttgcatttttttagtagagatggggcttcaccatgttggccaggctggccttgaactcctgacctcaagtgatccacccaccttgggctccaaaagtgctgggattacaggtgtgaatcaccatgcccaccccatttagcaactctttatgagtgaccactactactaatatggacacattcctagtggcacagccaacattttgtaaaacttcctgatgttaacttcagatagttaaatgtatagcctactttagactgattttccttaaaacccatgagctaatttgcttttatttacaacttgtagcattatgtttcaaaacagcaaaaacatatcgaatgcttctcatgtgtaagggcatattctcagaactataggtgcattaacttatttcaccacagtgaaaagtaattaatattattaaactgttcctgctttattcaacctgtctcaatcacaaattcctcatctgaaaaccagagataagaaggcttcattactgaagattaaacaacgtataaatcatgcatcttagtctccaaccacaatagtaactcaataaaagttaattttcttcctctctttgctcaactttacccgttaagttttttttgctgttgttattgcttttaaaggtatttctgtatgagaaatttaacatcacattactcattagggaaatgtgaattataatcacaatgagaaaaagctatacagaatggctaaaactaaaaaaagaaaaagacaatgccaactggtgagaatgtgtgacaactgaaacgcttatattgtatgttaaagggagtaggaaatggtatgatcattttgacaaactctttggcagttcctactaaggtcaaacatatacctactctataatccagcaattctattcctaggtatataacaagacaaatgagtgctttgtccaacaagaatgttcatagcagctttattcacaggagtcccaaatgggaaataacccaaatgtctactaacaggaaaaaagataaatcagctatgctgtattcatacaacatatgcacagaatgacagactgaagaaaatgaacaaattttaggagcttgttgagtggaagaaggcagacacaggagtgcatattgtatgacttgacttacacaaagttctagacaggcaaaactaatatagagtgtgttttgtatactttaatgtgatggccaatcagatgtggccatgagaggaggcacaggagagactcaggaaaacaaaggttattatcttcccaagtcctagagacaggaggcactgtatgccatgcagggtcacatgggaaaaacaccagggtggttaggaggcagaagacgggagctacaggacagcttagaccccagcctttgctggggtttcctagggaatggcaaggcaggcagggtaatcatgttaggattggctattctgaataatttcagtggactgtaagctatggggtggtccctagttgcctggtacctggccttgggatgattaaggcagaggaatattgtgtcctggggtgtaagggccagatagaagaggcatggctctggattgttagtttgtatatcaaagccatgctcctggctaaaccttgctatctctaagaactggctagccctaggagaggcgttctcttctcagccagaaaagtcttttaaagatgtcaaatcagtaaaatatgcagaacgtagtacgtgtatacacacacacatacaatacagtgatggaaatctgacagtggttaccttgggtggtagtgattgttgtgatattaactggagaaggtcattaaagaactttctagggtgatgccaattaatacgtcttgatatgggttgtggtcacatggctgattttttttaaatattattgagcttacagaaaaaattcacaaattctactgtaagttatactcaattcaagaaggttttcttgatgatgttctactgttcacttaagtaggatacctgttagcagcttttacaggatggtggaggatgactatactagaaaagtcagtttagatgtaaagagcagctatccggaattcatcttggtatttattcaggacacatctgaaaacacatgttttccttttgctcagtgatacgccactattgacaactgcaaagtaatgctcatgatatgatttggatatttgttccttccaaatctcatgttgaaatataatccccagtgttggaaatggggccggggggaggtattttggtcatgagggcagatccctcgtgaatggcttggtgccctccccatggtaatgagggagttcttgctctgcatccacagatctggttgtttaaatatcctggcacctcctccctcactttcttgctccctctctttcctttgacaggcctgcttccccttcaccttctgccatgattgtaagcttcctgaggcctccaccagaagcacatgctggccccaagcttcctatatagcctgcagaaccatgagccaaaataaacctcttctcttcataaattacccagcctcaggtattcctttatagcaatgaaaatggactaacactgctcactattccctttgcctaacattttatagctgtccagagcaaaagaaagatgttcttgccatagctcttgtttactataattctcttaaggctgttatcattctggatgaaaacattttaaaacgtataaaacaggataaaatgtttctccacaatgagacagtttgcaaagttgtttggatatggaaaatgagtttgccagggggtacaaaaaagggaaagaaaagtgaagatccctcctacagtgtaaccctcttaatagagcatcctgcagtggctgagcaattcccacatttaatgactaatgaatttgggttcgcctctgcatttgcgcagctggggacaatggtgctgtctatggagcttctttgaggcagagggtgaggaggtggccacattgcacttcaacttgagcaatgtaaactaggcagactgttaaacaagaatgagctgtacatcaaagcagtatacattataaatatacccccaaccctgcacagaggcagtccctcacgccactctcttcagcccactccacccacgacgtgcccctctacttcatacttcattcccttcaagggagttcccactgtgagcaataatctctagcatgcgtccttgcctttgcctgtactgcaccactgtacttaatcctgaatagttttttctgccccttcttctggttggtatctccttcagtactcagctcaagggttatcttttcaaggaaaccttgcccatcttcccagcctgtatttggtgtttctatccctgctcaccaatgtgaaaacatgtatcaagttatattgttatttccaatttctttgtctcctcaattccaatattagctccttttgatcaaaggcctgttcttttcgtctttgaatttctaatacctagcagagtttctgacacttagcaatagatgattgtagaatgaataagtatgtgaagagtaaatcagttgggggtgaaatgttaattttatactgctgttttgatgtatgaattgctatacacttaaaaacaaaacagtgctcatttgactgttttacatttgtatgaactattatccttcagaaaaacttcaatgaaagcaggaacattctgttgaaatattaataatcttttattctgaactcctttaaacatggttaatttttcaaaaatcataaaaattttttaccccatatttagtttactgtgacattacttccaaacaatgtgctattttctttcttttttcaaggacataaatttgggatgttgcaatttcagtcaaccagaagaattgacaaagcttgtggaaccttttgtcagtggtgaaaccatgaacaatgggagcaactcaagaaggcatttacggggacatctgaacacatcctgccatcttagggtggaactctaaaagcatttcttcatgatttcaatatgttcctccagtgaaggagagtctactacttattccagactctctaagcctcttaatcagaaatactgtctttatagtatacctaaaatcagattctgtagttgaactccatttcctcttgttatatattagcaaaaggtatagaaaaattgtttatcattacttgcagagtgaaatcatagttttagatcgcttgccatgccttctaggtctgggtagattccagaaccattaagctattatgtgtgtaggaagttcatgctaattgagttagtgaagcactgtgcctgcatccttgctaagagaggctgctcccctgccatatcacctgctagatgaatgggtctaggtggccatttttaaatcttgtgactctatttctctgaccagagctaaataaacaagggtcgacatatcaccaaaccttggttaatgagattttccataggaaaatgggagaggataaactaaggagacagaaggaaggcaacttcgagattacaaggaactaggcactataccaagtgttagcagaatacagaataatagacgaagctaacttacaaagaaaagtataaagtagatgggccaagagaggcagaaatgagagactccagggccccgtaacagagaagtctgggtccctgtggctgtacttcatttcagtcattggtattttagaggttaactttagaggaaaatttttatttaagttatcatgagttgattaacaattatctatgtgatagttaatgttatatgtcaacttctctgggctgtggtgcccagagatttggtcaaacattattctgagtgtttctatgagggtatttttggatgaggtttacatttaaattggcagacattgagtaaagcagattactctccattatgtgggtgggcctcatctaataagctgaaggcctgaatagaacaaaaggctcacctcctccgagcaagaaggaatgccagcagactgtcttcagattttatctgcaacatcagctgttcctggttctacagcagactcgagctaaaattttctggctctccagccaacttaagctgcaattctctcctgagtcttcagcctgctggcctccctcatcagcttttggacttgtcaagtctccaccactgcataagccaattccttaaaataatctctttcaatatatatatacatcctactgcttctggtttgtttttttttttctggagattcctgactaatacaatctacaataactccaaagtgaaagcagttgcacatagataacatgcatcccctgagtctagtttattacaaaagactccttgaattctgttaatttgcattgcatcacttttgctttattaagttgaaaggaacggaattcatataaactgcataccaactatacgcaaacacaaacatattaatttatgaataatacaaaacagtatttttattatttcaatttataatgaaagacactaagactcagaaaagttttctatcttgtcaataatcattttgagaattggccgtttcattctttttgtagtcaagtacctagacaatctaccaatgtttattattaatgcatgatataactctataatctagttgggcctcagatgaagagagacggtaacaggggcaaatacaagatgcagaggactgcagggaaggagtttggaattagaaaagtccttaatatgtggcttaacctatttgggccagaatctttttacctataaagaggagtaactgaacccaccacatttgttcacagcgttgctatgaagctcatttcatttgatgtaaaggaaagtaccctgtaaattgaaaagcacctttcaaatgttaagcttttattatcatttcattttcagtccctgtacatttcaatatatatatttttgtgaataatgacatattttgaagaactgagactgcatcaatttttttagagggagaacaagtattctcctacccctcataagatagcccaccacacactgctccccaataagcacgaacgatttagtctcaatttccctcagacactgagcagtttcaagacaaataggaacatccaaatggcttttccgtcattcctaagtaaattcaagaatgttaaaggtggaaagaaccttaaggatcatctcatagttggcaaactgtggagcacaggccaagtaccacctgcctctcttgtgtacagctgttaagctaaaaatagttcttacattttagaatggttgaaagcaatgaaaattagaatattctatgacattcgacaattatatgtaattcaaatttcgttgttcataaataagttttattagaaaacagctatgctcctttgttgtgtattgtctgcggctgctttcatgcttcgatgtaatatgaattgagtatggcagtagaggctgcatgacgcatagagtagttacaatagactacatgagcagttgcaacagagggtgtatgagccacaaagcctaaaccagttacattctggccttttatacaaaccttgcctaccctgatctaaccttattctctcattttatagatgagaaagctgaagcattgaaagataaaactacttattctaggtaactcagctaggatattaattaatgcagaatcaattaagagctgaaattccattttttgtccgtttgatcatgctgaaattaatgactaaaattagctatagttatactcatctttaaattatatagcttgcttgtataaatgactagattttatctcaaaatctttgaatgctcacatgagctaatgtcacataaaaatttgtcttgagaaagtgaaatattttcttcacttattcattgaaatgaaatgtatattgcattgttcttaagcagttctaagtagaagttattacagaacaaaataatggtaaaaattaaacatttcactggataaccatcaatcaaactgaaaaatatgctctgcttttgatttaaaaaacaacatatatggaacattcaaacattttcagacaaattggttacattcgattttcttacaagagatgattgacaataagatgagaaaatgatttcttagtctgtgtttagtgaataaaactggaccagttaatttcccaaatgtaagctaaatttcaatttcttgtaaaatgaaaaagaaagtgtgtctaaagttaaagcattcccttcctatcactaggaagtatctcttgggattccagcaaaatcaattacgtacccacccgttaatatctattttcaaggggaaatgtttaaacagtgttgccaactgggggtgatttttcccctcgcccccaaaggatatttggcaatatctggagaaattttgtttttcccaatggggatggcatcgcgggggttggggggtgctcctggtttgtttcaatagaaacctgagataccaataaatgtcttacaaagcacaggacagatgtcccccacaacaaagacttattaagccccaaatgtcagtagtgttgaggctgagaaatcctgttttaacgaaacatcattaggctagcccaaagctttcaacgaccctgcaaacttatctgccaggtcctaaatgttcaagtgatcctttatttgtggactagcacaatagagcaaatatttcttatggaagcctatatgatagctcattctttccaatattttcttctagcgagattatcacagagattatgccagcaaatagttatttgccttctttccagccacatgtattattgatcttaaccaacaaacagtagcataattttctaataattctgatctcttccataagcaagttattttgactctgatttattttttccctgtaggaatctgataagctaagatttctatttgaccttgatccatgatacatgatatagtaaaataacctatgactaacagaaaaataaatcctaagtcatatttaccttcaaacggaaacaccaaaatatttcagttgggtagagcctacacagttatctctagacattttccaaagacatatttagaggataaagcaagggtggccccagcaagtttaacagtacagtttttcttctaacagtattttatctattttacaatgtaacccagtcaataatattaaaggaaatatattaacatatgttagatcaccatattaagaaataccttttctccaacatgatgaatagatgagataatttttatctctcactttctctttcagtgtatattatcaaagcagatatctggtgctacctacaaagattcttccttgagtacatattttattctgggtcactttcactgagcacgaaatattggtttaactccctaactaatcttccaacttggggaatcgatgaactaaatcatctcaaggtcaaggtattctttaatcacaaaaaaattaccaagaccctataataccatttggttcctctgagtagcaacttcagaacactaatcaaaaacatagttactcattttctccaatatttacctattcagatataattcatctaacacccgagacattctaggctctctgctaaatgctacacacaccaaattgaacaagatatgattctcaacttcaagaagattttcaaaatgagttggaagagctaataataccacaacatgctaaaagtaaagctagaaatacccactgatgtttatggacatgcaggagaggcgagctttatctagcttagaggattcagagaaatttttctgaactcatcctacttacctgcgttgagcattaaaatatgggcagggttagctaggagaaggtctggtgcaggttttccaggcagtagaaataagtcatgcaaaaaactcagctacacggaattccatgatttgaggaggggaaaaacaaggtaagaaggcagcaaagtaggcagaggccagatcaccttgggtcttgtattccatgccaaagagcttaggttttattctgcaagagatgaggaatcactgaagaatgtcaaacacagcagcctcttggtcttacttgcattttaaatggaccattctggtggctgtgggaaggatggatttgaagtagacaacactggaggcagctgtagtattttgggcccaagtaaaagagagactgattttgggaactaggaatagacagaagggggtggaacagagatatatttatgaggaaatctggcagaactgattggctaattacataaggatgggagaaaacaaggcaaaaggcacaaacccaggttttccagtttgggcaatgtggtgaatgggtgatcctagcagttgggagatagtatagaggaaaaggagcagatgagagggagcttgcttgattcagcaatggccacttgattagggcagcagttagacttaatgtgctttctctgctgcaaagtttttctgcctctaatcatgaaagtgtacagtctcctaaagtaaacaaagagtgagtctgacatgccatattttctttgaatccggaatactacctatcgactacacatttttggtatctaaattaggtttcctgcatgatcccttaaaaaataattataaaagtcattcaatgctctgtgagcatgagaactttaaagatgtggatacattttgaatctatataaatgtatagagagatactgagtgctcaatttttaacaataaaaatgagatactgaggcctggtcatgccagagcctaattttaatgagccaacatctctttactaaagcattacactttagaagcagatattctcaaatgttaagtgtgtaacattcatctgggttgtttgtgaaatccaagtttgcaaggtccacccaggggtttaacttagtaggtctatgtgaagttactgtcatctgattctatcatagatagtcttggatcacactttgagaaatactgcttcaagtactcattgtgttggataaaactttcttcatgtaagacaattcaatatgtaaaatgtaggaattcttcctaccttccttatcagttatctattttatctatctatctacctacctacctacctacctatgcattaaaccttgaagaatctttacttatttgggagaaaagaaataaaactcatcaatgatatccctacactacaactcctatgcatgtccctctgaaaatgaagtacagaagaaccaatagttagatctgaattccgaaaggctattaaacacaaatcttctgtgtgataaacataaaaattaagtgtgcccttcctagagattttgttatacctgaaccaccccaccccagcagtcacagcactgtatttttgccacatgctcaagagccaggaaaattgtgttcattctatttttttcatattaaatatttaatattaagcagcatttaaaaaattttccaagtataaaattaattgtaaatataattatgcttttccaaatgaaagccctaaatgttctcttcctcctcctttctgtccagaatcgttggttagtttttgaaggttgtgcggtggaggtggttgggttggggagtctagaattatgggcatcagttatggctgcttcagcctttgccccaaagtgaactggccacttctcacttggtcctatcacataccttggaatctaagggacatgcccttgagtgaccactgcaagcccaagggccattcattatagcggaataaagaaagggggcatatgtaggatgttccagaatcttgaccatgaagactatttttaggagctctcgttcacaaccatatctccatctaagttcaatagcatagaaaattctgaaatttcacatcacgtgactaaaaattttcatgaaaaaaatacagagaaatgatcatacaaacagaaaataaaaagaaatagggaaaaacacttcttcagattctatcatctagaactcagagcagggcagctgaactcaatttacttctctttctgtcaatgatctttcatgattacattctgaaaatctgagaactgtttacttaaaaccttttgctcccactgtcgactaacacaaaatctgttcttcccagataccagcatcagaggggccgctgaattaagtttccatccagctcagctgaatctatggcagcttttttcaacgtggggtccttccaagagctctggacttcagaatcactggcagaacagtgaaaatgcaaattcctgaacccaccacctacctactcagtcaacacctccgagagtgggccctgactatttgcttttctgacaagctccccaagtggttctaagcattcttgggatttcatatatctttcatgtgtttgttcattcattaaacatttgttgaatacgttttgttggtcacagcctgtaaaactctttttcatgctagataatggaaagggagaaaaaatatgatctgaaaattaatttggagccagttgaggatacaccaacagaagagcagaggggagggtgtggaaccgctgctgggtaggcagagtcctggctccctgcaggaagtcatctggcaggacagcagggccctttccccttgagacagaccttgccagggacgttactgtgcctccaagcatcccagagtgcagtggcccctggacttggatgtcccagccatttcctcctcactccccagtgaccacacattttcattcttgcctccacaaaaaaggtcatcaggagacagaactctccagagagacaggagggtttcttgttgcctcaggaattttccttaggctgcctgaagaacatttcacaaaaaggcaagtcacatggttcactgttcagcagcctgagtcgaagccaccatttgatacacaccagaccattttccctctctgctgggttttagtttggtcccattttcttttattcttttctttttttcttaaggaaatctgaggctggcaggctgagatggaaagatggaagtttcttttatttgtagccattaaaattctgcctaacaatacatcatgttttcctaaaagcagtttattcttcaagtttcccatcttcaagtcacttcatggaattagtccattacaaatatcctggccttgcttgccaggattcactgatatattcacctagacataataggtgtgcatttcctctcttgtggtggaaatttaactgttgctccctaggatgtggctgagtaccctgtccaggctaagcaaagtttctggtttactgacatcattctacctcctttgtaaagattcagaattttagatgtgaatgggacaacttgaacatcataaatttaaaacacaattgaaacaaatttcaacataattattccttgaagagtttgagaacaccagagggaaatcagttcctggaatgcctgaaatcaactatagaagacagaccaaatacatttggttatttggatcttactttgcttcagagacaatagaaagaacattggttatcattatatggaattatagaagtgtaaaacattagcacttgggcagaatttgtgctgatctgataacccaacctgatcattgctccttcagttaattcccttgtgttacctactttaggtaatacttctgtatcacaaagagaaaggataaaaaataagagtttgggcttttgactagattccccccaaaaaaaaaattaaaaagggaatttactatgtaaaactctacatagttttatcagaaggcagggtatataacaaaaatacagtgacattactgactgaatagtatttgcttcaaagaattctgctatcggacactccatggggctcatcctcattaatgagatgagtgagataaggaataatattctttacttttgtcagtcctactagagacaataactgaaataccctttctagcccgggaaagaggaacttccttctcaggatcttaattcttagatgctgggaccaccagccaaccctacagcaaagatagaaactcagaagttatcctagattcctctctccaccacaactagtccatttagcaaggccctgtttattttaccttcattacttttgccttagccaggttctcatcaattccccaggcctctaatctaatctttcagcttccagttgcatcatctcacccattttagacactacagccaaagcaactatacaatacctaaatctggtgatcacctcgctgcaaaaattcttttaattgcctctccctcccccctagtttcaagataatggtcaaatgctgtagcttagcagacaaggccttctattaggtgggtgaaaatgtaatcgtggtttttgccattaaaaaccttttgcaccaacctaatatgatttaaacactgttgtttacccgtttccttcttccattttaatattcaattctttcagtccaaatagacaacgttcttcaatgcccaagttgcatagcaggcttcggacactagatctaaatccagtcaagacccaaacccttcattttaaagaagacatcaagttacagaaagattaagtaatttgcccaaggtcacacagctggttaggaacacagtggaattaggacccagtgtccaggctgacttttccagaatataatttctttattctatttctgacattgcttaaagtgagcaaactcatatgatttctcaatataaaaatttgaaagtcttaaaaatgatactaatcatttggtcttcattaacacactgacttaaatatctttccaaaatctgtcacaaatacagtgtccccttctcccaatgcaacccatttttcagaagccttcccttcagtaagttcgccaagacttcaatacacagaaagctctctgccctaaaaataatcttcgaattcaacatgttaccaaaataaaatcttccaaataaaacaatggcaaagatagacctgataatgaatatgaaatatgctaagaacattctgtcactgaaataaacttgactttttttgtgattaatagtaagatgcaatcttgaaacacataagaataaagcaaacgacaacagaagagaaatgatgtagaaagggtcccatttgaaatttacccatttgaaaacaggctctgtcttttggctatcatcattgtgtgcctgtccagaaattcatttccaagttttatttccaaatgcaaccccaaattcaaaatgtgagtgtgttggcatgttcaaaaattgctctgagatggacaaaacaacaaatgagatgctttcaggaggaataataagtacattccaacactcattgggtttaattcatacttcagatatcggccttccccttctaattcttttgtatcctgtttctattaggaaatggaaaataaggaaataggattatgaagccatttctaaatattaacgtgataccaaaggaagttagcaaagatacacacattttcaaggaaaaggatagaaagggaaattggcttgagtccagtctgtcagaaatggtgactgatcagagtttagctaaatctaatcaagccatcaggacctacactgcatttactgacaggtaggggcactgagagagggcaggtcatattagaacaatgcttggaagaggaataagcactacctgttgaataggagaattggctttgttaccttaagatttcaataatctactggattcctagagaatccattcatcaaattaacatagtggtggtagtatggagggaggtggaacaagagagagaagggggaggaagggagggaggagaaagaaaggaaaggacataagaaatactgttattaaatatttcatttctagattaagccaggaagagcatttaccaaaacatgcaaattattattcatgaacttacattttactcaaaagataaaatggcaagaatacataggaactagcaaagcaaacacaggaatccataggagaaacatacaacaatccataggaaaaaaatacatagcattcacagccagagagtggacaatacaattgctcatataccaaagcagctttgctttctttctaagtattgctgaaagaacttggtatgactttatttttttaagagtttgaaatgtgctcaatatctgaagtctcagaagatagctatgatctttcaaaaatacagatgtcatttgggaaaaaagttctccagtaaggttccatcctgtcttttagatattgaaaaaatgggaaggacacacagtaatgcactttattcaataaattattacaaagcatcactttaataaaggatggtaagattgagctgtatgccaatgaaagtatggctgtagcattaacaatgtctcctgaaagtatggacagcactttcagttaaaaaagatgacagaactcactctcctaaaaagacagagcttcttctaaaagaagtacctcaggtaggtacttctctgctggttttgtgactagtaaatgaataacattctccatttaaaaaaaaactagcatattaattaatcatatatggagagtgatagtcacctatctgtcaagaagagttaaaaagcattattttgggttaaagctgatacatgactttaactgaaaaaatgtttctcattgcacttcgaattactggagttgaattctttcagggagacttagatatgcccattctttgcccctgactcttgattcactagtgattctggagaaaatgtacaccaatttgttaattctctggcctcattctttttcttgccctatcacacatgttgttacaacacagcaaaaacacacatatccaaggaaaagtctcttctactacccatacccaaacctgcctttcctcctaaatagtccctagggaagcaagccatcgccatgacaaccatatgatgggagtttgaacagcacttggggcagcctttgttgaaagttaataccagttggtgtttaacaagaaaaggaaaactcaggcaaggggtaatactctgttgtgaggcaccacttagctgtatggaactaactgtccccatcaaatcttacctaaccagaacacatcctcagaacaaaattctccaagtgtaacgtattcagggctaattcattaattctccattgtagcccactggactcaatgctctgtggtcactaaatcaaaagagcatacatactcaggaaaagagaattaagaactttgccttttttaacttcgaatggatatagaacatcagagatatttatttttccctattaagtattaccaccttctatttactgggcaaaaatgcttgtttcctgcacctttaaatctaatttgtgttttcccccctacaagaaagatcatgaaggtggattagtacagagttgtatggactttttcagtatctttaatgcatttgcttctggaaagagaagcgctgcagacacacggtggcaattcctgctcaggtgtagtgccattcttttgtgtgactcacagctagagagagagctgacattcaatatatgtttaacaatactttcccactactgattccactcaggagactcacatttttatgccttttctaaaaacaaggacacaaaaaaagtcactgtctgaggaggctcattctttgttcatcttcacctgactggccacctaactacacaaagcttttaaactaatgaggagaatcctttgttctctctggttccatttaaagggaaagtgggtcgaagggcttccccagggagagagaaagaaaagcccaggagccaaacacaagggagtaagagatttcactcccactactattcccaccctcccaaagaagttaattaattctgttttaggaatggttaaaaggggtgggggagcaccaggtagcccattctctgagaccaaaatctccttctcgagtgtggttcgcaccagcctcttgtctctgacaccacggggtgtgggtggggggcgtggggggagggcaggagtactgagaacctctctccagccacggaccacagagccagtactgcatgcatttaggctcccccaaaggtgcgtcccagcccaagtccccaagttgggtatttaaatctaaaaagcacaattagcgccattcaaagctgcaagttacagtaccttcagaagtctgacagatggaagaaaggctgcgtggcacagcttccggatggtccagtttaggggtcgaggagcatcagcctgattcatgaccccttccaaattccaccaggaaaacaagaaactgaaaacctgagcaatgcctagaaaataaacggtcccccacggctctggcatcccatggtcatctccacacctgcaaattccattagggcagaggcttcctggaacttggaagactagtcaagtagccttgcctgagcccctgaaccttcttaaaacagccacctcccctctctctgcagccgtgctcatgcataccaaatgtggctgaatggaggcacactgcctgctgcttcggggaggggatgcacgattttgaagaagagggacagcctgcacaaaacagcctgtggtcggagtcaaagcagcctgctccagaatgcgcgctccctctcccgctctcctcccagtaaacgcaggtcaggcgttgggggggaaccggggccattgctttgctagcttggtttgggggggagccaggaggatcgcaaaagggaacaaaaatgaagccagaacgggaaacttgcactttcttgcacaaagcatctttgagggactgagaactggtacggggggaggggtgaggacacagggagagaaggggtgcctccgaatgatgagataaatgcttcccttttgatttatgtgacataataaagtgaggctatcatcaaatacatctatagtaaaagagatctgtgtcgtgttctgaggtttttattaaccgtgattgacagtcttcatcctgataatcggttgcatagatgacagacactgagacagaagcaaactcaaacacactgggttgttcctttcatacaaagcagtttaaactcatgggcatttggctcaccttttagagatggcagtttttaaatgggggttatctcctggaaagccacttgataccgcttctctgcaacacaagtttaacccataaagtgccacatgggatgctgtctataaagaatggattttcctcaagtggggtgtccacccccatcattttctaaggaggctgtatgaaatagttgctgagttggaatgtatagtctttaggactcctgtggtgagagagagaattaaaggacagtttttcaatttgaaggtagaaattggataatttcacatagtaagttgggacggtgagatgagaagggagttcctgacacaaccccccttcggctcccatgtacccccaggcatcggacctcagtgggagcagttgacctgacaactcctatggggagaatccccacatccttggagcatcgccatcttatttattttttcctctgtgaccatgctgattttccatttctaattaacttgaagagattggtaaatcccagctccatgactattatgcagtcagagctgaactgggagtggtgcaagcagatgtgatacactgctgtaattcagaaccgggacaacacaggcccaccccagcatgaaatcaatacctgacacactgcgctacaacaccatttcactcacaatggtcttgtgtcaaaaatttaagaaagatattgcagaaaactagtccacgggtggaaggcagaccattgacctacctcgtatagtaaaatttatgtctctgattatctaccaaacaatatcactttaatagatctcatacacagctgattcattttctgttactattctatttccacaaaggattgaaggcagtattaaaataataacggctcacatgtatcacctagcacaatgcattgcataggtttatgcccatgtcaaccttatggagtaggtgttatggtcattttcttatctcacagattaagcaagtgaggtccagagaaattagtaacaagtctaacatactagtataactggaatctggattgaaaccagtctactaggctgtaaagacaagctttctcttgtctcctatttctttcaaaagggacttcaggaataaaaccactgcctctgttttttggtaatttaatcttacataagagttaaagactttaaagaagaaacgctcagcatttctttcagattattactttggtctgatgttgatgtattagttaacagcatgaattctggaatcaagctgcatggttcaaattccaattttgaagctagtcttgggagatttacgtaccttctttgtgtcttggagtccttatccgtacaatggagattaaaataaacccttatgcctatggttgttgtgaggactaaataagctaatattggcaaagcacttagaacagtgcctggcatatactaaatacctgtaccatgatccatcttctgggtagcatgtgctgattctgagctggaagcccactgacaattttcattaagcatgcatacatatggtagtaggtaatgaagtcaagcaagacaaattaaaactgaatgcttcttgtgagttactatgagtttaataaatggggtaaagaggaaggtgggagactgcaagggcagcgtggttttcctcatgcagtgtggtattcatccagttgcgagatgctgcctttagtggggaaggctccagcctttctaagcttttaaatgaacgcccttaagtggttctgttgaggtggtgagatctctgctccatgaaaatgctgaaaaactgcaattgcctaccccctgccctgcagtatttcaaaatgctaaggaccccacaaaaatgacagcatcattctgaaaacacatggcctttgatcctatcccctttaattttactgaataactttggtcaaagagaactgttagaaactatgcagagtgaggaagtaggaggattcacagccctctctaatggcaattagaggagaaaagcacaaaaccttcagggaattgatttggagattacactgcaaaagaggtaaaagatcaaagaaggatgacagtgcatgagaggcagtttttcttccatcactggggacgctttgtgccagaattgtttgctatcaaaacatctaaagaagggttttcaagacccttctctctactttcaagaaattatattttcacatagaagatgccttccccagttttagagagaggtctaatgagaaaaaaaaaaaaaagcagagaggagcaagcccagccccagatattagcatctcacaaattcaaagtgcttacttataaatcttatgaatgtagatgtctacatatctgcagaacaaattctagcaggcttaaaactctgaaataatcatactagctttcagtatcctaaaaaatagcaagcagggcatatcagatttctgtattccaaagcctgcctttgagccaactctaattctctcccgtgctacagaaaagcccactttccactgattatcttccctttttattttctgtgtaaatgatacgaaaccaaagaatcatgatgaaatttgagctcattctcaatactgacaaggcggccattgtatagcccttctgaattctttcttttgaagaccacgttccttctcttcaaaagtcatagcaccctcaatatagtattgtaccactttgcaccctgtcttctttatatcttttggatgtaaaaggagctgacccatgaaaacctaagaaaacaaaaaggaaatgacacagtgaccaggtagtacagagaactcaaaagcctccctctgaaatgtgttttctgcaaacaacactaaaataacagtgttgcaatgtaatttttcagagtttattattacaacattaaaattcataggtatctggacatcaattgtacatatattttcaggctctaatatatggatgtagtgcacctagtgcagaaggatgatatttaagcaaccaggggaaaaaccaggaacaagcccagtggtgagcctttgtagacactttcgtttgcttcagtgttttgtagtcttaatattaacgtcttgcttgcttaatgattggcctcttttattaattttgttgtgctttgaattttcttttttaaatattttattttactttaagttccagtatacacgtgcaggatgtgcaggtttgttacacaggtaaatgtgtgccatggtggttttctgcactgtcagcccatcacctaggtattaagccccacatgcattagctatttatcctaatgctctcctcctgcaacaggcccccgtatgtgttgttaccctccctgtgtccatgtgttctcattgtttagctcccacttataaatgggaacataacggtgtttggttctctgttcctgtgtcagttcgctgaggataatggtttccagctccatccatgtcactgcaaaggacataatctcattctttttatggctgcatagtattccatggtgtatatgtagcacattttctttatctagtccatcattgatgtgcatttgggttgattccatgtctttgctattgtgagtagtgctgcaatgaacataggtgtacattatctttaaaatagaatgatttatattttgggggatacataccactaatgggattgtggtagattaaatacttaaatgtaaaacccaaaactataacaaccctagaagataatctagacaataccatttaggacataggcacaggctaagatttcatgacgaacatgtcaaaagcaattgcaacaaaagcaaaaattgacaaacgggatctaattaaactaaagagcttttgcacagcaaaagaaactatcatcagagtgaacagacaacctacagaatgggagaaaatttttgcaatctatccatctgacagaggtctaatatccagaatctacaaggaacttaagcaaatttataagaaaaaagcaaacaaccccattagaaagggggcaaaggacatgaacggacacttctcaaaggaagacatttatgcagccaacaaacatatggaaaaaagctcaacatcactgaatagtgataaatagaaaaatgcagatcaaaaccacaatgagataccatctcacaacagtcagaatgacaattatcaaaaagtcaagaaacaacagatgctggcgaggctgtggagaaacaggaacgcttttacactgttggtgggaatgtaaattagttcaatcattgtggaagacaatgtggcgcttcctcaaagaccgagaaccactatttttttcaaaaaatcatttgtctcatgaactttatggcaatttatcatttttgtcaaaaaacatactttcctggttcttccttttaactttactccaatagagctataacatttttaggcattttttgatgcttatactgtattttccaaaatattagatctctttatagattccatttacctacaggacaatccttaatgtatttccaaatatatgttttcaaacagattaacttttttcctttcttaaggtatatttccccttttgccatcttttgtagataatagattctaaaatacactaaaatttattaaaatacatgactcactttgttaagtaggttaagcagcatttattccatataaaataaaaatatctcataactacaattgttatctattcattttccctccattattgggacagcatctctgactgctgtccaccctctgcacaaatgcctgtggtgacagagagtgggtgagtttttcagacagcccattccatgattgtacagttctggttgacagaaaattctacctaagactgaggtgaaatgtccttccctctaacttccaagtcaagtttttctcccagagcatagttttccaaatgtataaggatacttaacaagctccactcacacttcctcttctttacatgggggatcttgggccattaatcattcttcacgtgatggcatagagtttttaggaaaaaacaaaaacaaaaactctctttaggattatattcaatattatgttataggggtactttaaatatagtagtctcttaatcctctggaatctcttgaattacttctcataaaggtcctttaggaagctttgaggggaaactcactaataatttagcttctttttaaacattgtttcctaaattaattagaatactcaacatagattttaagtaatagctgaccaaaacacacacacacacacacacacacccctgaactgatgtgagtaatttactctttttcaccctgacttctaacagaggtggtggcgggtagtgacgggctaatggaaagctcatgcttgtttcaagaaatgaggagggactggactgtctgtgtttcatcttccctatctttatctgtaactttggaagtcaggcagactctatccaaacctaagtgcctcctcttacccactatgtggcctgggggcagtgatacaacttctcagaggcttagtttccacattgtaagaatggggtctacaatagtttccacctccaggtttttgtgaaggttaaagcaattagcacagtgctaacatagagaaaaacatatttaaattcaattacttttattgttgttagtaatagtgttgttatcttgttcacggataccactggcagtgtatgtagcatagtccataagcgcacaggccatagaccgaatggcctgaaggtaaacccaagctttaccatttacatgtcactttggggaagttatttaatcttatcatgctttagtgccttcatctgcaaactggggataataatattacctttgtcaaagggataatgtgaaattaataagccaatatgggcagaaaccttagaagaagttcccacacatgctaagagctagaaaaatattagcaacttattactaccaatattggagtcatatgtgccacccttcccacagctagtgatctaggaaaagcaaagcaaaacaaaacaccttcatctcctcctttgtttcttccagtaagagaagaagctacagagaacacatgagaagagacccacctctgactctccttactgctttcctctgcagtcccatgagtccttacttttaaaatagatagtggttatgagagggaatcatatattccaataatggggtgtaaaactttaatatataaaaggtctcactttggaaaagacaaaggtatataagcagcttccaccttaccaaaaatagaaatcctacatatacacctaccaaaaaatgtataacagatattcaaaggcctagagctaaaatacaactttattcagccttgaaaccctaaaatttccattcacaaaggggatggggttttagtataattcaaaaattctaatgagttcccggaggcttgttaaaaatataagaatttgagatgtgcatttctgatcacttaatattcactcttctaatatttgcaatgctattcattattgtaaatgttctctttctaaactaagtttaaatatccgcaacacatacacacatgtaagcacaaatacacacccacacacagaatgtaggtattttagatacattttcattatgaaagccataaatttgaccaacttgataaataacttacgaattaatatattttaggaggagacatttaagcagtgaatctccaattactgcttgaataacttgcatgaattggagggagctcagcattcactattaacagtgcagctgaagtcagatttcttggccaatggatacccaaatcaaacacaagttcaagctcaaacctcacatataccttctcaagcaccttctgactcacaccaatgaaagctgagggcctgcccaagctacacaccctgccttgtgcatctgggcttctcacactagtggccagccctgggttggaccataaggtccgctcacctgggaaacagagacatactgtgatctggaagatcctcaaagcagtaactctgcttggtagagaattttaataaagaaagctaatgaaaaccgtacttgctatctatttttgacagccttccaaaaaatgcaacattgttgatatttattctggtatcatatttttgacaaccaggagcctttcattttatttttattaacattaatagtaatgggagggattaaatgattttactttatgagagacaatggtccagtttttgttttgtttttctcctgatgaggcataaaataaatgcaaactacatggattttgaaatcagggagaaacagatttgaatccacattaagtcactgggcaattcatttaacttttatgagtccttatttttaaaatagatagtggctatgtgataatattaaaatgatgattaataacttttttcaagcacttactacgtgctaaacagtgttaagcacgtagctcatttagttatcataacaaacctgtaaagtctacagtattgttatcccagtattacagatgaggaaatagcctcagactggttaagaaacctgcagaaggtcacgtgggtggtaaacggacttgaattcaggtctatcttattctataacccatgcttttacccattacaatatgctgctgccaattaaataaaaatatttatatagggttcctgcggcttcccaaaaagaagctggtatttgctctgacaaatctgaaaaaaggaaaaacaacccaatgaccctaacttatctaacctaacaccagaatcctgcaaagcacagaagaagcagtggttcttccagaagctctgggtttcttttatttgcacggctgacttccatatccctttccctaccttctagttacatctggctggcctctctgttgagataaggattgtctgtactcatttggtatgctcaatatataacacaatgcctgaaacacagtatttattaaatggaaaaagggatgtttctaaataacttatatgattttttgcaaatatgaggtaagtttttaaacatatacaaactcatgtaattatcagtattatccaactttgattcctacctgcattttctagttgaggaaactaaagcacagaaagattaaatactcaaccaagtttacactgtaagtttcagagctatgttttgaattcaaagataaactcttgatatattatataaggttcaaaaacgtatacataaaaagtaaaatgtgtttttaaggtaactgatttagtttcagatactcaagtttggtatctcaaaaaaataccatgatctatcattattcatgagtgaaagataatattctagaaacttatgacgtttgtttcaatgacacaaaagatgcacgtggccagaaactttatgcctgttatagtaagtacagaccaaaggtatctctgtaaccatataagtaaaattatatggttacagggattattcacatttacttggacttcatataaaatgttcagagtatttagggagaaaataaaacaatattatcaagactctactactaacttgaagctattaagttagaaaatgaaggtaccaaagatgaatttgatttatagcagcttctaaattggttaataaatcagattctgactgcttttattcagcatccagccaaagccatccgcaggcgcctaaatggtacatgcgttggcacagggtatctggttgactgcatgggacaaccagctgtctctgggaagccttcctcaataaggaaggagagagatgataatagagaaagaattataatgttctgtagtgcctgatactatcccaaggaaaaactcataattattgttttagtaaagaataggtagatatagctgtaatgcgtatgtttttctttgtactttaattaaattctttgcaagtaaacctgttggctacagatcagatgagagcatgatgtatttacttttatgaaaacaccacaattaaaatagatcaagccactcctatgagtaaaatcatctagttctctccatggagttaagaaaaactccgaactcctcgtttttgataatgtgacaaatttgatcctgcctctctctccaacctcaactcttgacatttccaattcatcatgcctaaccacttttatttcttctagttttgtttcctgtcacgggacatttacatatgctgttccctcttctaaagctttctcctccagctcttcatgagattagctccttctcatgctgggaaactcagattatatgtgatctccctagagagtccttccttgatctcttgagccctccttcaacatttattgcagctctttgtttgaattcttcctgtacttttcagaattggtagctatttaattgattggtttatttacttttggccttaatctacgaatggaatgtaatttctatagggcaattgtcgactgtatcccagatccttgcagactgtctggaacataatggaaactcaatcaaaatttgttgactatagaatgaacaaatgaagaatgagtgaactagccatgtttgttataatcatttcttgcaagtcattt

SEQ ID NO: 1335 - DNA, 206330 bp, Homo sapiens
gccacagttttaagccatcagatcttgtgagaactcactcactatcacgagaacagcatggggaaaccacccccatgatccaatcatggtgttaggtgattaggggttaggttagatccctcccctaacatgtggggattacaattcgagatgagatttgggtagggacacagagccaaaccatttcagtgatgaattggctagtaaaatagtggtttatctataccagcagctctcaaactttgtggtctcaagactccattacacttttaagaatgtttgagccccctgaagagctttggtttatgtgggttatctatgtgaatatttatcatattagaaatgaaaagggagaaaagtttaagacacagaaatacacaagcacacattccattagttgtcagagtgatgacatcacatcatgtagctgtcagagtgatgacatcaccacatcagcaaacccaaaattaagaacaaaatgggaaataatgtcttagtattaagaaatagttttgaccttgtgaacccttggcatcttagggaaacccttgatctataaaatagaataagattccaccaaaaaaatgttgtataaagcattcactgacactgaaaaatcccaatttttaaaaaagcagaccacagaacagtatgaacaggattatacgatttaaaacaaatttaaaaagcaatggaaagacacactaatattttacaagtatatatctctagatggtgaaaatactagttttttttctgcattgagatttttctttatttttatttttttgagacagagtcttgctttgtcgattaggctagtgtgatggttaatactgtgtgtcaacttgattggattgaaggatacaaagtattgatcctgggtatgtctgtgagggtgttgccaaagtagattaacatttgagtgagtggactgggaaggcagacccaccctcaatctgggtaggcagcatctgatcagctgccagcatggctacaatataagcaggcagaaaaatgtgaaaagagagattgccctaaccttccaacctacatctttctcccatgctggatgcttcctgccctttaacatcagactccaagttcttcagttttggaactctgactggctctccttgctcctcagcctacagatggcctattgtgggaccttgtgatcatatgagttaatacttaatagactccccatatatatctatatcctattagttctgtccctctagggaaccctaactaatacagctggtatccaactcctgggctcaagtgatcctgtcacctcagcctcccaaagtactgggattacaggtgtgagccactgtgcctggctgagatttttcttttgtaattagaataaaacgcatttaccaaacatatacttaatgcctatttacagtcacctgtattttccttcccagacctgaaaatttcagcttagtagctttaggaaatgtatcactaaaaaatattaatacaaggtattagttttgcacagctctaaatgaggcctacttgtagattgtccttgcctcttaaagtgcggtctgcagaccacagcatcagtatcacctgggagcacgctagaaccatggattcttcagcctcaatcaagacctacagaatcaggacctgcattaagacccagatgatttgtgtgcacaacagaatttgagaaaccatgggggtacgttagaatgacctgggaattttagaaacagtgtggaagagagcacatgttttttgtcttttttttttttggaaacggggtctcgctctgtcacccaggctggagtgcagtggcacaatctcagctcactgcaaacactgtctcccaggttcaagcgattctcctgcctcagcctctctagtagctcggactagaggcctgtgccaccatgccccgctaattttttgtttgtgtttttaatagagacggggtttcaccatgttggccaggctggtctccaactcctgacctcaagtgatccacccaccttggcctcctaaagtgctgggactgtaggtgtgagccaccacgcctggctattttttgtcttttctaatgctctcaggtgattctaatgtgcatctagggctgagaaactgctgctctaatgcaggggcctggcttgaatctaaaaaagaacaagattgttaccccaatctctacctactttaaaaaatatcctcccactgcaacatgtagtgacctccctgccagttcccgggtcctagaatttcacaggaacagcagaaccagatggagaaaacagctggtaatatagtttgttcaggctactataacaaaatgccgtcaactgggtaatttataaacagtagaaatatgctcacagttctggaggctaggaagtctaagatcagggtgtcagcataactggattccagtgacagctcttttctgggttgcagactgcttccttctcgctgtgtcctcacatggtggaagaaggcaaacgagcgcccacaagcctcttttataagggcactaactctgttaatgagggctctgcaatcatgatctaatcacctcctaaaggccccacctgttaatactaccacggtagggattaggtttcaaccctaacagcacagagcttgtacctatgttgtccaattttacaaaaaaattctacttttcacatcaccttctgatatggttcggctgtgtccccgtccaaatctcaccatgaattgtaataatccccatatgtcaagggcagggccaggtagagataattgaatcacgggggtggtctctctcatactgttctcctggtaatgaataagtctcatgagatctgatggttttataaatgggagatcccccgcacaagttcttttgcctactgctatgtaagatgtgactttgctcctcattcaccttctgccatgattgtgagttctccttagccatgtgaagctgtgagtccattaaaactctttcctttataaattacccagtcttgggtatgtctttattagcagcgtgagaacagactaacacaccttcattgtggatgaggtagttactgatcacctcaattaccactgctgtcattcagcaaactttcaagtgcctggtatatgccaagtactgggccacaattccaagactctctatactggaccttgctgcttatctgagcttttccccactctttcgtctggaggttctgggcccttcccaacctccccagcagcataggctttattatggccccttccacattccccaggggcccagaccaaacctctcttccttcttgagaccatcttccattaacccctgtgttcttcctgtatctcaaccaggcaccattttgagagatgtcagtttagctcttgatgaattggaaattttccacatgtggggttttcccctccatcagtttacatttcctcaggaacttatgcagcgtgcttataacacctgcctggaacacagtaaacttctagtcaataaatgtgacctgttatttcaagggatagatgatatattcacccctagtacccagcctgcaacaggtagccagagaactagtgggcctgattcagttgcaaagtaacaagactaaagacagcacaagtgtggaaatatggctattttctttataaaacttgagtcactctaacaacttgaatttaagataatttacttcaaataaatacagaatgcagactatgacttaatcataataaatcattctctatgtttaaaatgtcccacaaaatgttgattgttttctttttttgtttttttgagttggagtctcagtctgtctcccaggctagagtgcagtggcgtgatcttggctcactgcaagctctccctcctgggttcacaccattctcctgcctcagcctccagagtagctgggactacaggtgcccgccaccacacccggctaattttttgtatttttagtagagacggggtttcactgtgttaccaggatggtcttgatctcctgacctcatgatctgcctgcctaggcctcccaaagtgctgggattacaggtgtgagccaccacacccagctgattgttttcttttttacgtattttttttgtttgagtcaggatcttgctctgttgctcaggctggaatgcagcagtgcaatcatggctcactgcagcctccatctcctaggctcaagcaatcctcccacctcagcctccaacatagctggaattataggcttgtgtcaccatgtccaccaattagaaaaattttttgtagggagacggtctcactatgttgcccaggctggtctcaaactcctgggctcaagccatcctcagggtgagtctataaagtgaaagcaaatttattaacaaaaaaaaggaataaaagaatggctactccatagacagaggagttctcagggttgccaattgcccatttttatggtcattttttgatgatgtgctaaacgaggggtggattagtcatgtctcgcctttctagaccatgtagggtaacttcctgacattgccatggcatttgtaaactgtcatggcgttggtgggagtgtaacagtgaggacgaccagaggtcactctcatcgccatcttggtttttgtgggcttctttactgcaacctgttttatcagcaaggtgtctatgacctgtgtcttgtgccaaccttctatcttatcctgtgacttagaatgcctagccatctgggaacatagcccagtaggtttcagcctcattttacccaggtcctattcacaatggagttgttctggttcaaacgcttctgacaagaccaaagcaaaatccaggtgattcacactggtggtatgtatgcatatatgtgtgtatttctaagtacagtgtgtagaagtaacacactggtggttttagaagaaatataaagatgttctattccttgtttctggagagttgctcattttgaagaggaattgaagtgcaaaccagggtcctggggccttttgtcacaaaaacctctgaagttccaatggagggtggtgttccctgggagggagggtgcagagcattgtcctcccagccccattgaggacacctttaggacagtgcctctgcctggaagatgagcagctttaggcagtcaccatcgtcgtctagaaaccacatttgaaaactggtgggaggacaaggcccagctccatcctgccgcgataaactcccagcagcaagatcccaagcaggatagatggtgatgggagcaaaacgtcctgttctctcatctttccaaaacaagccttgccattttcaggagcgtgtaaaggaaataaaacacctacccgccctaagcaggcaacataagctgtgtaccttcaagtttctccaaagcacaagcgcctctgaacatacagtgtttttatccctgaactattccaactccagtccggagtggttttacgcagtcgacactagagggcaggccattaaaacgttcccgttcaaacgagttgctctgcaaatgcaagagctgacacagcacctgaaggtccgctccgtatctgaaaagtagctttcccccacggagaatgcaagcgtgcgttcggtatggggcaagagcgtgggaagcctgctactgctttcctttcggggcatatttacagtgaaagcccgtgaactcgcctgctcttcccttagatttactttacttgggaattcctagaagtggaaaaataaatcacaatggccagtgcgggtccccagaggtttagccccggctaatggataacaggaagggactaaatcagcctcctctcaccagcggcaagtttacaagagaaccactcagcatgaaaacgccaaagcaagctgtacttaatccctcaagaagtcctaaaaactgtaattttattaagttagagacagggtcttcctctgccaaccaggatggagtgcagtggtgcgatcatacttcactcctgggctcaagctgtcctcctgccccagcctccagagtcgctgggagtacaggtgcatgacgccaggtccagctaattaaaaaaaattttttttttcatttttttaagacacggggtcttgctatgttgcccaggctaatcttgaattcctgtcctcaagcaatcatcctgttttggcctcccaaagtgctgggattacaggtgtgagccagccaccttgtctggcctaaaactgtaattttataaactctttgtggcaaacccctccaaacaaaaaggctcgggtgagtgtaaggatggctttgctccaagttcagagtttggcttctccgccgtgctccctgcccccacccacccccccacccccatctgactgccttgtctgttatcatgtgtagattttctatggattttattgtgtcatcatgataaagccaatgttaatgtatttttcaggcaaatgctgcattttcctcctcaaagactaggcttctcactctggaattgggcagcacctagaagcagccccatggcctcactggagagagctctggccatgaaaccctgctggccagcgtttatagagggcttcccagttcttcattggaggtctaaacaggatttccctagagaaggagggcttcgtggaataaatgacaaagggagttggggtggcctgccaggtcactgggctccagctcctcattgttcagcccacaggcttcccagggcgcctgtccaagccagccggaaacagacgaaactgcaaaatcactccattcctgcccacacaaacacggggaaatgaatgatcactttgcacaagaaacctccaagagacactttgaggatccccttgaggaaaggacaactgggacctgtggcaggaagaaggctgaaagaaaagtccaggtttattactccctgggagaaggaagaggaagaacaaaggaaatgcacttctttaagtacttcatgatgcaaaatatttttaaattcctgagttcacatttaaaaactgtatatttttaaattataggagcaatgatgttagtggtaaccagcccaacaacagaaataaagagaaatttaataagcttcccctaaagtctaccttctacacattgaagaaacttcctccaagtttttgagttttatagacaaagcatccttttacttctgagctgtcatttttttttcctttgttggcttatagtttgcaacaagcaaagagggccaatgtagacaataagaaaactcaagaagcagggattggccatctccaatcatcactgataaatttccttaaaatcaaaataacgttgtttcaaatatctgagatatgaggcaaaacgtttcttgaacaagtctgacactatgttgtcaggatctaagtgtgctatatgaaccttaaaatttgttttcatttgatctttgaaaaaagtatttaatcagttctaacgacggaagtcttcttctgcagtgataattcacaatgaaagacatttaagctgacgtttctctaatgggtttttaagattccagctccaagggactgtgagaaattattttcttatataaaaggttgtgaatattatcaacatttatctaagcccataagtcataaatcccaccaggcattaaattttcaagggagcttttaaaacatagattaccctgtctcccactccagaactgctaggggtaaggtctggggaatctgtatttcacatggtccccaagtgattgtaaccagcagatgacctcatgggcagggatttcctacatacgaggctctggcctctgtgtcttgtcagtcagcatttttaagtacaaaggaacctttcccttcccaactacaaaatcttacctttctgtttcccctcctagaaaactggatcagaacaatgcttctcaaagtgtagtccccaaacaagccgcaaacagcatcacctacgatcttatcagaatacaaattctccagccccaccccagacctactaagttagaaattatgggcacggagcaaatgcattcatgtgttttaacaagtcctcccagtgattctgacacctgctaaagtttgagaaccactggattcgaaaatttcacaatttcaagaaagaagtaatgaagaaagacacaccatgtaaggtagaaccaagtttattaatgacagcctttattacaatcactctcaagtgtaaaaaataaagggtgattaattaatatttaaaactcactcggacttgctgtttggcctttcagtggatgtgccaaagggcagggatcttgcctgattctgaatcaattggccagatggagttcactggagaatgaggcaatcaacaaaaaagacaaatgatgccaactggagagagctcgtgtcttctccatgttggaaggacattacaaaatggcaactgtggtgggggcagagatgaagtaagacaaccttacagtcggagtaagatgtgaatacctctacctatacagagacaaaaacacacacatgcagagccatacacacacccaaacagtgaacacagttttgaaaataatttcctttttgtcctttctctgagcagactgacacattcatcggccaccaccatgcaccatggggctgaaatggaaaacctcgcttaatttccacaaagtattctagctggctgcccagttatgtgctggcaaatctgtccgcaccgaaaaatgtgcctgtggttttcccagagttccacagactgatatctgctccccaggagggcaacatccggtggacaccagctggattaaaatctagagggcaaaactcgtccctcccacctaaagtgggggcaggagcggcagcaccaggaagtggtttcccactttgtgttacagagtacttgccccagttcaacgcattcccctccaaagtatttgtgctttgataccatcctgatggttagtctgcaataagagaactgaaggagctatggccatgcactattttctttttttaataaaagcaaactaaaactggaggaagaaaaagaaaccattagaagcttttgactgggtcaatgttgtttccaaattgggtttaattccattcaaagagaaagaaggggagggtgcagaaaaggccactcagatcgactctggaagagatcatcaagaccagggaagcatttggatggtacagctggtctcttcccagccagactgggaggacatgccacaacctcccaaggctgtgaacctaggaaataagtgctgaccaaataacatatttcaatgtttgtagaaaagctggcaggaaagggagatgatggattcagattcacaggtcatgcagattaagacttaatcaaaaattaatgcttgagctgagtaagaaaacactaaaatttaagtggaactgtatcatagctttcacctttggaagacgaaaaacaacaaacatacaaaacaaaatgacccagaatattccagagtttccaaaaatccaactgctaattttggcagggtgagaagaaggggatatttaactgatacctcttcattaacctcattttctccttgaatttcactgataaacaaagctcaggtctacttagaaaaacgatcagtcctgctaaaatacagcctcatgacgtcttccaatgcccttgctcggtgcacatgaaatacacaacttctcttataaggagactttccaggatagaccaagtgtgctcgcccaagtgacttgctgaataccatcacaaaatctgaacccaaagatgagttgttttcttcttcagatgagagttgcaagtgtttcctaaaatgtacatggagggatgcccacaaaccactgccctcccaggtgaggggctgagtctttgaggagatgcactccttcaggccatggaacagaaagaaggtggtccgtccaaggtgtggtgaagagcaaagctgcctctcccagccctccaattacggaagatgaggacaagaatgtattttctgcacattcaagtacatctgggtcccctaccctccctttttttcttttttggtaagcatctaactgtccataaattcatggctacagtagagattcacggcgcaacgactttcatactggttatttttttttttaattctgtcagtgagcagcatttcccagttttacactcccctaatggcagctccattaggcgagactgcaggctgcatctgtgattaggtccatgcagctcgaagatcagttcggcacgcgggagggtcccgaaagctgggtctgtccagtgtcttgcagcagcggttgcagggggtctaccagctcgccctgacagcttcgatatcgctaaccaaattctgggccaggcatatcccaaatatctgagaaaggaagaaaatgtgagtgaaacagtgacacttgtaacttgtttccctggccactgtgtcccatttttttaaatcattgatttttgaaatttaagatgtaattcatatgtggtaaaaagcatccttgaaatgtgtataattcaggggcttttagtatattcacaaagctatgcaactatcaccactatctaatcacagaacatttcattaccccaaaaagaaaccctgtacctgtgagcagtcattcccatcccaccatccctacagacctagcaaccactaatctacttcctgcctctgtggatttgcctcttctggacatttcatatcaagggaatcatataatatggggcttttgtggctgtctttttcatgtagcaaaatattttcaaggttcatatacatgtgctattaatttattccttttgatggttgaatgatattccatggcatggatatgccccattttgtttatctactcctcagttgatgtgtatttgcattgctctcacattttggcaattatgaataattctgctatgaacatgagcatacaagtttttgggtaaacactttctcaattcttttgggtactcctctaggagtagaattgctgactcatatggtagcactatatttaacttttgagaaactgctaaattgtttcccaaagaggttgcaacattttcatttccattagcaacatatgagggtttcgttttctccacatccttgccgatacttgttattgtctgtcttttttattctaaccgctttaacgagtatgaaatatgtggctttgaattgcatttccttaatgactactgacgttggcatcttttcatgtgcttattagccattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctttattagcaattttaatctttagagaaatgtctgttcagatcctctgcccgtatttttgtttgtttgtttgttttttaataatttaagggactgggttttgctctgttgcccaggctggagtacagtggcgtgatcatagctcagtgcaggctcctgcctctgcttcccaagcagctgggattacagggacaagtcaccatgcctggctgcccatttttaagttgtttgtctttttattgttgactttttaaagttctttatttttctagatactaggagttatcttttcactgtcttgatggtatcattttcagcacagttttaaattttgaagtccaatttatttacatttgtttcattgcttatgcttttgatgtcatatctaagaagacactgcttaatccaaagtcacaaatatttatgcctatgttttcttctggagttctatagcattagctcttatatttaggtctttgctttattttgagttaatttttacatatggtgtgagttagtctaaattcattattttgcatatctagttttcccagtaccatttgttgaaatgactgctctttccctattgaatggttttggttcccttgtcaaaaatcaactgaccatatacgtacgagcttatttcatcttcttttttgagataggatcttgctctgtcacccaggctggagtgcaatggcatgatctcagctcactgcaacctcccaggctcaagtgatcctccctcctcagccccccaagtagctgggaccacaggcatgcgccatcatgcccagctaacttttgtatattttgtagagacagggttttgtcatgttgcccaggctgttttgaaactcctgagctcaagtgatccacctgactcagcctcccaaagttctggaattacaggcatgagccactgcacccggccttatttcttctttttaatcatatatatttttttcttatttttttgagacaaggtcttgctctgtcacccaggttagagtgcagttgcataatcacgactcactgcagcttcaaccttctgggctcaagcaatcctcccacttcagcctgctgagtagctaggaccacaggcatgtgccattacatttggctaatttttttatttttactttttgtagagacaaggacttgctatgttgctcaggctggtcttgaactcctgggctcaagccatcctcctgccttggtctctcaaagtgctgggattacatccatgagctaccacacctggcctggttttatttcttgatttttcaattttattccacttctctatatggctaatcttactcaagtacacactatgttgattactatatagctttgtactaagttttgaactgggtagtgtgaattctccaactttgttttacttttgcaaatttgttttggctattatgggtcccttgcttttccatatgaattttaggatcagcttgtccatttttgctaaaaaggtggttacaattttgatagggattacactgaatctgtagatcaacttgatgagtgttgttaccttaataatatgaagttttgcaattgtgaacacaggatatctttatatttacttaggtcttctttaatttgtttcaactatgtgctctttggaaagtatcacaccaacaacatgaagagtccagctcttaagactggccaggaggaaaagtgggtgctcccttccttcactagcactttggcaaggtagtttagggagagaaaggggtatgacatctctgtgaaacttcccaaaaccttaacgtcaccactgagatctacttctaactatgcatgtttgactcagttgccacaatgcagtatttttgagcccatgtaaacgatggaatgccagtaggcaaccactatctaattaatgtctccatcttagaaaaagacaaggtttcctaaagtatttcatgatagtagcatctaaactcagagctttaataaaacacaaatcaggccaggcacggtggatcactcctgtaatcccagcactttgggaggccgagatgggcggatcacgaggtcaggagatcgagaccatcctagctaacacggtgaaaccccgtctctattaaaaatacaaaaaaattagccgggcgtagtggcgggcacctgtagtcccagctactcgggaggctgaggcaggagaatggcatgaacccaagaggcggagctttcagtgagccaagatcatgccactgcactctagcctgggcgacagagcaagactccatctcaaaaaaaaattaataaataaaataaataaataaatgaataaaataaaacacaaaccaaatcgtttaggtctgttcctcagccctccaatgtgtcttaaaaactatgacaatcaaggtttttaagcaaagctccgatcctggcaagggctctcccagggcattatttccctgtgatatccataaaggacccttatcttacctgcagcaatgcaatgcctatgaaaataccagcaacgatggttaaattgtcctgcaaccacttctcaaactggggcacacagcctttcgtgtagattacaatctgctggtcaacttccttcacaagagaagaggagagcacattgtcacagatagagcaccaggcacaggccaaagctcctccaacacccttcgtgctaagcaacaacatgagattccacttactggtttttgcctggcatcatagccacactgagtgttgatgacatcttcctggtgaagaaaggaaagagaaaagtgaaatttactcattagacagaaagcccacctagaaatgagcagaagacttctgttacgcattagtaataaaatgtgtatctgggcacaaagactgcagcactatgttaaacactttatatacatgatcccatgtcattattgcgacaatcttcagaagtaggtattaaaatatgccctattttacaaataaggaaaactaaggcttggggaatatcagaaaagacagcaagtctatcacacaggaggctcaagattcaaagtggtgccaacctcaagaagcttatgggatttagggaactggagacacagataaaaaacataaagggcacagtgaatcttcatgtatgctcttttggatggactgctactttttaatctatgtacttccatgttacttaaattgtttttcaatgagcttttaataattaaaaaacaaaacaatgccccgaccacataatcacacagacaacctgacgtctcacagggtctgatcagaaacatggttccactttttcgggttgtttattttccttctctgcggggtgtggggcagattttattagcttagagcgcaaggaatgagctagctctgcccagaggatctgtaggtgaaaggggaagcattaatgcctctgagaatacagaattctcccaagggagtgttaatgtgggacaggaactggcgacaggaggcgcactgtgcggcacccgctggccagtgcaaggccaccaggatgagcccctcaagctctgagtgggcactctgctgccatgtggctctcctcagaagggagaggaggtttgagctggtgggaagggcagctggcggggcagcacagtccttagtgactttgtctcctctttcagaccaagagaaacagctgaggtggtcccctggaggaagcccacagggaagttctgcttttccactccaagaccatagctccttttaagagccccacagcctccaccataagaaggagcatccccactgagctcatcagcacccactcggctctgcttctgaggggtaagggcgagccttggggagtacatctggagactgcagggccagagaacagttgaggagtcccagaagggttctgcagctaggagcacacagagatgcgtggagtaacctctcatgtttgtcattctaacactagagagttaccttttttttttttttttaagaattgtggtctcactctgtcaccaggatggagggcagtggcatgatcatggctcactgcagcctcaaactcctgggctcaagtgatcctgtttcagcctccagagtagatgggaccacgggtgtgtgccaccacacatggctaattttttaatttttttgtagagatggggtctcactatgttgctcaggctggtctttaactcctgggctcaagggatcctcccacctcagcctgccaaagtgctgggattacaggtgtgaactactatgcctggcttaagaattgcattttaagtcattctatataccaggcacgatttgacacaaaatataatcaaacctgtggcaaaagtgagtgacttacaaatagattttatattttattcttttttataataaaatgcaaactgcatgactatagtcatgatgacattcaggagtctgggcagctgtggtcttcctacacagcagtccaggcctatcttgtctcaaactctcctcctactcctaatagttcccctagaactaagccaaaaagaaaagggttactaaccccaaaccaatgcagagagctctcatatgagcctgcccttctcatgaagaaaggctaacagatgatacaggcaagttgcctgggtctcatattccactccattgcctgctagcagtgcaagcttgggaaagtcacttacacctcatgtgccttgatttcttcccctgaaaagggagggtaatggtggtatctgccagtaggaatgtgcccaacttaaatgagccaacacacataaaggcttagaataggaaccagcacacactgctaaattaatgccagcaattattactcctactaggaagatttgagcaccataaccccctacaggagctacaaatacgagtaaccaggtaagaagagggttcaaccaaaaaatcactctgctcgtcccatgcacactctcggcatgatgtacagagtaggccaatagttcgctggcattcacttactgcgggatctttagtgcagcaggagaatggaacgccacatcgctctcgacttgcattggaatctgtgcaattgaagtaaatatttaggttccaatcatcagctccaaaagccccacagcactgccactagagcaaacaggaaagaattagaacatcccaacttggaggcaagcagtcacctacactcacacccgccgaacgacaccagcttctgccagctctgaccttcttttctgtcctagactttatttttaagccaaactgaacctaaatggcccatataaaatcttccaaattaattagggctgaaggtttgtagggatgtgttggcacgtgatttaaacaactgatgagacctgtggtgttaggtggaagaagggcagagcagctgtacagcagggctcagttagaacaagatctgtttggcttgggcacgtcattctagaaggagaaacaagaacattctagaagggtaaataagacactaacgacagtggtagtgactgaaggaggcaactggggttatgggtgggctaactatagcttactttttcaaagttttgatctctacattctaatagtttttttaaagatctgttttgttttatggagcgcagggagaccccctgaaactattgctatggaataaaagatgaaatgctcctgattactggaaatacaaaattgcatgcaggattgtgtaaagacaatgccaggttggactgccagaatgagccaacagtgcgtgatgtgcttccccctgcagagagcctatgaatggacgtgcagtcagggaggtttcacatcaccaagattcctatcccagaaaagcagatgttcatagctctgggaatagaatgcgacctttgtggagagcctataaacagacacatgaggggcacctgtccatatgtataagacagggctataaatgccctcatcttgccacggctcttctagacctctttagggttaaggcatactcccttctgagaatttctggtctaactggttgtgtagcttcacgtcctgtttctatggattgtttgtaactggcttttgctgcaactgttactgctgactaatatcttgctaatcataggttgtggaaagactgtgtttctgttttaaggctctgttagaaattactgaagcacacactatattgtaaattcttatccctgtatactgtacttttgcatacagatgttatgttaaagaattacttcatccccatgtgaccatctcacctcataatcaaatgacctaaatccctcactaacctacccccaccctcactaaacttaataataaattctggtatatccagtgcattgttggcactgcgtgaccagaaggcggtgacccccctggacccagctttcactatcttgtgtgtgtctattatttctcgacctgccgatccgcctgggaacagagagatccctgttgcattgcaggctgctggccagatcccgcaataatggaggtataactgacatacaataaattgcacattttaaagtatacaatttgataaattttgacatctgtatacatcacaaaaatgtcaccacaatcaatggatatatagttgatatatccattaccaccaaaaattttagaggttaacttttcatcatatttgtttctactctgagtttgtttaaaaacaagtgcatgtgttttacattttcaactttaaaaagtcagtcttccaattaaaatatattaaaacaagcggttaaattcagtggttcttaaatggggccggagtcaaaggctactacacaagccccttcctcacttccctgggatgcactttctctacttctctgagttaaataaatatcaagtctcaaccatttgaagaccttccggaccaacagctacttctaaacattacattccatgatgcaaaaagaaaatcacatgaaactgtagtatttccgtttaaagcacacagcatcccaagacaacatggtccttccagggcttgggtcatgcatttcgaggtgtgtccacaaagctccatcaatgtgtcatgcaaactagtcaggaataatgccaggaaagggattattagggagcctgcacccattaggacctaataaaacagtgaagtcggctgaggacatgaatcagggcttaatttcccacttaaggggcagcttactccaggacgaaatgttgctgccactgaacaaaaccacataaccctgctcagtcctgagtgcctaaggaaggggatggcctccctcataaagagtgtcaacatggctgctgcctcccttcatcacaggcagacaactatccaaccccaagaaggctaccgttcactgggcttctgcttgccctccggtcctgccatatacatgaatgccacagacaccgctgtccaagtccaagctcagcctacccgacttttcagtgcaggtatataaagacctgcaagtttgtaggaccctaacaccttagcctaatataaaaacatgtatgtctcattagtgtcataatatccctgtgagttagacagtagctagtattatttccattttgctattggggaaataggtcaaggtcctgtgagcccagggtcccttatcagattttggcactagacctgtgtcttttggtcccttgcattctgagtgaaacgggacatctgctgctttgctggcactgaaagagccatttcacaggcatgctcagagacgggagggagtggcctggactccaatgctcagggataggagagagtggcccggattccactgcacagattcttcacttgttagaagccactaggacttaggagtttctaagcttttgcttttaactgcatgtgcaataataatatttggataggcacattttaggaactttgtggcaaattattctgttgataagtagattattatgagctgtgaaatatcaaggattaccaaaaaagggggcaagggataagaaagaatccatatttaataaccaaagaaaactttaaacccggagcaaaacaatgttcctcaaatgcaaataggaaaggacagccatgattataacgttttgctcaagcattttcttctttgttcctctaacttaacagaagttgaaacaagtgaaaataggaaatttccatttagaatacaaatcctgtaagtcacagagcaagtcggaaaataataaacaaacaaacaaacacccatgcagaatagtcaggtagtttccagctggcagatgcagaaaccaggagggatgaaattcactggggtcatcgttcagagaactttcaacttgaaaacaaaccactttaaacttacatattcctgggtgaagtctatgaggttttgcaaatcaatgtcatcccgatatgctctgatgttgttgtttataaagaaatacagctggtctttgatccagtctttgaaaacaaatgctagaactccggcagtgagctccaggaagaaaataattcccaggaacacagaaaactaagataaaagacacatacacagagaacagttataagggctattttgatcatatatagctaaatggttcctctctaaacaggtttgtaattacattggattgttacacatctccaaagcagataatcttcagtttctgctgattcattaatagaatattacactccaagaaaggacttttaaaaatcattttataatcacattttagggtctctagtgttccatttgataattaaccaacaaagcccataagcaaacatggataataaggatttctcattagacccacattaaggcctaattaatttctcatgattaatgtactgccagatgcttgtaacaatgacctgcccctatctctagtaagcttctgtaacttgaaagatagattattccaatattttaagatcgcctgtcacttgttactgtggccttgattctctatgcaatatattccttttatggattcagacaccattttaattctcttttgcacctgctatacagggtaaaataacagatgtgttcatcttagatgaaggggtcaaagaggaagtagtggggtgggcagtgaccgcgaaatgaaagttatttcccatcataaaaacaaaatgaaacccctgagttgagggctttcctgggaatgctagctgtgcttgccttcctctaggaagcatgggccccagcaacattttaagtgacatcaaaatgcagccaaggggagacttccgcttaatgtagacaacaggggttttaaaagaggggctcaagaccatgaggcaacgtggtaactgcccgtaactctggagaaattccccttccatctagaagactcagaagagtctcagcttagtcatatcgacttactgctcacgcccactgttttttccacctcctaccatcctgtattcttaaccttctcaaactttgttgttaaaatagattatgagaaatgagctgtgaaggaccagagggtacagtgcgggtaaatttctggtgacaacagcagagagggtgacatgggccacaactgctgggcagaggtcctgaaggccacatgcagaagaacagtgagcagctgaggaggcagggggtgctcaggtggtctgcggttctatcttcagcaagcagacaaggagctgccagccaagagaaaaatgtattggggaggggtgcaaaggaaacagcagttactcattaaaagaacaaaagacaaacaatgtttattcattcagcaaacatctactgaatgacccacaatgagtcaggccctgaggtaggtgggctttgcagaaacaaggatgagtaagaacaaggggtatccttgccttcgaagatgtcccagtcttatgtgattagggaggctaggcagggagtgggtatctgcagacattagatgtctgtagatctggcagtatttgtctagggtgccaagtactgctctgtgagggtgggcacgggaggaggagtggaaggtggaaataagtgtttggcaaagtttttggactcccaggttaaggccccaattctagaccctccagctcagcccttcaggtttccctagagttcctgattatatatccttcaggaattcgccagaaatggaatttaaacagttcttaattatcatcagtgatgccaataatttcaatttaaactttccccaatctagaaaaatgaacagaaaaaatatcacaccacttctgctcaatgcctaccctacagtgtaaataacgccctgccctgtattaggccccaccttaagcatgtaaatatgaattatgaattatcacagtacagaaatgacaaaattatagctagcatgcatgagcatacacaggaaacaccaagtcagggaaagattttaattcagtttttgttctcacctccataaaagttaagtgcattttccagttcccctggtaaattttctcttcatgttacatattatacataccaaaaattgagtccaaattcaattcatataaaatatttggcagatacctacatgccccaagccctgttgagctaatttcctctatttccaaaggtgcagacactgactcacaggcttcaccctagagcctcggtcaaccaagaaggtctatttccattttgcagtatcttagttcctagattttccctcagcaagtctcctaggggaatcagatctttagagctatttggagtcctgtggacgtttacttactacttatctcataccttctgttcgaagattattccaggcaagtttttattgtttgtcctaaatggagagaggccatttaagatattttccaagtcttaaaagccaagaaacaacacaattctcttcatttccaacatgagactttataaattaaggtgctgatttagagaaatgtgtagttttctgcctgttcagttaacactggactcttcaactgtaagaaatgataaactatattaaaggggccaccactataaatgaaactatattaaagtaaatcacaattaaggggactgagcaggtgcagtggctcatgcctgtaatcccagcattctgggaggctgagcaaggtggatcacttgaggtccggagttcaagaccagcctggccaacatggtgaaaccccatctttacttaaaaaaaaaaaatacaattcagaggatcccagccaggtatggtggctcacgcctgtaatcccagcactttgggaggctgaggcgggtggatcacctgaggtcgggagtttgagaccagcctggccaacatggtgaaaccccatctctactaaaaatgaaaaaattagccaggcacggtggtaggctcctgtaatcccagctacccgggaggctgaggcaggagaatcgcttgaatccaggaggcagaggttgcagtgagccgagatcacaccattgcactccagcctgggcaacaagagtgaaactccatctaaaaaaaaaaaaaaaaggatcccacattttggggcatggaggccgaaactgatgaaatagtggcaacagatgagtatgaccaggacccaatcaggctacaggaaagctggcaaggtgagctgagcactggagcactgagatgcctcaagccaagaagactggcaggttggcaggtggcaatcagggacagagctctcctgggggctccccaggtttctgactaggtgaagaatgaagcatttggttgtgtgtgtatgagagagggagggagagagagagagacactgtgtgtgtgtgtgtggcaaaggaaggatctggcagataaggcagatggagtcttaggaaactagctacagccactgtggtcccatgtatccacaagagagaaccagctgcttgtgaacttatctgtaagaccaggtacccctcggttctccttgttagaataagtcatgctaattttcaggttaaatagcctccaaaaacttctccgagacagagctgctcagaaatgggctgccctgggtggggcacaccgtgtaccctcttctcagggatgtttaagaaaagacgctggaggatgatgtggcagaaatgctggggaagagaatcacacattacatgactattgggctacttcttggatatgctttttttttttttttttttttttaatgagaatgtccctggatgatgatgtgtcaacaaaagttgggaataactgtggtaacaggaaatattacactacaactgttctctagaaatctccaccatccccatccttcctcagcaaatgaaggtgggtgctttggatcctttctctgttcttagaaaggggaatggatgcttcgtatagagagctatgattcagacgcccatcagagtgccaagctccatgctgacaggcacatttggctacattcaacaaccctatataagatacataaacggcacatgccattttcttctcctttgaaacgagtctccaacgcaaaggctttcacttttcattctctattttaactttaaataccagtgaaccccctggtgaaacctctcctctacaaacattcactcagacagtgatcacgccaaccgcaccacatctaaaaattacaaaggagaactttgtaccagctaaggacaaagaagctttaccttttactgtttctccatatttagcaaaacctactgcttaacagatttaatctggacaggccacagtcactgtgcttttgcctggtttctccaaaccaacagcctgcacagctccccacttactatgtgcattaaaacggtgggaaggaatcacttagaagaaaatatatatatatacctaccttagtcctaaagatatcttagggaatggaatccaagtctgtgatatatatgcacaaaacctccatggatggcatggtggggtggtgggggtggtgttgtacttattaaggaggcacaactgggaatcagggctagagagctctctcaaaagaaaataatgacctgggccctactttggccagtgcctttggtacagctcactgtcttgcctgtagatagggtgacctcctgatggaaggtaaagttttggctctcaatctgagagtagagagtggaatacttacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactccctgggagcagaaaagaacacacaacaaggcacggggatgtggggtcagttttccaacatgtaaagattattgcatttgtcctttcccctcccaaagaaaaccttcagagggcatctgattatcaggtatgtgattaatacttaagagaggaaagaaagagagagagaaagagaaagagaaagaaagagtgagaaagaaagagaaagagagagaaagagaaaagagagaaacaaaagggaggaagggaggaagcgaggaagggagggagggggggatggagggaaggagggagggaaactgctttctttccaacatctaaacgtgttcatatttttgggaaaactatatgtagagaaaaaaaaaaaaaaaagaaaagaagagcccaagaaactgtcattagaccctgtaaggagaagacgtggtgttacctttggtttcagtgtctgcaaatataagaggtcttcagtaaaaacaaacaaacaaaaaaagacagatgtataaaaaacacacacaccccctgacccccagagaggggggaggtcatcttctgtaagacccaattcacgcagaagttagacaaatgcctattgcaaagcccttggcatttctcaggaaataggatcgagctagaagctgaaaactaacacagcacccggtccggctacaaacacctacaagttttttttttccaagaaaatatcgtacctcaggatctactcttgagctccatgggagacctttattaggctgagatcccaaaagccttgtgtggtttgctctggtggctgttctgtggcttgctgttggggtatttcttacccccttcgagttgaaatttaaatgatttacaaatcaaaggttacttcctcactttcaactcttattcttcttccacaagaacaccaaacggacctcgagtaatttcacttttccacaaaaaatgacatttctttactgaaatcccctcttcccttatgtgtgataccatattaaataccacccagaacctatgttacaagattattttgaaactgtggatgtgcatgggccttaaacagccaatatcaccaatattttaattttattgaagttgtttggtactctcaaatcaaaatacctccagagaatcacagtatagtttgctgtaaagccttaataataaaaaaaaattgttttcaaagcactcccaataacctgtaagaacaggaagcaatcatctgattttatacttgaggaaaatggaactcagagcagtttggtgatgggctgaaggtgacagacgccatcgcttctttgaaaccagtacacaatgtctatttcagtaccaagcaggggccacacacttgcttcccagtacttcccagtcagcactaaccaacatctgaacttaggagttttaagttttaatccatttaaaggttgtaggtaggaacatttggagaagcgtatttcgtttgttctatttttctgtctgtttcttcctttaggggggtgtcaacttacgaacaataataggatattaagaacagaatgtatatggggaaataaagaactcttataatgtaaaacttaaacctaattttaaaaagtctaaggtttaatgtcacagacaaatggttgaaaggctattaaagcagttaggattgaggttgtattcattaacttctgaggtgacatcaaagaaggcaaccacacccttcacaagtctgcatagaccaaaggtttgatccaattttgtttcttgggtttccaagcagtgaactatgaatatttactccgggggaaaaggttgaaggaaaacagaaatactcaaaccaaattctccacctatacaaatgatgctgagaaaaaacttgccagagaagtcggacaaaatccaagcaacaggctgggtggagtggctcacacctgtaatcccaacactttgggaggctgaagtgggaggatcgcttgaggccaggagtttgagaccagcctgggcagtatagcgagaccctttctctacaaaaataaacttaaaataaaaaatccaagcaacagtgctaaaggcccagggttgttaggaaaccagcctctcctctgacaatgcctttaaccacagatgttagtacctgaagctttcaggttatggaccttctcagccaccggaagagagagaagactttggggatacatgaagacattcttaaaagactttaagcttaattatgggagaagaagacacagctaacttggcaccagaaagaagaggtagcagtagcagaattgacagagagaaatgtcagttccatcataaagaggcatttctaatactgagagacaggactagctggatttcccaggccgaataagaattcctaagcctagctgggaaaggtgaccgcacccacttttaaacatggggcttgtaactactcagctcacacccaaccaatcaggtagtaaataggctcactaaaatacaaattaggctaaagcaggaggtaaagaaattgtcaaatcatatatcgcctgagagcacagggggagggacaatgatcgagatataaactcaggcattcaagcagggagtgggcaacccctttgggtcccctcccgttgtatgggagctctgttttcactctattaaatcttgcaaactgcacactctctggtctgtgtttgttctggttcgaactgagctttcactcgccgtccaccactgctgattgccgtcgttgtagaagccaccactgacttccacccctccggatccggcagggtatccgctgtgctcctgatccagcgaggtgcccactgccactcctaatcgggctagaggctcgccattgttcctgcacggtctaagtgcccagggttcatcctaatcgagctggatagagctataacactcaccgcatgcatggcccaagattccattccttggaatccgtgaggccaagaaccccaggtcagagaacaagaggcttgccgccaccttggaagcggcccgccaccatcttgggagctctaagaacaaggacccccggtaacaataccaccaagtctgttcaatgaaccaaagaaggctgccctgagaaatacgggattccccaacagggttgctgatgctgtgaacctttgtcaacagcattctaggaaagattcccaaagtggatgggaaattaggccttaatgacctttaggattcctttcaactttgagaccgttctatgatttcatccatttttaatgggctttttagttgcggctcacaagtctgaacaaagatcagattgctcccaaacccttgcccatgatccatggttgtacataaagagctcagtgggtaacaaagacgatgatctgagcaactcagcaaagcaagcaacaagctagcaaacatacctatgcccgaaatagcaaaataatccctcccccaaagacaaagaagtatgatcccaactgtcaggagattcctagatcatctgcactctctgggtttaatttggaggataaaaattggcttctcagacaaactcattttaatacttactctctccagccttcagaggcagttttaattgagagccttcaactgtttccacggaaacaacaatcattggggggctgagctggactgcagattctacttatttaatcctaaattctggcaaagatagagctgcaaacagatactacagcgtgctggggggaactaatctcccacaaagcataggaaagactaccaagaactttatttttaatggattcagaatatacccacgtagttatcagttgaaaactaactcaaatcttttttttcctgggtgaaaagaatatatcctttatctacttatttaaaattattttaaaattttaaaaaactgaaatggacataaaattgtatgtattggcccggcttgatggctcacgcctgtaatcccagcactttgggaggccgaggcgggcagatcacgaggtcaggaaatcgagaccatcctggctaacatggtgaaaccccccgtctctactaaaaatgcaaaaaattagccgggcgtggcagcacgcgcctgtagttccagcaactcgggaggctgaggcagaagaatggcgtgaacccgggaggcggagcttgcagtgagccgatatcgcaccactgcactccagcctgggtgacaaagcgagactctgcctcagaaaaaaaaaaaattgtatgtattgtacatgtccatgttttgaggtgcgtgtatatataaatagtggaatgactaaatctggctagttagcatgtgcattacctcacatagttatcatttttgtggtgagaacactttacatccactcggcatttttcaagaatatattattagccatcatcactacctcaaatcttgaaacacaagaagtgaatgtggaagtcaatgcccaatggccagtatttttccccttgggattagggaaaattagggattacttacctagcaggagaaaaaaaacagacttattctttcatctgtgcacaatttcccaacattcactgaagagcagcagttttattgcttttgactacacagagggattgggaggccaaggcggacagatcatgaggtcaagaaatcgagaccatcctggccaacacagtgaaacccagtctcaactaaaaatacacaaatgagctgcacgtggtggtacctgcctgtaatcccagctactcgagaggctgaggcaggagaatcgcttgaacccaggaggcagaggttgcagtgagctgagattgagccactgcactccagcctggtgacagagcaagactctgtctaaaaaaaaaaaaaaaggtgggggggaacataatcctgacaacagtgatttggattacaaaaatgatagggagttgactgttcagtcttctgttgtcctaaagatggggtctctttctggactttttaatttcattcagctcaatttgacagatgagtaagaagtgctagtatatgcctgctgaagagtaattataattaaaccttgtagttgacaagaagctgtaagaaaaaaaatctaagattacagttaagtctgccaagcaatttaaaacaggcaccagattcacagtaaatccttaggaatgtgcaagaacaccaccagcagacacctagtcttctgggaacctgaggcccccgcctcttctgggaacagcaccacctcctccttgtaaggatgccttcgcccctcctttcactccatgacccctcagagctgccaagatctcatacaatcctgctggcctggtgagggctgagaagcctggattcccttcctaaagtgccaggatttagaacaggcacctttctctagtggctgagactctaaaatgccaaactccagagccttgtgaagcatgtcatatttcctaccaagtggagaaagtcagacagcagtgagaagcagaaaaccgcgctcaagaagaaacaaagaacaagagtagggagggaaaatccagacagcattataaatccccagtccagtggttcctgaggcctgccctagagctctatgtgtcactccaggagccttagatacactcccttgattgcttatgctggttctctttgggtcttcatttgcatctgcgaagtcctgcacaacacaaaagctttgaatacactatgcttcagtcctccatgcacgtaaacgcacacacagacatgcacatagacacacagacacacgcacgtggtcgaagctgggaaaaaatgtgggtatagggagcaaagggatgtgccaggttttaaatggtcattttccccagctggctgatatttcaagtcaacgtagtaattaagccggtgtaaacagtctcattcatgttaactcactatgaattcagcatcatcaatgaaatgagcagttctgtggaactcttatggaacttttaggtgatttgtctatgttactgacaaataatgcataacatggtttaacctccaattctgcatgtaaacttgaatgttcagcccttgagtttaaataccaacttttaaaacctcaaacacggaaaaaaatcaatacattgggaggccgaggtagggggattgcctgaagccagaagttgagaccagcctgggcaataaaacaagaccccatctctagaaaaaatttaaacataagtcaggtacactggtgtgtgcctgtagtcctagctacttgggaggctgaggcagaaagatcacttgagcccacgagttggaggctgcagtgagccatgatcacatcactgcactccagcctgggcaacagagtgaaatcacatctcaaaaagtaataaaacataaataagtaaataaatacaaaatgttatttgactactctcttctgtacctgtttatgccagaagtgcacacacagagcttggcatctatattccataggaagttctcatccttctcctacctgaatcctacaagcatagcaagccctgggggctaaagatgtcaagggtactagacttcgcagataacatcagaaaatatcccatgaagctgaacctaactggaacaaggataaatgagtgagaagcagagtaacgggccacacacagttatttccatccgttttagttgacatatgaaagtgagattctgaacagtagtagcagaaacagaaagattcagaatgagagagagccagagaccaagactgcaggtgatgagaaaaatatattcaagatgatcgattcagaatgctatgtgggaagaattcctctacatatatcttattaatacattaaaattttattagtaagaactgatataaatgaatatattcataagaattcttcgtatgcagactatatgctatgtcaatattcttcttaggatccttaatcttctcttctcctgcctctgaggtctacagctgttgttgcagcaggcagcagaggcaaaaaacaaattgaccataacataaagtgctgctataaagacaaaatgaatagcagtcaatttaaaaagttgaaagaaaaaaatatattcaacaaattggccattctgcaaattagcttttggacaactaactctggcatatccacttgaagcctttaagagatgattctgcaataggagatttccattatccactaggtaccagacagcatctctcataacttagcaaagagaccagtatatgtctaagaagaaataagacacattagtggtccatgtctgaggcaataggattgtaacagaagtttagagagccaacaagcaacaatgtatccatttgcacccatcgtggtacaagggagactctgatattccagccacttagactagcctgctctagagtggggcagagagagcattccagaatcaacctcctcctgaacaaaccatcctgaactgtacttaagccaatgaggctcacctccaatatcccctgggatccaagtaaatccaaaactcagaaagtggggtagcctggacaatgggggagacagacaaacagacagacactaatacagactagcttgtcttgaatcccaatgctaagccaaattgaggcttaggcagatgaagtaacctgcctaagatcgcacttactacctgtgtcatcttaggcagattacctcatctgcctaagcctcaatttctgtatctgtgaaaatggtactctatgtcctaaggttattatgaggatgatggaaacaatccaagtaaatccaaacacgatgtgaagtgcttcgaatataataagaattaaataaaagtatattgccataatcactgttatcactattatattaataatataattattagaacaagaagaagacaccagacactgtagaggcacccaggaggagtgtctaacccaactgcactggagaagaaactgttttgctctgggtacttgccctgcctgaccccctctaaggaaagccatggccacagttgatgatcatgcctaacagaggtgacagtcactaacttgttaataagatcttcttttggggggaattggaaataatctaagacatggagagaaaaggcagaagagggaggccatgaggaagctgaagccaggagtaggcagaagccatgagtggtggaagcttagggtactgagaagtggtgcagcagagaagaaagcagggaggagtcagtgactgcggtaagacagcagtggtgctgccacgatggtggcacatggaaccaggagcaaggatacctctgttgctggggtgctgactggcacactggttgtcagtcaccactctggagtgaccttccagtggctgaactatgttctatccccgttagatctggctgttcagtggtttgatgaacacagtatgtctcagtaagaatgtgaaaaaccagccaaccggccaggcgcagtggctcatgcctgtaatcccagcactctgggaggccgaggcgggtggatcaagaggtcaggagatcgagaccatcctggctaacgtggtgaaatcctgtctctactaaaaatacaaaaaattagccaggtgtggtggtgggagtagtcccagctactcgggaggctgaggcaggagaatggcatgaacccgggaggcggaccttgcccacgccagtgagctgagactgcgaaactgcactacagcccgggagacagagagagcctccgtctcaaaaaaaaaaaaaaaaaaaaggacaaaccagctaaccttccctctcctcattagtgccttattcattcagctgtctctggaatttaagcagcttcttccccatgcttctgcaataaaggaatatgttctgagtaactatttcttcttgaaagaggtttctatgcacatgcagaaacgaaaaggcaaacaaaactccagaagggttccacaccaataaacttcaggagtgtctgtgtttttttttttcatcaccagcacagaggagcctctgtgtgccacctggcaagcttcttctcgcaacccacacagaaaagaaatacaaaaatagcattaataaaccccaaggtctgggactcttctgcttttgcatatacaagcacattccttccaactgctggataagaaagagagagagacaggcctatgaaatgtgtacccaaagctgggccagatggacccctttgagatttatgagactagctcttgattcaccaacccctccataaaccagatcctactgacaacagttttcctagagtaagagatagagaaggatttccctagtgagaaagggtaacgaggaatgacatttcaaagaaaatacagctactcagcgaggggtgatcctggagagttagaaatgtggttctaaacagtatgcacagtaagaacaaatagagaccacagggccacagaggaacctgcccctataaaaacttgtcaaagatgctccgccactctgtaaaactccaaacatccatctatctaaggaactgctgcagaggccagagtgacgactaggaatgagaagaaagcctgtcaggccctgaacagtccagggagatgtaagggagcaagagcagcttagttcatgcctggcaaagagatacaaggataaaagacgactagctgcttcaaaggtgcatggctccttcccattttttcttgtcaaaaaaggtcattagtgaaactcaagtaatcctttttttgcagattaaaaagtggccatgacctgcctttgaggagaagaggagaaggaggggtagtcatcttttaggtctccatacaatcctgcaatcaagtagctgctggggaggccagcggtaccaagttccatcaggtggcactgctcacaggcagggaaactaccatctctacacactctggtgagagccactgccccatcagcgtggaaacagccacatgcaaaagcgcagcctttcagaaatcacccatgttctcagccattcccagatattttcatttacattcagaagacgggagacatacctagaaacattccagcctaggtgtaaagtttaagctgaaagatttaatagaggttctggtatggactaaatgttcgtgactcccccaaattcacattctgataccctaagcccccgtgtggtagtattttgaggtggggcctttgggaggtaattaggtttggaagatgtcatgagggtgggacccccatgatgggattagtgtctttataagaaaaggaagaggctgggcacagtggctcacacctgtaatcccagcactttgggagactgaggcgggcagatcatgaggtcaggagtttgagaccagcctggccaacacagtgaaaccccgtctctactaaaaatacaaaaatcagccaggcgtgcgccttgtagtcccagctactcggaaggctgagcaggagaactgcttgaatccaggaggcggaggttgcagtgagccgagatcgtgccactgcactccagcttgggtgacacagagagactccatctcaaaaaaaaaaaaaaaaaaagaaaaggaagagaccagggccctccctctctcactctgccatgccagcacacagcaaaaaggcggctgcaaaccgagggccctcgccaggaactgaatctgtcaccaccttgatcttggacttcccagcctggcgaactgtgagagagaaatgtttgttatttaagccacccagtctatagtattttgttacagcagcctgagctaaaacaggctctgatcatggtgcccctaaactcaagtgaaaaaaggtgaagtctggactagcggcaggtgaccctctattctgggacctcaaaaatatgagactcgttcatttattgagcaaatactttcatgaggatcacctgtgagttgccaggtattatgtcagtcaagggttatttctagcaaaacatccagtgacaccctcaggagctgagtctagaggggagacggttaagaacagagtgcatggagcagaggcacaagcagtgggtgttatgggggtgcatggggaggggcagaaggtcccatcagtaagagtgcagacaaagcgacaggatctggcccagtggggcctctatgtgacaagcggtgagaagagatgaagaggctggttgggcgaggctgggtttgtatctgagggcatttggagcagaggaagctccaggccatttctgaatttagaagcccgctcaggtggcagtcacgtgctgtggaagcagctagcaggctctggggtgatccgggtgagatctgctgaaggcctgaataaaagcagcaccaaaagaactacacttctcagcagtgactccagccaggcactgggctacctggactacttcaccctcaccagaaaccagccaggcaggcactcttacccatgtgaggagacagacacagagaggaactaacatgcccaggtagcccaggtcaggaagtgacagagcagggttctgagcctgggccgcctgacccaagagcagggttcacaccactccctgtgatctattgctggaagttggggtagcagctggcaggaggattcttatttccaacgtaacatcatacatatgtttctaaaattttaagaaaaatatacacaatatgttataacattcttgcctctgatttcactgatcactatctgaaaaccaaagtgagtaggagacaagacctcccaaccacaccccacctccaccaccgccgacaaaggacatctttcttttgtgcgcctcggtgaaatctggcagggacaaaaggggtcagaggaggactgagaggcaaggtttctctggagaaagcagttgctgtgctgtgacaccactgcccagggcctgggggtggagtgtggatagcctctttctcaccctaaaccttaggaggagttccaagggcacctcccgggagctctgaagtggttctctgcacttgacccgcacagccattagggcccgactctgcctaggaaggggctgtgggctgcctcctgcccttgcaacctagagagagaagggccggctggctgctctggtatcagaagtaggtgaggacaggcaatgggctgttctgggggcactgacctcgctcccagatgagtatgtcctggagaaaacacggggacagcacggaagaggtggcctgaggtcatcctggacgctgtcagatagggctgcctgcaggcgtgtgaagaagtgacctcagagggcagagctcagaggtgcactggctgaggaaggtggccagggatgagcagggctgccaggtggtcacctggaattgagatggctaccaagctcaaggaaatcactaggcacagggactcagcaggggagcttcacaaagaccaggatattctcctctttaacttccaccaggcccagagagcacagcccaccccagcttctgcccgggcaggcggtgggcagaggcatctgggcagggccaggggccagaaggaggatgcagagggcaagggcccatgttcccttccctcctcaggggccaaggctgatgggctcggcagggagaacattttaatgcaaagttaggtttgcagttttattatccagccctgtctaatcactgggcctggatctgtgcctcaaagtgagagaaggactgtgatatctgagagtgaacaacaaagtcattgaatttttgacccaactaaattttcatccctaagaaaccccactgaatacagtttaaaggggaatacatagagaaacattaaattttcttcccatatacttcatgtgtgtgtgaaacattactgattagagcacatcagatcacatagcttccaggtactgaccatgagctgtttggtttccagctctttttttttttttttttttttgagatggagtctcactctgctgcccaggctggagtgcagtggcgtgatctgggctcactgcaagctccgcctcctgggttcataccattctcctgcctcagcctcccaagtagctgggactacaggcgcctgccaccatgcctggctgattttttgtatttttagtagagatggggtttcaccgtgttagccagcatggtttcgatctcctgacctcgtgatctgctcgcctcggcctcccaaagtgctgggattacaggtgtgagccaccgcgcccggccggtttccagctctttagatacaacagagaacttgagggaatcattgggataattgaggaaaagaatcacaatctactttcagtcaataaaaccaagtcttcatagaagtattttcagcatctcagtaatgtctccttaaagaagtttcaatgttaagaaatctatttttttctgctcaagtcatctgagtaaccattttcctctattgcctccctcaggcaacagaaactggcctgtactgctatgacattcctgaatcaatgaatctcactgaattttccttcctcggcaaatagggaaaggttttccaaggtgagtctcctgtataattgtgacaggaagaactggagtgttctgcattgagacctaaaatcacagacagtgggctgggaaaaaccctccaggaaaaagaaacatcatctacagcaaagccaaggagaaaagcaatatgggggctagagctcctctaattcccccttctccctactgggatcagcactgggcaccagttctttccttccaatcacccctagagaacccagcgtagtgagtgcaatggaggatgacaggggactggccagaggactgggagggagagggccagacttccagtttgacatctctgtgccttggtttccccacctatgaaatagaatgtcattctcttaaagttaacttgaggggatccagaagtcagggaagtgcaaatgcaactcctttataaaaagtggtatttttttcctgtgtagcattttacaacgtgtaaagctctttttgcatgttctcattggcttagtcacaaacagcttctgggcatccattgtgtaggaggcattgtggtaggaactgagaataaagggcaaagacaggctcctgtcctcaaggagtttccaggccagacaagccaggagtaggtatccactctgcttagtgggctaggtgctgtattagggaggcaggggcagaatgggaacattcaattcacactaaggaccagggaaaggcattttccctcctctgaaaagctgagtcctccctcgccccaatacctttatttctaattgtgagtgatcactctccctcttgctcccacttaagaactaagtaataagcataagagttgagcaaaacggaaaaggaatggcatccctaatttttccatgaaatgagataatcatatatagatttccacttttacgagagaagtaattttcttcttttctgatatagacaatatatatattttgtttctaaccccgtattattctcaaatcagacttcagaaaccacacgtatttacctccttttattctgtaagaatcgctaatatagtatgcttactggagatgtgaggcaagtactgacttctataactccatgacatagccagtgttttaaagaatgctgtcattgctcatttgctcattcattctttcataagcaatacctcttgaatacttgctatgtgccatctaacattctaggtactagagtgtggtaataaataaaaagtccaggcaataaacttgttagcgtctaagtgatgagtcgcatgagaaggaaaaacacaaggaaggggaagaaagggctaggtcaaaggtgacatttgagaagaaaccaggaagtagaagatagcactcatgtggttttctggggaagagcatgccagtcaggggcaagtgcaaaggccctggggttgtgggggtatgtttgggatgcgggaggaatagcaagttgataagtaggaccataggacacagtgaggaagcacacagtatgaaagcaaatgtcacacaggccatgggcaccatatatggctttgagtgagaagataagctcactggagggctagaagcagagaagtaaaaggatctgtcttacatttccaaaggatcactccagctgctgcacagagacagccctagggtgagggtcagggtgcaagagcagaggcagggagataattggaggcttctgcacaaatgcaggcaagatgtggtggccacttagaacagggtataacagcggaggtggtggaagaaatcggattttcaatatagtttcaaagtagagctgacagtatttgctgatgggctgaatatggtatgaggagaaaagaaagcagagtgtcaggaatgagcaagtagaagagtggagttgtttctttaccgcaattgggaagagcaggttgggagggcatgagaatcacttgtgttgttttgaatgtgttaagtttcagaagcctaccaggcatttcagtgtggatgctggctatgcaagtctagaattcagatgaggttggaagcaaaaatattcatttggaagtcatcagtgacagatggcatgtaaagccccaagtctagatgagatttcttaagacgagtcaaagctcagactgagccttgggcactccaaaatttagaggtcagggaaatgaggtggaactagcaaacacatgtgagaaggcaccacctgtgaggtatggaaaccaggagagtgtgatatcctggaagccaagtgaggaaaacgtttctcgaattgaggagtgatgtattatgccttagtccttgctttgctgataaaggttcccaagtacctggatgagaaaatgatgtgcttcaggacccagcatgggttcaataagaaagtgctaggttcagttaagtgcctaggccagttaaccagtgaaaaagtgaaagataccatctatctacaaagacaagatgcagaaatatagtctgatgtaatgacaagtagatggatgagaaactccttgactgatgacacccaagggcacacataagtgaatgagtgtcaaccccaaaggaaatttctagtgacatgtcattgggctctgtccttggcctgctcaacagcatgtcactggcttttatcaatgataactaaacttgactgcagtcacaacaatctagtaggcctgttaaaatagagcatcgcagtgtctatcctggacctactgaatcagaattttcccaggtggcatggtggggcaaaaggacagtctgccttagcagaaggaatagagggaggaggttgatcaaaatgtatagctgaaatcaagctgggcggaatggggaagatgctagatagaggctctggagtgatctcagcaggtggacaggtgggctgaaatatcactgtgtcattgtggaatcctgcaactgcctatgaaaatcagccataggtgaggtggatggggtaaccagttgggtctgcaacctacttgggactctcagtgagctgcagacaccgtgatctacagtggatcccaagctagattgatgaggggagaaaggacgcaatccagccacactctctacagcccctaaagcttcctctccatggtgcagaaaagacaccagagcggggccagatgagcaccaacaaaatggacaaggggctccagcccacatcctgtgaggaccacctagagagaagcagatgtttagcctggaaactcagaaggaaccaggccctcaccctgacatacctcccgggctaacatgtggaaagacttattctgtgggatccaacagggtagatccagaatcaatgagtgaaaactagtgggacatgattctaattcggtggaatgaaggtctttccaacaggaagggcaacctaaagagacagaaatgctgagcactttgctgtgggaaccattaaacatatatacacccctaagtagcatttattgcagtgtattattttaggtatatgcacacacccttcctacaactggataaactccatgaagactgaaactaggtcacttcatccacatttccctagaattcagcacaagccctgcccatgctatgtgctcaataaatgttatctgaatgaatgagttgactgtcactggatgttgtcaagggtgttgtggaggtgattcatgtcacataattgttaatgttccttccaaacagcagatcctatgatctctgaacaattgcacataaatcagcttcccttggagacactcatcctttgcatttttacagttgatttaaaactcagacaaaatgaattctttaaattattatgtctaatgttgaactgcaatattagccctaggtttaaaactcagactgatattaagtatggggtaatcatttttgctttcaatgcttctgtacttcacatgaatatgctgaaagtcctatctgctaagaaaatgtgtttcttccagtggaaatctcatccttccagctatgatccagtttggggatttaccctccaggcctcttacaagtaaatgtcgccacatctgggtctaggggatgtactgattcatgggctgatggtgtcagctcagcaggtgcagtgttcaccacactgtctaccaggctggggttcaccttgaaaacttactccagcagaggcctggccgaactcagaaattaacccaaagggctttgagagagcagtctctgcagttaccaaggagatcaacacacttcacatcctcctcaagagaccacaaaacaaacccaattctctggtccatggattggagcctgaaactctcctaaaatttgaggctgcctttcaaaactacctttgtgctcttgccccatattaagagtggacagcctatggtcatgtgtccaggggagggagccatgtctccagtgggcatctgccttagagcagacactgtgctgagggaggtctcatttaatcttcacaacaattctataaggtgagaacagtatacctattgccaaacaaggaaatggcatctcagagaagttaactcagttggccaacatcacacagatgagatgtgtgtattccacacatgtcaaatactggaggagccagtatttgaactcaggtctgtttacccctgtcttagtcggctgtataacactgatcataaactgggtgacttaaacaacaaacatctacttctcatagttctggatgctgggaagtccatgatcaaggcgccaagatttggtgtccagtgagggctttcttcctggctatgtccttacctggcagacagagaaataatctctcttgtctcttctgttatcagaagggcattaataaccctattcatgatggctctgccctcatgacctaattacctccccgccaaagcttcacctccaaatatcattacattggggatgagggcctcagcatatgaatttggcagggtggggagacacaaatattcagtccatagcaaagccacaaagctgtgctcttttcccacccagcaaccagagtgatcttaaaaaaaaagtcatattagacttttcaaaatgctccagtggcttccccttgtacctagaatatatccaaacttcttgcaggactctgcccagtctggcctctacctggcaacacaacccacctcttcttgtccttgctttctcccttctaggcctactggccttcttgttgttccctggagtcaccaaagtccctgcctcagggccactgcacttgctcttccctcttcctagaatgttcttcccccataccctgcagatccttcttccttcatccaggtctctgctcccatgccacctccttagagaggctgttggcaactacttcatctaaaagagactccttttcccaccactctctaacttgatgtttcctgccagaacttaccagtatctggacaaacatacttgggcagtaactgcttctcattggtgacccaccagaatgcaagctccatgaggcatggactctgcatccctcattgtcgtattccccacactcaggccccagacacatggccagcactcaccaaactgggctggtgcacggctaacacccgcttcaccctctgctgcctctatttgttccctgcttatggagttctgctacatggagctgggtgaccttggccaggttaacttcggatctcaagagaaatcttgatggtggcccttacaaaaaaggaactgctatttcatccctccctaaagaccgcatcaaccccttgctctgatatttgtatgacactgccagttttagaagtttgtgattttatcagagaagagacatttgaggcaactgatgaaacaaaaagataattatatttcataaagagaaaattaaaaaacttcaaaattaccaactgctgtttattgctagaacagataattagttcatttaatgccttccagcattttttcaaagcagatagaaatggactcttattaaaggagttataaaaagctgtgttatctggcatctaaccaacttcccagattccacaaatttccaagttcacaataggcttgaggcaaaagttaaccataatccaagacaagatcaaccgatattcaatgtaaaagtttctagagatgaaattatctctgttttgggaacttaatttgtctcccctcatacataatcactgccctgcctcaaaactccaggtagcctcagttactcttgttgctaaaaagtagtttgttttccataaaacattttacattctgtagaagaattttgtaaataaatacaggatggttcatttgcaaaactcaggatttgctttgagttttgttttatatggtctgtctgaacattgttttagttgtggaaatgcctactggcctctgaggggcttttgttgactggaccttcccagtttttctctcctttcttaatgcatttaccacttcaaaggaactctcagcttcaggccagggtcaggctagagggtgaaacacctacgggatcaaagaatggtcttctgggaaattttaagctagattttagtttatggcagcttttaaccattctatacatccccttgtccttacgtgggagataataaagcttttgtgtatagccagatacaaggatagatgaaatgctgcaggtgatttcacttgcaaagaaggaaggaaaaaagctgggaggagggggcgggtgtttatattcactgttgaattccactggtggcctcagtagggggagctgtagagaaaaattagaaggtgcgatgggaaggagaggtgtggacacagggggtgtctgcatgagtgcgttgcttagagcagaaactgcccagaacattgtatcttcactgtcacatagattactctgtatttccagattttccttttattatactgtatttgatcataaactgaatatttcttaatacttgccaccagcagccaaacattcccattatttacattaatgatgagtgtatttgatactcaaacatgaagttatatcccacttccttcaatccacatgctaatagttgtttaccacataacacactaaaaaaaatcgtttttatcttgagttatcttccaaagagttgaagaaaaaaagcagaagagaaaaaaaggctacaggtggtttagtgatatttataatcattactggaattcttgtgcctgagtgagaaaatatcccataggaacatcgatctttggctaactgatcaaattccaaggtatattctctgttgagcacgtgtattgttacttcagtaattattttgatgcagtcatcaatttaggcacaattcctaaagtgtctttgagagtatgacattaatcttccaccaacactttttcttgttaaagagccatgtttatactctgtggttgtcaaagagaaagggggataatacataatatgatgtgcagcctctaacaaccacgatgtgtgcattgtcatgatattcaacttactttttcattccatgcccacagtccaattccaagaaatgttattcccaaaaactgaaaaagaaagaaagcagtgtaaatataagggaaaatgccgctaatataaagaagaaacttttcaatcaattcttttgtcactttacctggctgggaaatagcttttcctaaagtgtgagcacttatctttaccaggaaaataaataccataatccccctacttaaaatttttacagcattaagaagggctggagacacacagttggttagaagtcattcagattatgaagagtaataattaggtagaatcctgagtacactgaaattatcaataacatttaatatgctgccttttagggtaggggaggaaacggattccccatggatctgaggcctgtggtcactagaaaatggataagcagaggcattaacttagaggaactgggatcttctcttcagtattgagccattacaaatgggccaggtcagcgaggggcatgtagagccttggatgtccctctttgatcatgccttccaaaggtaacaagaatcttatcaatgtaacccaaagaaaattcctaagttctgttttcagaaacttcgattgtgtaaattttagttcagaggacctcccaccacccttcttggttttgactcagttccacaacttcatgcatacacagagtatacaacacatgggactgagttacgcattcagccctaaggcagaggcacatctcatacatacccacaaatctcaccgttctgtcaattagctgtgttgaggactgggggaatgccaggagaggaacaggtgataaccaggagggctttccattttactgtttttcttttttttttttttttttttgagatggggttttactctctcacacaggctggagtgcagtggctcaatcacagttcactgcagcctcaactacccaggcttaaccgagcctcctgcctcagccttccaagtagctgggaccataggcgcatgccaccatgcctggctaatttttcaattatttgtagagacaaggcctcactatattgcccaggctagtctcacactactgggctcaagcaatcctcccgcctcggcctctcaaaatgctgagattataggtgtgagccaccactcccggactagggctttccattttaattaattctcactgtattccatctgctataagatacatatattttccccacatttgaacacatctgaaattgggatgtatcttaaaatccatggtatctcataattttttcccccttgatatagaaaacaatggagtgttttgtaactggggcgacacagacttgatgacacattgtacagagctgtccacccactaaaaatccaatgatcaggactgtgtgtaattggccatgagtaaagatatgcttcatctttattatcaatagcaactctcaatttcctttccaaacactgaaaagagacaagaagtttcagtgtgatggcagcacaccgtttattttactaacatcttgattaagttaatgtgaggaaagtggtccactgagaggggtatgcagagaaaaaaatgagtgagagtggttattttttacagttccagggaaatccgagacctgcccactgggcaagggcttcactgttctcagcagggagttcctgatactttgtaagcaatcactaataaatccaaacgggacttggacagatggcaggagcagaaagaaaaggggactgacaaaagacaattagctgctccgaaaacatagtggtgtttttaaaaagcagaccttcccgaagctctcgacactcatctgacattgaagcaagacaacacacaatacattctgagccctatacagaaaatcatgtccttgatttggcaagaactgaagacccctttcttcctaccccttgctcttataggggactccttggaaagtgttcagaaagatttctcgttttactatcccaactgaaaaaccgtgctcagccctggtcagagagctatttcattttacatttcagatccaaaacaagtgaatctccaaaagactcaaaggtacttaggactctgtagcacaaaagtaaaacaattcagcatgttactctcatatttataggtgctgggcaaaagagaacgaccactgacaagtgagtgtacaggctcccatgagacctaggaagcacagaagcacagagttaaggctttgacttcaacccattgacatcaaacacaacccagtgaaatggctgactttccaatgctgaagctcctcatggacaaatgtttggttattttccctgacgcagtattcactgtccctcctgctgctgatggtgtggacatgttcctgccgaaggcctctgcttgatcgctaagatttgtttttattactttccaggcatcatgcttagtgctttgtgtgcaatgtctctttaaagcttcacaacaattttactctgaaataggcgctcttattatcccctttttaggaaagaggaaaatgaggtttagagagtttaaataacttgctcagaggcacatagcttctaagcagaggagcagagacttgaacaagagaaatacatgttcttagcagtcctgataaattcccctttgctcccatgatataaaaagttgaggcattcaggctggaattacatggtacatgatcagcatatcatatattcctcccccagcaagcaaaggggtgtggaaaaggtaaagagagataaaaaccttgccttcacataagaactggctgtggaacagaaattccccactttggtgtccacaatggagttaagcaaaagaacagagaaattcaatggtgggtccacattctcctttttaaataaagttttcgtctctcctcttggcactttgagacaacttttttcattcacgagccatataaatagcttggaaaccaatggttttccataaagaggagagagaaaaaaagtagggatttaaagaagactcacagacaatttcctttataatcttgctcccatatttcctgctttgactgtgactttccaaacaagggtttaagaactgggaaagaacacaatttgaagttaagggaaacactcaatacctaagcaagcaagtggtgcaagcctgggcctcaacttgatacataccttcagtgctacatcactagcaaatgtcctcccaattattctcagaccatatgttttgttttaaaatcaagttgttccagttcccaataattaaacagagaagagccaaaaaacagagacaggcatgcaatacttgaggcacattcagtttccccttcccacctcccaaagaaaagacaaccataaaccacgaaactgacctcattctgaaacccagggaggcccacttgcaggaaatagctgagaagtcttaaagtcaaccctttactcttttgaaatggaaaaaaatatatctgaggcatcttatctgaggcatcttcccacatggcaatatatgcaaatgtacagtacaaatgtttgtcaacccaaattttgatgttttaaaataaataacaataattttgccggcatttgttgaatgctaagtatggctaaactacagccacgtgttgcttaataaagggaatacgttctgagaaatgtgtagtcatgcaaacatcatagtgtacttacacaagcctagatggtacagcctatgacgcacctaggctatatggtatagcctattgctcctaggctacaaacctatactgcatgtcactgtactgaatactgtaggcaactgtaatacaatggtaagtatctggcatccaaacgtatctaaacatagaaaaggcatagtaaaaacacaatataataatcttatgggaccaccattgtatatgcagttggctgttaactgaaacatcattatatggcacatgactactgtttcaaactgagctgcactggtaagtgtaaagtgcaggctgaattttgaaaacttaatatgaataaaaggaatgtaaaatatctcattaatatttattatcgattacatcttgacgtgataacattttggatatactgggtcaaatatttaaattaatttcatttcactttttaaagatagctatggaaaacgtaaactacataggtggtttgcattatatttttatagaataatgttggtacaaagtatcccataacaatatcccaggcactagatattgttttaatccccattttatagataaggaaactgaggcttagaaattttaaggccaggtgcaggggttcacacctgtaatcccagcactttgggaggccaaggtgggcggatcatgaggtcaagagatcgagaccatcctggccaacatggtaaaaccccgtctctactaaaaatacaaaaattagctggacgtggtggtgcacacctgtagtcccagctacttgggaggctgaggcaggagaatcgcttgaacctgggaggcggaggttgcagtgagctgagatcgcgccactgcactacagcctggcgacagagcaagactccgtctcaaacaaaaaagaaaaaaaaaagaaattttaagtattcctcccaagatcataaaggtgcctgagctacattgctcagaaaatctgaatccttagcccaagaccaaaactattatactttcctaatatgcacagaatgtttgtccacagagcaagctcagggacggagaactgtaatgaaactcatgccctaagtctctaaattactcttttaatttctaggcatcaaaggtatgttttcccacctaggaatgagaacagccctcaggcaggctgatggaagccttcaggcatagcagaaggacagccggcagagctgacccttgggaacagctggagaagaaaatggccccagcatgtgatgagggcgattagttacctctggagggacacatctgccccacttttctctgaattctacaaaaggaagatcctttcctccctatctggtggttttcttccttgctgaacctccaacattttgaaattggtacagtgccttattctaactggtataaaaatggatacttcaagaggccattcatccattcatttataatctgcaacaaatattcttgagttcctattttgtactagacactacttttctcttgggataaatgaaggtaagaaaacagaaacagttcctgcctccaatgagcatacagtccagtaagagagagagagagtcctcaaataaagagtaaaacgtaaaatcattcctaatggtgctacaaaggagaaacaaataaggccaaagaaactataacagggggatttgacctggaggggcatctgaaggtttccctgagtgagaaatgcgtacatgtagtccaaaggatgagaaggagttaatgagcaaagaaaggaggaagagtgtttcaggcagagcagaatgtacaaagtcccagtagagagagaagcatgacaagtaaacaggtctaaaaggcaattgctgtggctggtgcacagagaatgggggaagtggggaaggtacagcaggtttgcaattagagacacgagcatggaccagcccatgcaggccttgtagcccaccttaaggaatccagtcattctcctacaagtgccaggaagccatttaaaggccagctatgtgtggtgagcaggggtggggtaggcaggcaggtctttgcagatctgggctttggaaaaatgaggatctgggccgcagaaaagattagagtctgagtgcatctacagtgatcaaaaggaggtgactttggtaatacaggcaagatgtgatcatgtcctgggctgaaatacggtgaaacggtcggaattgagagctactgagaagtaaaactgacattttcagtgggggtgggaggaaggggaaggaaaaggaagtgttaaggataatgcctacatttctggcatcttctacagagactatggctcttcaaaattccaaagacttacatcccctctgacagaagttattctcaggtgccaatttcataactagcttgatctagtggcacttctgaaggacagttttcttttctgtgtattttggctgctatctgaattctctttgaaataaatttcggtttgtatacttttaaaaaataaattatttaaaaatatacatatatttccaacacccctgctacttttattcataaaaagcaaatagatagatagatagatagatagatagatagatagatagatagatagtatatatcaagttcctagacaattcttaaattgacactttcaatcctctttgcttaaaaacatagcaattacattgatggcatctgcccaggatcctgtgaacagactcaaaataacagcacacaaggtaaatatgatagaggaaaataaagatcaagtcaatcttcttacctaaattggagtcacaaaaatatcatcctaaataacaatgaatggaaaaaaacccaacattctgatgaagtctttaagaaaatgttaatccctgcctgaataaacaggagaaatgcatttaaaaatttagcatagaagggaggcaaggggagaagtgccattaggaaagttgtattttcctgaagctgcagcacctgtactctgtattatatattttctgacactttagtctgaacaacactcgttttagcagggtccacacaaatgtgctaaatacttataataacaaaataaatgtctttatagaggagggacttatttcaggaataaaaaaacctctggggataattctggccatgtcaaaggagtaactgtgggctggtggaaaattcaatatgcagaaagtcaatcccagttttcccattgggtccccgtgtcccagtttgtacattcaaactgtccggagtcctcatggtaagatggcgtgactgataaagctcaaactgtaaacaggacatgtcccatccagccagggtcaccatctctcatgtcacttcatcctgatggcctcctttcagtgtggcccgagtgcactctgcctgctgaaccctgactccagtgctacgtagtttcatgatcttgggaaagggtcttcattcatttggcaaatatttattgagcacctaccatgagcaaggaggtcatctaggggctttggataaactgggaaacaaaacaaagtgactggtcttgtggggtttacattctagttgaagtgtgcaggaagagaaaggcaatataaagaaacataagtgagtagatgcagggaattttttaaaatgggaagtgctgtggaaagagatcagtgtcacgggcttgtcatgtggcagaagacagaggaggcactgcaatatgaaagcagagcaaataacagaggtcttcactaagaaagtgacatataagcaaaaacacaaaagaggtgaaggagtgaatggcaggtgtcgggggaacagcattccagggaaagtctggaggcacagccaccaagtggctgcaagacacagcacagaggatgataggagccaggttgtgttgggctttgcaggctgtggtgaggactctggtttctcctgagacaaagaatcactggagggtttcttgacttcttagagctctggtgtccttacctgtcacatgcagataagaagggcacctcagaactgcacaaagcaattgtgtgtgttgatgtgaccacgtgagcactgagtgcttggcaagtattgtcattaatatcagttcctgcccccctcctgacacatttctcaacctgcccctccaaccctgccatctacaactggtcaaaatgaaatgcagcttcacgtcctgcctcctccaaatacaagaaaatatactagttcacagtgatcagaggctctctctctctctctctctctccctctcctgaacttctgtatcacttgctgcatgtgcccttatttgacatttacacacacacacacccaaacacagaggattatggaggagtgatgtgacctgggattagataacagagatcagtgatggggcctgtcctaaccagagagcatgtgctcacaggaagtggcagcatccggcctcccatttatcttctctcctcaatttcagcttgagggtcattccaggaaaaaatgtatacagtatcccatgcatttaaaacaaactaacacactctagtcagatactcatatggtacttaatttcacatcttttccattgcttttcttagcaacctagttcatgaattctggatgactagccccagaacttttaaatccactaattttgattaatttaatttctgcattaaagaagtttctctccatcagggcttctagatgcatctttcctctccgtaaccttattgctcctggtttttgcatgatatcctgtgtgaatgggtttggtttcattgtgcctatttttttacagaatcctttcagaagaacgtgggatacaaatgataaccaatattaatcgagttagctcctccatctacatccccctttctgaaaactggccctgccccaacaggggctcctgtacgcatatttgtggaggatgggccttctcccactctctggacagatgagtcactagggtcagacatatgactcaggaagagctgttccactgaataccaggctgggccagagtctcccatttcccaagagtctggtattggacaaagtgatttttctcagcctagtctccctcatgctagaatagactgggggatattatgtagatatagaaagtagaaaagagacccagagtagcttatgttcctgactgcttccagcttcttatcccgggacctgtggttgcactccttatgctgggttccatgcaatcccctgggctcctattttaagtaagcgcctctcatcttagctaaagctactttgggggcattctgttacatgcagccaaaagcattctgctatggtttgagcacggtttgtctgccctcaccaaaatgaatgttgaaatttgatccccaatgtggtggtgtcagaaggtggggcttagtgggaggtgtttgggtcatgggggcagagctctcatgaatggcttgcagctgttctagaggtaactgaacacttgtattaacagtagtgagttcttgctctcctgagactggattagttctctgggaatgaattatttcccacaagagttggttggcattaagtgagattccttctcctgtttgatccctctttgcacgtgtctgtctcccctttgtgcatctcaccatgttatgatgcagcatggaagcccttgccagaaaccagggccatgcccttgaacttcccagcctgcagaaccatgagctaagtaaatgtctcttctttataaatcacccagtctcgggtattctattgtagcaacaccacaaaacagattaagactggtcctaagacataaataagagaccagatcaattgctttcatgctttaatcctgtgacaagcttacagtaagctacaagatatgcaaaacaggcatgagactgatggtgctcagagactaatcatgctctggcagagggaaatttctttccaaataattgaatggagataccagttgttctgaactactgggcaagatgttgttacttgctgtgtaaggaatatataattcagccacacatccacttgcaggaaagagctgtctgctgcttgcttgttgaactatggaagcagaatgatatggctaaaatccacagaatggttcctgaaaaacaccacatagcagagcctgggaaaggggtgaggcaggggaggaggtctatttggaggtatccaagcatttttggaactgtgttctctgttttcccagaggatgaaagggctctttgcctttgaacttgcactacaccaggagaaggccaggcaccccttgaagaaatgtctacaatccagggacagtcttgtttgcaaactcttttgttagggtttggaacttgacattttggcaaggactagtcatctgagatggggaggggagagaagggagggctgtgcaagcaatcaaactgatactcttcttggaaattacccaagcaatgcaggcacgtaaaagggaaagtgagggatgagccatcctcttttggatggaaacatggaggctgcaagtttacagcccactaatctttgcttgtctcagtaaaagaaaggcttgcactattccatctgtaactccctgattagataaatccaaggctgaaaaacataccagagaaatgttctgaaggctgagaaagactgaggaataactcaagcacttcaaatcagaggcatgagaagtaagttatctatagacaaacatcagcctttgtaggaataaactgcggtttgcattagacagctgagttataagctctctctaatggtagcttcgaaagtttaatactgtcagatgcacactgtttttatgttgaaacatcttgacttttttttttttttttttaacttttcctaggctcaagtgatcctcccccctttagcctccaaaagtgctgggattacaggcgtgagccacaccacacccagtctatcctgacatttaaaaacaaggtatgataaaggttaatgcaaataaaaaccaaaatagaattattctttaaggtaaaagtaggattatatcattcaacttatttaatgaatatcttcagtatataccagccaccatgctaggtgccagggatagaagggtgaaaaagaaaatgaatgatatcttttcttaaagagctaatggtctggtgggagtgggtgggagatacataaataaaatgacaactcaattacagaaatggagcattcccagagatgcacatgggttgccacagaaactatgagatcactgcaggggtcagaggaagcttcctaggaagtgacacttgaactgtattttaaagagacggcgatagaaagactatctcctgtagaggcaacagcttatccaaaaggatcaaagcctgaaacagcatctcccttcaggaacctgcaagtggttccagggctggagcagagagagccagacaaggcactaggcaggctatggtcccgcaccagtggtagcaccagggaacttgtcagaaatgcaaattctgaggcagctcgagacctactacatcagaaactctgggggcagggcccagcaagttctgtcttcttaacaagccctgcaggtaattgtgacatgtgttgaagtttgagaacctctgggctagaagggttaaggcctgatcagcatagctgtatgtgttatgggtaccaagggaccagcaagccatgggaagccaaccaaggattttaagcaaaacaagttatcagatttgcatttcagaaacatctttccagcacagtacaaagaatgaattgaagagagatgagactgcaggtagcaagacaaattgggaggctactaatttggtgagaatgacatcagctgaaaaaggaagaggcagccgcagcaagatggagacagcagatgaaaaggcagagactctatggactcagtggcaggaagcagcagggtacaaggttaaaattatgggcctttaggtccaggtgcaatggctcagtctgtagtcccagcactttgggaggccaatgtgggaggattgcttgagtccaggagtttgagaccagcctgggcaacacagtgaatataaaaaataaatatgaaaataaaattaaaaagattagccgggcatggtggtatgtgtctgtggtcacagctacttgggaggctgagtgggaggatcgcttgagcccaggagttcaaggttacattgaggtatgatcacgtcactgcattctagcctgagtgagacagtgagtctgttagaaaggaaaggaaaggaaaaacaagaggaaaggcaaggaaaaaaatgaatggatgaaggggaatgtcctgggaggtgaagaaaagagtgcagtctaagaaaacgtcccagtttttagcttaaacaacttggcaggcttttggtgtcatttacaaagttaggaatactagaagtggagaatatttggagagaaatatcagttttagatttcagttttaggcgttattaccaagacagatgtcagacactgatgtggaaagattctgactcttgcacaaggaaatctgggggctggacagcagttggctctagagtcaaacttagcttagcattcaggttccaccattactggctgtgtgacctcagacaagtaatttaacttgtcagtcctctacttcttcctctacaaaacacagagacaagtggaatctatctcgtggggtcattgggaagactaaatgagataacgcatgtgctcaaataacgtgcttaaagtgtgtggcacatgaaaaggtgcctggcatatgcctggctcaataaataactgactgtggttatcattaaggctacatatagtctggaggaaagaggatcaaggcattgtcttagagagcatgaagatgtatggggcagtgtacagaggggaccaaaaggggagattcagaagaattagataaaagggcagcaggaaaccaagaaagaggtgccaccaaagcccatagagcaattacacattaagtaggggaaggggccagctctactaagcaaaggggtggcaacagtggagactgtttgtgttccgttaagtgaaaattaaaacatagagcaacaagaaagcattaaaaaagtaacttccctcaactcaaatgagtccagcatgaccaccagacactgggcattgtgtggctaggtaagatgagttgggaggcacggaaactgccaaaaaggaactcaggactggcctgggggcacctctgtaatatctggaaatatccgttaccttacgtaggagacaaaagggaggcagtgttacacaatgtgttccaaagaccatcagacggggagtcaggagcccccaggtgtagtggcgagctgcagagtaactgtgtgtgaccttggtcaagtcactgaatgatagtctcctcaagtgtaaatgggtaataacacctgctgcaatgtcacaagactgtgactgtcaaacacagggaagacatttggaaaagaatatgttgcatagatacaggataaattaaaataccaccttttatccatttcttaaaataacagagatataacgctgcagttatggctgtgtcatctggtacctgcactgcctttagaaggcagcacagattagccattcatggaatcggtacttatctggtgcctatttccagaagagtttgtgtggggagacaattctcacatctacacttttttggggggcagggtgggggggatagagtctcgctctgtcgcccaggctggagtgcagtggcgcaatctcggctcactgcaacctccacctccccggttcaagcgattctcctgcctcagcctcctgagtagctgggattacaggtgcgtgccaccacgcctggctaatttttgtatttttagtagagacagggtttcaccatgttggtcaggcgggtcttgaactcctgacttcgtgatccacctgcctcggcttcccaaagcactgagattacaggtgtgagccaccttatcagcaaggcactgacattacaagtgagtccttcgttactatcttttcaagaaaatttgaacagcagatagccttgaaagattcagtgtttctttacagagcaagggtcagggagacttactgcccattataaaagatcggagttccctaagttcagggttcctctcctagaatacaactcactatgtatcacctggccctctctgcaccaccctgtaagaattagggctcagggaaagtgtacaaaaatattgatcctctggttcctggcattgctgtgattaataaagtcctatgtgtctgccccagcagtgtgatgccttctgccaggatttgtgacactgtggcaggataacttgtttgctggcatgcagggtgaaatctcagacccttcacagtccttgacactcagtgttattgttccacagaagagtttggtgtcttagattgttctccagccccctggcttgcttcagcttgccctgtgggatgtcagcaccatcagagctgaggaggctgctgagatattaatagctatttttaaaacacttatcacaaatgctctctctatgcctatatatctgtgtgtgtttttgaattttattttgtttttgtgggttctgttttttttgtttgtttcactgatgaaatctttcttttctaagaaacacaggacatttatacatttaaagagaggaaaagtgactgttattaaacagatgtctgtgctacagtcaatatatcattctttcattttaaagtgttctaatttaactgtaaatattaaaagttcctaagaaataactccatgtttcaggtacattttagtaaacatcttgcctttgaaataattgaaatgccaggagaatgtaacttcaaagcttcagacattgtacagaatgagctgaatggtgtttcctacacttacacgctcccgtggcctatgtgcccaacccccacattaggcaaatccactacagaaaactatactcagagtacactgacttcttgttagaattcagaaagcttctttaaaatgaaacctgattgataacattagcaacaaagtcatccaagaagtcatctctgagaacctcaagtccacgctgaaacaggaagtgaattttctcctggtgggccttttgaaataaacgctccatcttaaaaatgccaggacccttcttaatagctatcatagaagttatacctccgatcaaatcaaccatttacaaaaagaatgatgacaggtgccttcacttcaagctctgttttcatatttccatacccatgtttaaaatccccttaatagttgcactgaactgacgtcatctttctgatgctttataaattcaatcaaaacctaaaacatcttgagagatgaatgcaggatgcatggggcataatcaggagatcccaatccattgattatcatgtgaaagaaggcacagaggcaattagtcctttgttgtggatgacaaataacctccacataaaatgttctatacactgaggcatctttgatccatcttactggctcagtgactcacaaaggaggaaggaggggggatgtctgaaaacaaaagggcagcctgacgacaccatttagttatttattctgtatgttcagctcagtttttcctctttccaacttttcatgatactataaaaagaaatggaatggattcctttcaaccaagaacatcagcactgcatactaagaagtaaagtactggcttaacacagagcccacagaagccaccgaatatcatcctctctccttagttaggtattttttacaaggaaaatgggttttgacaaatcattcttttatatgttcttttatataagactttaatgcacagactcttggaaattaatttacatataagacaaactattcacagcttcaggagagaaggctgggttctcaacaagcactgccttggaaactatccatgtgtgtgcactctggaattttccttttctgttagaattgtttggaagagtctcctgatgaacaacagcatgagggatgtgaataagcgtcccttatttcctctggtttaaagacatccataactttttgttctctgaataaaagtggcatgacattaaagtgagttgaagatataaaagcatgtgctagagatcagcaagcttctaaaatgatttactaattcagatgaatattaaaaaatcaacatggaaataaaaattatggtttttttttgagacagagtctccgtctgttgcccaggctggagtgcagaggcgcgtgctcggctcactgcaacctctgcctcccgggttcaagtgattcttttgcctcagcctcttgaatagctgggattacaggtgtgcaccaccacacctggctaatttttgtattttttagtagagacaaggtttcgccatgttggccaggctggtcaacatgaactcttggcctcaagtgatccacctgcctcggcctcccaaagtgctgggattacaggcataagccaccgtgcccagcttttatctttaaaaattaagaggactgctaatttcctgaagttaaaacagaaagtataaagggaccatacaaattataaatagtgacacagccaaatgagcctgacctctgatgacaaaccttggttcaaatctgggccccagcatttaatggatgtggcctgggcaagctgacactctcaattttctctcccataaatacagactattgcctagcattcacatagcattgatatgaggatcaatgagttaaggtatgtgttttatgtatagtaggcactcaataaacacactattattgccattaaaagtgtaattaaaaagtctcttacctaagcacaatataaggtcacttttcagataacaaaaagaaactatcacatcatctgtgcattattcagttaatctagcagatttgtatcagaaccgaaatagcatatactatggggaaaaaagattgcaaagaggacctaaaatccttttttccttttgcaagaaacttcttttcatttttgatacaagatttcatttaaagctgtttaaccagagagggtcgccatgggaaagtaaaccgctgacagaatatattaggttcacattaatttacagtggtagcataatgcttatgaaaaataagctggctggaagcccacagtttgcccttgagcctcagtcagcagggaagttttgtgcaatatgattagtaaatgaggagaccctaggtgattaattagtgctccatgtcaatcctatcagacaggctttcagccagtaacgtaaataagccacctgattttaaacttcctcctcttaaaactgacgtccatgtgagcatgactttgtcaaacacttaaatattgaaggaagatttcctccaaatctcctttaagataaatcctgcttcctttgacacacactttagctctggtaaatggcagactagatgggaaagaatctaaataaggaagcttgtctgagaattctgagtactgaattaacaaaactcatttcataagtccctattaactgttcaatgctcaaaagagaaaaatctgactatgaatagatttactgcctacacctgtgtaccagtcagtaacttttcccagactttactatgcagttatgtttttaaaaatctttttactgtgtgtcattaaattgttaatgatctgttttttatctataatttcctagatatttctgatatgtattttatcaaggtattgtcccaagagagatgtttctatggccaggtctgttagtttacgtagctgcacagtcacttctctggtatctattactatttcagtcaagcttcttaaattagatttaaaagggaaagaaacagctttcctaaattaaatcagttcctttaaatgaggttgacccttgagtaggtaatttgtgtaaacataaaatgggtcctgctcttcctaaaatcttatcactaggttctcaaaactgggctccaaatgtgagatgtggtgtacagcaggtcttcgagaaatgtcattttgttcaatgtcgtttccttcagtaacattgatgagaggccggggccattgtgcagagtttgcacatttgccccacgtctgcatgggttttctttgggtactctggtttcctcccacatcccaaagatgtgtgcattaggtgaaccgaactgaagtgtccacacggtccctgtctgagtgagtgtggatgtgtgatggaatggtgtcctgtctagggtgggtccctgccttgtgccctgatatgccaggacagactccagccactctcaaccctgaactaaaatcatggaatcattgagtaaataattattttgtttttattaatcctttctcttgttttcgagacagagtcttgctctgtcccccaggctggagtgcagtggtgagatctcggctcactgcaacctccacctcctgagttctgtatatatagctcacatttatttcaatgtttaatattaaaagtgttttgaatctttacttagtttgctgatgtttttgtgaccagaaatatgtcctagcaacttcaacttttgtctgtatcaagtagcctatggtaaaattagatttcttatacatacatgtcattttgcttaaagtcacagtttccaaatagatgatcttaagtgaggacttactgtatctgtataattaagatataagtattccattcttgtctgtatactattttctcattgtagatgaaaggctctatatgaataaaatactgcatataaatatactcacatatagaatctacagatcaccgtgtacatacacagaaacatcaaaggtgtcctaggctataaagtgcaggtctcataggctaaaatcattaactgttacatgctgcaaaggtccaaggtttaaagatatcaggctgggtctcatcagaaaggaggctgatttttgctcaaacaccgttagaactgaaaggaacctctgaggcccaacaaagtcaagtcaggaaacaggaaaattgagaatctccatttagaagccagaataccaatctcaacctaatgtcattctttttcacatacacaagaaatccaaggcaggccaggtgaaaacatctgaactagatagtagtcatggcgagaggcaacccgctcccaagggtaaacacacaaactctaattctacggctttcaaatgtcagcacaaaggtaaggaagcatccaagacaccaggcaatttcctaacaaatacctctgagggcttcagtgggcaggacatcttgctatgttcacaggttgataaatgatggcacaatggagttcatgccctgatggtacttatcatctcaccatagagataagttatgaatcaataatgaacctaaatgccaatttgcagtaaatgccataaatgagactgagaaaaaataagttcagagaaggccaccagatgccaagatgagggaagatttcatgagggggtacaggtctcaaggggggtggaggatagaattctaagaaatggagatggaaggccttctagaccactgttttttaaacaggttgcaacttgcttgatatcacagtttaatggccattttcttcctcaatgaaatggaatagaatgctatagcatgtggcaagataaagtactatttcatgaagctttttagcctcatgtaaattgtattggttgttctgcttcatgaaaaatgaagagtgaggttttgtatttggctggaaaataagaactcagttatgaggtgattccaaggcagcatctaaaacatagcatcaaagaatctggattttgtactgttttttgcctttttaaagctttattgacatcgactgtgcttagtatctcacacacatgatctcacttaattgtaaccaccactctttgagttgggtattattacctccattatagaggaggcaagtgagaatcagacaggttatataaccagcccataaaatgaagccaggtcttttgaatccaaagctcataatgttaaaaaggacacaaaagaaaattatgaaatgatcagagctgggctttaggaatattaatcttgcaccttcaaagagttacactgaatagacattagacaactatatcattagagaggtttcttttgatcactcaatttagatataaaatcaatttaaatacactccaaattctaggcaaaaatcacacccaaaccaagagttaaaactgctcttaacgaccctaaaaatatttcagtgaaggttcttatttctcaatagctatattaatatccccttacttcattctgcagccatgaagctaatgacttatcatttgaaaaatgctttgaagaaaatatgaaaataggtggaaatgcagaactctgcctaaagcagaaatgctaacataaaagaagtaacccactgcttttctcagactgactcgccccagccctctgttctcacccctacgtgctctgtctgatcctacctacctccgggaacaactgtgaggactaacggtgtaatctatgaagtgcacagggctccctggaaaagcatggctgttaaaagcccggatgtcatcactagaggcagctgagagaacatgccaacagtcgactgctaatataaaaatgtaaaaaagaaataacagtagacgggataatgttgtgtctaatttaaagaggaaaaaagaattcagaagtagctatttctgatgaatatgaaatatctgggtattgagcaatgaaagacaaatattcttcctctcttttctgttgaaagcatccctcacaacaagaatcaaaaaagctcctccacatacccagaataacccaattgcccaacaggcagagagaccagaagggtaaagtgttcctctgtccggcatatgagctggatagagaaatgtacactaaataccctgcaaatcagaaaagccagctgtgcacaggattatgctcttcttcatacactctgaacgatctattcaatggttatggactaatatatgaactctctttaaaagaaaaaagtcatagatcctcaaggttgacataagttattatttattaaaatattccttaaatatgcagaaatagaagactggtataaaaccccaagcaaatttatatatcaactaaaaagaatactatcaaaccaacagaactgaaactagccaaaataattaaatgtaacagatgatttttttttttttttttgctgtcactaaaacactgatgtaggcatccagtctagttctatatttaatctgctttggtattttaactttcacaaatgtttacatagagaatacctgtttacataattatattgaacaaaacagcaaaaaatctagaggacagactgggatgattagacctcatacttaacccaaagtcagccatacttaacccaggtgtcacaataactctacaaagctctcttactaacttgaacagagttagtatcagagcattattgaaatttgcattaaataggtgtctcattcaatcaggtagaaatgaaaaacaggaactttttttattgtacatttaccagctatgctcactactataaactattctgcaaggtgtatgtacaagggctagctagacctgcccaccactctgctggaaatggggggagggtactgactgctcccattttagtatgaccatactgcaaacagcttttcatttatctcattcagtcttcacaaaaggggagaggtactgttattattcacatttaacaggtgaggaaacagttaagtgactcacccaaggtcacacagattgacagtggtagagccaggatgcaaaacaaggaagccttactccaaactccaagctctgtaccacaaatgcttcttgaccaccgtaaatccctgtgtggcacgctgtgataccacatggccccatccacccactgaaaacacacacacagatgcaggtctgcccttacatccaagcattcatttataatgtggttgaccacatgatcccaaagatgctaacacttctaaccgcctactacatatctccatttggttactactcattcaactaaagcatgtgccctcgaaaatcaatgaaattagagacttttctttccagctggaagggtgtagcaagcctgatttgaaaatgattacaactgcttctacagggtaaaaaactgcccgaagtgggcattgagtttaaacattatatcctcgtcattaataaaaacaagagctaacatttattgcatccttacaatggaactggcacagttacgaacttgtgtcatttcaataaagtttcaggacaaccactgaagtaaacaccatatcgtcactttccaactgtggaaactgagcttacgagacattaagtagcctggactagagttgctacctacctagtgactgggaaaaccccaattcaaacccaggcatctgactccagaatcccgaccactccaaatgcaggatgagaagatctattggcaatacagtttctcctcactgcgtctcagaacttggggattcagtttcatttagacttctgcagccagtttaatctctaacctactcatcttgtttggttggttaagagatgttatacagccacaaaataacacaagatctgtaataattcagaatcttttggctttgagaccaaaaactgctgtaatcctaaaaagaatcaccaattaaaaactaagattttgagtatgttcaagtaaaagaatctacactgccatagaagcacaaaacccagctttggtcagaaagctagaccacagtttctgcagccttgacttcagactctgagttccttgatgtaggtgttgtatcttggacatggcacctggcaggaaaaagatggtgaaatgactgagcatcaggcatgggcctactctgctgttgttcaccaggccatcacctgactgggtaggcagaagggcctgcacacacattgccaggagctaacaaggtcactgggaccagagcaaatgagagacagtgagcacatcctgaaatggccagagatgctcagggatgaaatgtcccctagacactgagaaagtgataatggtgaacttttgttgctcatcagcctgtgccaggagctataggtgccttctgtacatgactaactgtcatcacactgtgaaggagacaatgatatccccatcatacaaatgaggaaacaggctcagaggcaacacagctctagaaagcagcttgattaaggccagggctccctgaagccacagtggaaaagccacagccgtttccactttcctagaggcacactccaccccacctgcacttcggccatgaaagttgaaacaaagtgatgggatgtgcattggacttgggaataagggaatgggagctaaactgagacacagatatttagaatcaacaaagattttagaggttgtctagtctagttttttcatttgcagagtaaactagagcagttattagattcacttaagattacacaacatatacacacatattatacacacacacacacacacacacatatttagaaacaggatcttactccattgtccagactggaatgcagtggcaagaccatagctcactgctgccacaaactcctgagctcaagccatcctcctgcttcatcctcctgagtagctgggactaggggcatgtgccaccatacccggctaaatgttaaaatttttttaaaagacggtctcactatgtcgcccaggctggagtatagtggcatgaccatacctcactgctgcctcaaactcctggtattatataatctttctgcctcagccttctgagtagctgggattacaggcacacttctctatttttatttattcttttttaaattatactttaagttccggagtacatgtgcagaacttgcagtttcattacataggtatacacatgccatggtggtttgctgcacccatcaacctgtcacctacattaggtatttctcctaatgctatccctcccctaccccctaccccacgacaggccccagtatgtgatgttcccttccctgtgtccgtgtgttctccttgttcaactcccacttatgagtgagaacatgcagtgtttggttttctgttcttgtgatagtttgctgagaaagaggatttccagcttcatccatgtccctgcaaaggacatgaactcatccttttttatggctgcatagcattccatagtgtatatgtgccacattttcttcatccagtctatcactgatggacatttgggttggttccaagtctttgctattgtgaatagtgctgcaataaacatacatacatgtgtctttatagaatgatttataatcctttgggtatatacccagtaatggcactgttgggtcaaatggtatttctagttctagatccttgaggaatcgccacactgtcttccacagtagttgaactaatttacactcccaccaacagtgtaaaagcattcctgtttctccacatcctctccagcatctgttgtttcctgactttttaatgatcgccattctaactggtgtgagatggtatctcattgtggttttgatttgtggtctaatgaccaataatgatgagctttttttcatatgtttgttggctgcataaatgtcttcttttgagaagtgtctgttcatatcctttgcccacgttttgatggggttgtttttttcttgtaaatttgtttatgttctttgtagattctggatgttagccctttgtcagatggacagattgcaaaaattttctcccaccttgtaggttgcctgttcactctgatgatagtttctttcgctgtgcagaagctctttagtttaattagatcccatttgtctattttggcttttgttgccattgcttttagtgttttagtcaggaagtctttgcccatgcctatgtcctgaatggtactgcccaggttttcttctaggatttttatggttccatatgaagtttaaagtagttttttccaattctgtgaagaaagtcattggtagcttgatggggatagcattgaatctataattaccttgggcagtatggccattttgacaatattgattcatcctatccatcagcatggaatgtctttgcatttgtttgtgtcctctcttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtatagcaatgcttgtgatttttgtacattgattttgtattctgagactttgctgaagttgcttatcaacttaaggagattttgggctgagacgatggggttttctaaatatctgtcatctgaaaacagggacaatttgacttcctctcttcctaattgaataacctttatttttatttctttctcttgcctgagtgccctggccagaacttccaatactatgttgaataggagtggtgagagagggcatccctgtcttgtgccagttttcaaagggaatgcttccagtgtttcctcattcagtatgatattggctgtgggtttgtcataaatagctcttattattttgagatatgttccattgatacctagtttattgagtttttagcatgaaggagtgttgaattttgtcaaaggccttttctgcatctattgagataatcatgcggtttttgtcactggttctgtttatgtgatggattatgtttattgatttgtgtatgttgaaccagccttgcatcccagggatgaagctgacttcatcgtggtggataagctttttcatgtgctgctggattctgtttgccagtattttattgaggatttctgcatcaatgttcatcagagatattggcctgaaattttccttttttgtggtgtctctgccaggttttggtaacaggatgatgctagcctcataaaatgagttagggaggattccctctttttctatagtttggaatagtttcagaaggaatggtatcatctcctgtttgtacctctggtagaattcggctgtgaatccatctggtcctggacattttgttggtaggctattaattactgcctcaatttcagaacttgttattggtctattcagggattcaacttcttcctggtttagacttgtggggggtgttatgtgtccaggatttatccattattacaggttttctcatttatttgcatagaggtgtttatagtattctctgatggtagtctgtacttctgcgggattggtggtgatatcccctatatcttttttttttttttttttttttcttgagacagagttttgctctgtcgcccaggctggggtgcagtggcgcgatcttggctcactgcaagctctgcctcccgggttcacactattctcctgcctcagcctcccaagtagctgggactacaggcacccgccaccaagcctggctaattttttgtatttttagtagagacagggtttcaccatgttagccaggatggtctcgatcgcctgacctcgtgatccgcccgcctcggcctcccaaagtgctgggattacaggtgtgagccacagcacccggccccctatatcattttttattgcatctatttgattcttctctcttttcttctttattagtctggctagtggtctatccattttgttgatcttaaaaaaaaaaaaaaaaaaaaaaaccagctcctggattcattgatttttttgaagagtttttcgtgtctctatctccttcagttctgctctgatcttagttatttcttgtcttctgctagcttttgaatttgtttgctgtgcttctctagttcttttaattttgttgttaggatgtcaattttagatctttcctgctttctcttgtgggcatttagtgctataaatttccctctgcacactgctttaaatgtgtcccagagagtctggtatgttgtgtctttgttctcattggtttcaaagaacatctttatttctgctttaatttcgttatgtaccctgtagtcattcaggaccaggttgttcagtttccatgtagttgtgtggttttcagtgagtttcttaagcctgagttctaatttgactgcactgtggtctgacagactgtttgttgtgattttcattctttagcatttgctgaggagtgttttacttccaattatgtggtcaattttagaataagtgtgatgagttgctgagaagaatgtatattctgttgatttagggtggagagttctgtagatgtctattaggtccgcttggtccagagctgagttcaagtcctgaatatccttgttaattttctgtctcattgatctgtctaatattgacagtggggtgttaaagtctccaactattattgtgtgggagtctaatcctctttgtaggtctctaagaacttgctttatgaatctgggtgctcctgtattggatgcatatatatttaggatagttagctcttcttgctgcatcgatccctttatcactatgtaatgcccttcttttctcttttgatctttgttggtttaaagtcttttttatcagaggttaggattgcaactcctgttttttgtttgtttgtttggttttggctttccatttgcttggtaaatattcctccatccctttattttgagcctatgtgtgtctttgcatgtgagttggatctcctgaatagagcacactgatgggtcttgactctttatccaatttgccagtctgtgtcttttaattggggcatttagcatgtttacatttaaggttaatattgttatgtgtgaatttgatcctgtcattatgatgctagctggttattttgcctggtagttgatgcagtttctttataacatcaatggtctttacaatttggtatgtttttgcagtggctggtaccggctgttcctgtccatgtttagtgcttccttcaggagctcctgtaaggcacgcctggtggtgacaaaatctctcagcatttgcttgtctgtaaaggattttatttctccttcgcttatgaagcttagtttggctggatatgaaattctgggttgaaaattcttttctttaagaatgttgagtattggcccccactctcttctggcttgtagggtttctgcagagagatccactgttagtctgatgggcttccctttgtgggtaacctgacctttctctatggctgcccttaacattttttccttcatttcaaccttggtgaatctgaagattatgtgtcttgggattgctcttctcaaggagtatctttgtggtgttctctgtatttcctgaatttgaatgttggtctgtcttgctaatttggggaagttctcctggataatatcctggagagtgttttccaacttggttccattctccttgtcactttcaggtacaccaatcaaacacagatttggtcttttcacatagtcccatatttgttggaggctttgctcgttcctttttattcttttttctctaatcttgtcttctttctttatttcattaagttgatcttcaatcattgctatcctttcttttgcttgattgattcggctgttgatacttgtatatgcttcacgaagttcttgtgctgttttttcagtgccatcaggtcatgtatgttcttctttaaactggttattctagttagcaattcgtctaaccttttttcaaggttcttagcttccttgcattgggttagagcatgctcgtttagctcaagtctgttattacccaccttctgaagcctacttctgtcaattcgtcaaactcattctccatccagttttgttcccttgctggtgaggagttgtaatcccttggaggagaagaggtgttcttgtttttggtattttcagcctttttcagctggtttctccccatctttgtggatttatccatctttggtctttaatgttggtgaccttcagatggggtctttaagcagatgtgctattcctttctgtttgttagttttccttttggcagtcaggcccttctgctgccggtctgctggagtttgctagagatccactctcagccctgtttgcctgggtatcaccagcggaagcaaagattcctgcctgatctttcctcaggaagctttgtcccagaggagcacctgccagatgccagccagagctctcctgtatgaggtgtccgtcggcccctactgggaggtgtctcccagatacacaggggtcagggacccacttgaggaggcaggctgaccctcagcagagctcaaacactgtgctgggaggtccgctgctctcttcagagctgtcaggcagggacatttaagtctgctgaagctgcgcccatagccacccctttccccgggtgctctgtcccagggagatggaggttttatctataagtccctgactggggctgctacctttttgtcagagatcctctgcccagagaaaagaaatctggcggtctggccccagcagcctttctgagctgcagtgggctctgcccagttcgaacttcccagtgcctttgtttaaactgtgaatgtaaaaccacctactcaagcctcagcaatggcggacgcccctcccccgaccaagctctagtgccccaggtggagctcagactgctgccgtgctggcagcgaggatttcaagccagtggatcttagtttgctgggctctgtgggggtgggacccgccgagccagaccacttggatccctggcttcagcacccctttccaggagagtgaatggttgtctcgttggcgttccaggtgctactggggtatggaaaaaaagaactcctgcagctagttcggcgtctgcccaaatggccacccagatttgtgcttgaaacccagggccctggtggggtgggcaccggagggaatctcctggtttgtgggttgcgaagactgtggaacaagcgcagtatctatgccggagttcctcaggctcagtccctcacggcttcctttggctagaggacgaaattccgcgaccccttgcgcttcccgggtgaggtgacgccccaccctgcttcggcttgccctctgtgggctgcacccgctgtccaaccagtcccagtgagatgaaccgggcacctcagttggagatgcagaaatcacccgccttctgagtcgatctcgctgggagctacagaccggagctgttcctattcggccatcttgccagccagaagccacttttctatttttaactagaattactgaaccctgacaatgtgccagaaacagccctagtacctttaaatatgctaattttcataacaccctcattaggcaagtgccccattttacagatgaggactctaaggtgtaatgagcttaggtaattcactgaagatctttctgctggcaaatcccatgctctcaacatgtgcctcaccgccctcccagagagctacttcaagagctgatgctcaggcctccagtatttgctgtctgcattaggaggtggcaagggcctggcacagaggtctgcgacaagccaagctaggccatggcttccatccacacccctctgcacctaaatgcattgatcctacaatgaagagctggcaaggtcatcctggttttgctccattttctctgtggcattgtcatttgaggtgctgctcatggtaggtggtggggttcaccttcttccatgctgagctaggctggacacattccagccgacagcaggacaaagagggtgatgtgaccacctatgaggggctcagccccatgctctgtgatcacggcctggggactttggcacctgaggtgctggatggtgtcactactgggcacagttttccctgcatcagcagcaataggggaatacgtgcacacaggaaggctcaggttccccaaactcatatagcatctggactaaaaggaaggatttgtacagggctctagaggttaactgtcagttatgtagttgctccactttagaacaatgactttggacactttagggcatagccaaagagcaaagcagttactttgtggctgttctgcctgctcctcactcttggccatcagtaagtctggcttaggatggagaaatccaagggtctcctctggctgagggaggcaggtccagaaagccacacaccagcagtaccagttcactacatcagctccttagtccacaaaaaggtccacaggatggacagggacagaggccaacagccaccccgccaccagagcagggccattcctctgacatctaagagtcacatccatatgactactgcaacctgtggctcaaagtcagctgaaaaatggttatacacattaagttagagccattttgtgaaaactaattcagttttcttcccgttgcttggtacatacacactattcagtgaaatattagcttttattcaaggcatgacataggaattccttcaaaattaatattttatgctatactttgtatcagtttatactgaaatatttatcaacatgtcctgtgactgcctgtgcaggaatttattcaaatttattccattttgctgtttgttgtatactgattttcactgataaatttcctttgactgtaggtactgtagaagaattcactcaaatttatttgatattacagtttgcttctgcattacctttattcatcaaaatatcatacaggtatgtgcttttcaaaaaaagctctgccgtgtctgatatgaaaacgtcccctatctataaatgcctgtattacctactacttatttacccacaagtttcctctgttatctgtaacagttgggggtgggaggctggggaatgctactgcttgtccagatgttatgatctccttctggatctctgtaccctgtatttgcataaacaaaatgcttctccccctcacccccaccaaaaaaaaaaaaaaccaaaaaaccttttatgttactttcaatgcttgtatgtttgaagtagtcaaatctttttcctcaaataattatttgtaaaaattagaatatcatttacaaatctctgtttcttatttgcatctaaaagcagaataaggaggtccaggagccatgagcttctcccaggtttcagcctggaccaaatcctaaactccttatcttttctcagaggcagcaggttcaccaaaacacaaatgtcaggaccaaggcgcatccacatgcttctatccactctattgcccttactcccctcttccccaaaccacaattttgacatggcagacttggaataaaatcaagaagctcctctagaatgagaaaggaataaacagcttactgggacattcatgcctcaacattgcattccctttagattttttttttcctggtgatcttttgtatcttgcaatactctagggggaagaaaaggagaactgtgggcaaaaacttatgtaatttattgcaacataattttaatttacatgctgtggtaggcaaccttcgatatggccttcaatgattcccatccctggtcctcacacctttgtgtagtcccctcctataatattataccggggttggttgtgtgaccaacagaatacaacagaagtgcaggaacatcctttctaagatcagcgtagaaaagattgtggctgtgtcttggttgctctctagtgcgtgttctctctctctctcatcaacatggctctgtgggaagccatgctgtgggcagctccatgaggcggcccatatggcaagaactgaagtctcctgccaacactcacgtgagtttgaaagtagaccctgcagccccagacaaagctccaggtgactagagcctcaactcacagcttgactgcaactccatgagagaactacccagctaagccactcccagactaatgactctcaaactatgggagataaaagtttgttttaagctgctaaattctggggtaacttgttatatagcaatagataactcatacacatagattttcaaattctttcttgagctttcttcagtgatccaagtttctactataaacatgaattacttttgcaaatacaaatcaaagacggcatatgtgtgtatgacctcttgggaagaagatgggatgggctaaggtggtgacttccctcttcctttttttttttgagatggagtctcactgttgtagcccaggctggagtgcagtggcgcgatctcggctcactgcaacctccgcctcccaggttcaagctattctcctgtctcagtctcctgagtggctgggattacaggcacgtgccaccatgcccagctaatttttgtacttttagtagagatggggtttcgccatgttggccaggctggtcttgaactcctgacctcaggtgatctgcctgcttcagcctcccaaagtcctgggattacagacgtgagccaccgtgcccagccccctctttcttatatctcttaattcccggactgaaaactacccagcacaggcttcgtggggatgctacagagcaaatgtgagcagggataatggggagttgaacaaaatgccttctatcctgggattatttgatgagtactactgacattcaaacactgccaatctgtgtcttcttataacctctcaaataggctgatcaatcgcttcttttgttgactgaggactacagaaggatacacatttaaattcaagagatatttagggttaactttaggaagaacttctagccaagaaaactgtggttaaacaactgcacaggatgaacaattagcacggcataaagaacacgggccttagcttcagcaagaccaggcttgtgtcctggttccatttccttctagcagtgtgattttggataaatcattttctctctttgaagctcaacttccttacccataaaatagtgacaaaaccatctaccttgttggtgctcagctggcctcattccctccttctctagacaggggtggataaaaccacatcgctagaccctttctagtcctaagattacctggtacaggctttactctgactgcaggagagatgtggatttgataacactaaggtggtccttatccaccaaccttcctgctctcttggcaaactctgagaggctcatttcctgaatgtttctctcagaagattacatatacactacaatgcatccttttcttccataagaaaatgtgggataggctgggcatggtggctcacgcctgtaattccagcactttgggaggctgaggcaggcagatcacttgaggccaggagatcgagactagcctgggcaacatggaaaaaccccatctgtactaaaaatacaaagaaattagctgggcatggtggcatgcctataatcccagctactcaggaggctgaggcatgagaattgcttgaacccaggagggggagggtgcagtgagccgagatcatgccactacactccagcctgggtgacagagcaagactctgtctcaaaaaaaaaaaaaaaaaaaaagagagagagagagagagaaggaaaatgggggttaaatcaggaaactaaactttatgccacactttcttgggtgcctgtgaagcaaatcacctcacccatctgggtcttggttatcctgttgggatatgcaggggatacgttaaggtcatctctacctctaaaagcctagactctaattttagagagatatggagagtatttcagaagtctttatgtgttatggtgggttttattaagggattatctctatatagtgtctctgtgctcttaatttacccccacacaaaatgctctcatttccttcgcaaaacatattgtctaaagcccaatgcaggctgaatgctggcagctagtaggccactctgaagcaaatctcttgtcctctctgtacataacttccctcatctgtgtaaagggataataatatcttacctgacggggttctgtgaagatgaaatgagtcaatgtatacaaagaacttagaacacacagccccacctaagtgtgagctaccagtggtcctagtgccaacacatctgctcacatccgttccacccatggagctgtgtgcttattccaggtgagctatgtttcctttcaaatctttttgtgccaagtgtacttgctttgcatgcatactgtgcaagcattatataaaatcaattaaatatggaagtcaagaaatagttgtttctgtaaaaactaagctaaatgccttgtaaagactccatgaaggcaggctgggcatagtggctcatgcctgtcatcccagcactttgggaggcagaggtggcaggatcgcttaaggccaggagttcaagaccagccgaggtaaaacagcaagacacccattctctacaaaaagacttaaaaattcgccaggcacagtggtacatgcctatagtcctagctactcagaagactgaggcaggaggatcgtttgagcccaggagctcaaggttacaattagctatgatcgtgccactgcactttagcctgggtgacagtgagacctcatctctttaaaaaaaaaaaaaaaaaaaaaagactccatgaaggcaaaccatgacaaaagtttgctgttgaatgaggtgtgacggagacaactgcataacactggaaaaattctggaaaaacctcccgacttagattactttgcaagtattgctgagttctaggtccaccttaaaaaaatgtaaatggaagttgtggctgacaaattatggctgaagtttacacaaggaagatacttcagtcagaggacacttagacaagaaaaagaccttgggcctatctcaaaacattcctagtactcaaaatattacagcaagtgacataccactgggggaaaaatatcagagtctccatgcacacagcacgagcagggaaaaaaccaaaatgctagacaatatactacttcaaaatcgtattttcatttaaaataaaatgtgtaaagtatgtgtcattttacacacaccctcatcattttcattgactctttgagctaactggccaattatcagtcttgatttagtttggcaacagcgtttcaactctgcatgagcctgtgttctcgcatcgtggatgtgcctatggggtcgggggttagaaagcttccattagataatgtgtaaatcatatctgcactttgactagcatttcttaatatacatatatatacacccatccataaatacatacataacaattctgctactttagaattttttttttttttgagatgaagtctccctctgtcgcccagactagagtgcagtggcgtgatctcggctcaccacaacctccgcctccctggttgaagcgattctcctgcctcagcctcccaagtagctgggattacaggctcccgacaccacgccaggctaatttttttttgtatttttagcagagacagggtttcaccatgttggccaggttggtcttgaactcctgacctcaagtgatctacctgccttggcctcccaaagtgctgggattacaggtgtgagccactgcacccagcctactttagaatttttaaatgtctttagggaattttctaattttcccccaaataatgcataccttgagactacctgaatccatacctttttctatatgtgaacttcacgacatttgatttatccatcctatacagttatagaatattagatcacaatattgggcttaaaaaatgtcagctaggtgcagtggcacacacctgtaatcccaaatactttgggaggccgaggcaggaggattgtctggggccaggagttcgagaccaaagtgggcaacatagtgagatcttgtctctacaagaaatttttaaaaattagccaagtgtggtagtgcacgcctgtagtcctagctactcgggaggctgaggcagaaggattccttaagcccaggagttcagggctgcagtgagctatgatcacaccactgcactccagcctgagtgacagagcaagaccctgtctctgaatgaatgaatgaatgaatgaacaaacaagtgcttaccttgttcctaatttaattagcaagctaaacatatcttgcacatggcagacgtaagctctggaatgtgccctcaatttcactggctccagacccacaattctctttaactccctggcagacacacttcaccatctggagtccctactgcaaccaaactgtccactgtcaaccatttcatctgtgtgtctgtgtgtgtgtgtgtataggggaagccatggcctgtccaacaactcacagtcccaacctcatgtagtctggtaaatcagggaccctcattcacagccagagaatgaaagaaaagctgcagaatgcagttctgacccctgggctggctagagcacaaaatgaaaaggatagactgctgaggaggtggggtgtcacatgtctgtattttgctgttcataacgacggcaacaagtactaaaggtgtgcgaaagcagagggaggcataaaatgagatagaaggaaatgatgacttttaagtggcaatacaaagacggggtggctaaaaagaacatcttagcagtgatcaggaaggaagggatgacacatctttgaacatagctataatttaaattaagagtggaaatgaggtatatcttggaataagaagtatctaggtgttaacactactctcagttgaattattcaaagaaaacatctatgtaggaagtcttatgttcaggggagggatggtggaagtgtgtgatgggcatctgctgagatgcccccatggagcagccctcctccattctgaccttgtggcttgaacagggctgagcctacaaggcaagtacatgacccaggacatctaatgaccagtgcctctcatggctccgtgaccgacagtggcaaggagtcaggaggggtgagctgagcctagcccaccaaagtccatgtccatcagatgcaagactaagctgaaattaccagagaagagggtttttcttcctgctagtgaaacagaaacctagagcagctggtggctgtttctgccactgcttgggggcaagcttgcctgaaaaagaagccaacagagaaaggcagagcaagaaatgaagagaaaaactgctgataccttcagagcaactggaaatggccaatgccaaaagcaatatccctagatgtttctgttacgtcaatcagtaaattcctatttttgcctgagccagtttgattggggtttctgtcacttagagctgaaaatgtcctaattcaaaatgtaactatctagctgcaatatatatattttttcatttaaccacactgcttactgttcatgcttttgaacatagggattatttctacacataagacttttttttttttgagacagggtcttgctctgtcacccaggctggagtccagtggtgtgatatcggctcattacaacctctgcttcctgggctcaggtgatcctcccacctcagcctctcaagtagctgtgactactggcgtgtgccaccacacctggctaatttctttgtattttttgtagaggcagggtttcaccatgttgcctaggctggtctagaactcctggcctcaagcgatatgcccacctcaacctcccaaagtgctgggattacaggcgtgagccagcacacccaacccacatattcttaataggctcaacataagttatttcaaagggcagaaggaaaatgtaatccaactggagatacacataaatattaagatacagtattaataatgttaatagcaaacatttgttaaatttaccacagacacatagtaacattgaacaaatgtttgctattaatattaattctgtattgtgtcttaatagatgtgcattaggatatattaataatgtattaataatatacatctcaatcttcacaatgtttcgctataagtattcaaattatatctattttaaagaagggcaaactgattcagagaggttaagaaacttgcccaacaccagagcaggtggtaggtcagagacccaggaccaagcaagcatattctaactagaacattcgctcttaaatcactatgctctactccctccagaatatcagaagtgttactgaaaatacataaagttggttctgctgtaccacataaagaggttcagccactacacggtgccctgagccatccctcaacacagtgatagaaaggacggatccctgagtatccctgagaggtgttttccaactgcagggtgcaaaccattggtgagccatgaaaatgatttaatgagtgaagaccagcagtattccccgacagaatagaaaatatcagactatggtatataagggcaaatattgccttgtgaaacctttttgcttatacatatatacatacatatttatatcccagttcatgacatgaaatatactttcctataaatcataaagttttaaggccacaaatgtagagcagaaagttgtgtgaaggctggctgtaaaatcccctaaacctggactcacagggttgaggtggggagagagagagagagaagtgaaaactaaatggcctcaggaattgaggaaaattagaactgacccatactgcaatgtattttcctgaggaaatcctctaagcaaatctatctgattccctaagagggcttttttccttaactaaatattagagactaaggatcctttcacaaaacccccaatatctgatgtttatgtggtaattcaaaactgaaaagggtgaagcagcgatatgaaagcaatctgctgggtgagcgctaatgaggtccatgcagcagacagcaccagagcccaagctcggagcagctccccaggcacacggctgatgtggaaactcacaggacagcttgagtttgctggggaaaagtcaaattggcaagcataacagtagccttgcctgggctaaaagaaacacctcgctggctccccctcgctcttctcttgtgtggcagcgtcaggcggccccaggagatgctgaggggcttaacatcccacgcggtgctcccactgaggctcctcggctcctctccccgcccaggaagaggacacttcttaagcttttattaaactgttgtcataaattgcttatgagagcaaagtaacaaactatcactttccctttccttccaagtggcgagaactgggcctgtgcctgctccaaagcactgagccaaaatcagccggcagaaaattgccagccatcattaactgtcggactggcagagcagaggaagtccattttattagaggctcatccataatatattttgtttgaaccctgtacagactgaattcattaacatagattaacaattcatcctcgagctcagattcctttgtgcttctcctaagtggcatcactcttttagctcctcccactcacaataaattatttaatcgcaaagttcagaactattttctgtcagtgttaaatatttcctatcagtggctctgaaccttctgtggattaaggatctcctttgagcatctaatgaaagctacacatccttactcaggaaaaatgcacaaagaagccaggtgtggtggctcacgcctgtaatcccagcactttgggaagccgaggtagacggatcacttgagtccaggggtttgagaccagcctggccaacacggtgaaaccccgtctctactaaaatataaaaattcgctggcgtggtggtgggtgcctgtaatcccagctactcaggaggctgaggcaggagaatcccttgaaccctggaggtagaggctgcagtgagctgacagccgagatcatgccactacactccagcctgggcgacagagcgagactctgtctcaaaaaaaaaaaaaaaagaaaaagaaaaagaaaaaaacacaaaagcgtgcacacatacacaattttgctaggattttaggggtgcagagatgcccagaaactctcccacggtctcttagaaagcatatgaacccccagttaagttcctcagttctagtatgtatcacctttcctagtgccgaacacattcatggcaaaaaattagttcacttagagagttaagtgtttctctcaaacacctactgaaaaacaaaaccagcaaacaaacaaaacaatgatattaacatttcctacttatctttattgtacttcagaaatgaaaaatcagttaagtgtttagggtcctgttatttgcttagtgctaagaggaatataaaaaaagtaaaagacagtccctcatcataacaaaattaacgtgatgaagcaatgatggagaaaagagatccgtacacagttatatgctaaattacatggtaccagctaatggcacagtggcaattttttttttaatttttaaaatttaaaaatacatgtagggagttcaagtgcagatttcttacatgcatatattgcctagtggtaaagtctgggcttttaatgtacccatcacctaaatagtaaactttctacccaatcataatttttcaaccctcacctccctcccatcctcccactatttttagtcttcaatgtccattattttattctgtctgtccatgtgtacccatcatttggcccccgtttacaagtgagaatgtgtggcatttgcctttctgtttctgagttattttactgatgataaaggcctccagttccatccatgttgctccaaaagacaagatttcattcctttttatcgctgcatagtattccaaggtgtgtgtgtgtgtgtgtgtgtgtgtgtgtgtgtaacccacattttctgtatccaatgatcctccactgatggacacttaggttgatttcatatctttgctattgtgaacagcagtgtggtgaacatatgacttgaggtgtttttaaatataataattccttttcctttggttagataccggaaatgggattgctagatccaacggtagttctatttttagttgagaaatctccataccattttccactgaggttgtactaacgtatattcccaccaacagtgtataagcgttcccttttctccacatgctcaccaacatctgttatttttagtctgttgaataacaaccattctgactggtgtgagaaggtatctcattgtggttgttttatttttgtttgtttgtttgtttttgtttttttttgttttttttgaggcagagtctcactctgtcacccaggatggagtgcagtggtgtgatttcggctcactgcaacctctgcctctcgggtttaagcaattctcctgcctcagcctcctgagtaactgggactacaggtgccctacgcccagctagtgttttttgtatttttagtagagacagggtttcaccatattggccagactggtctcaaactcctgaccttgtgatctgcccacctcagtctcccaaagtactggggttacaggtatgagccactgcacctggcctcgttgtgattttaatttgcatttctctgatgattagtgatgttgagcatttttttcatgtttgttggccacttgtatgtcttcttttgaaaaatgtgtgttcatgttttttgctcactttttaatggggttctttggggtttttttcttgttaagttgtttgagtttcttgtagattctgcatgtcagcccttagttggatgcatactttgggaatttttttttcctcattctgtaggtttactctcctgatttttttcttttgctgtgcagaatctttttaatttaatttaattaagtgccatttctccatttttattttcattgtgcttggttttaaggacttggtcataaattctttgcctgggccaatgtccagaagagtttttcctaggtttcttctaggatttttatagtttcaggtcttacgtttaggtctttaatccatcctgagttaatttttgtatatgataagaggtatgggttcagtttcattcttctacaacatacatccaattttcccagcaccatttattgaatagggtgtcatttccccagtgtacatttttgttgaatttgttgaaaatcagttgtagatatgtggctttatttttggcttctctattctattccactgatctatgtgtctatttttataccagtaccatgttgttttggttactatagctttgtagtgtaatttcaagtcaggtaacgtgacgcctctagattttttctttttgcttaggattgctttggctattctggcttttttggttccatatgaattttaggattgggttttttaattctgtgaaaaataatgttggtaagtttgataaggattatattgaatctgtagatttctctggggagatggtcattttaacaatgttgattcttctaacccatgagcatgggatatttttccatttgtctgtgttgtctatgattactttcatcggtgttttgtagttcacctccttgtttaaatatattcccagctgggtttttttttttttttttctggtagctattataaatggggttgactttttgatttggtcctcggctagatcattactgtactagtgtacagaaaagctactgatttctatatgttaatttagtatcctgaaaccttactgaattgatttatcaaatctaagagttttttggtggagtctttaaggttttctagatataagatcatatcatcagtgaacagggataatttgacttcctcctttccaatttggatgtcttttattattctctcttgcctgattgctctggtgagaacttccagtgccatgttgaataagagtcatgaaagtgggcatgcttctcttgttccagttcttaaggggaatgttttcaactttttcctattaagtatgatgttggctgtaggtttgtcatatatggcctttattatgttgaagtatattccttctgtgtctcgtatgttgaagacttttatcatgaagagatgctgaattttactgaatgcttttttctgcatctattgagacgatcatatgtttttgtccttaattctgtctgcatgatgtatcacatttcttcatttgcacatgttgaatcatccttgcatccttaggataaatcccacctgatcacggtatagtatctttttgatgagctgctggattcaatttgctagtattttgttgagaatttttacatatattttcatcagggatattggcctctagttttcttttttgttgtatccttgtctggttttggtatcagggttataactagccttgtagaatgaggtggggagaatcctctcgttttttttttttggaatagtttcaggaggattggtattagttcttctttgtatggttttttcctttttcttttctttttttttttttttttgagatggagtcttgctctgtcacccaggctggagtgcagtggcgcgatcttggctcactgcaacctccgcctcccgggttcaagggattctcctgcctcagcctcccaagtagctaggactacaggtgggtaccatcacgcccagctaatttttttttttttttgtatttttagtagagatggggtttcacagtgttagccaggatagtctcgatctcctgacctcgtgatccacacaccacggcctcccaaagtgctgggattacaggcatgagccactgcacctggcctcctttgtatgtttgaaagaatttgcctgtgactgcatctggtcctgggctttttttgttgagagatttttattactgattcaatttcactactcatcattggtctgtgcagggcttctatttcttcaatctcaggaggttgtgtccccaggagtttatccatttcttccagcttttctagtttgtgagcatatagttgttaataataatagtctctgatgatcttatatttccatgatcagttgtaatgtctcctttttcatttctgattgtgtttattttgatcttctctcttcttttcttggttagtctagctagtggtttatcaattttgtttatcttttcaaaaaaccaacttttcatttcactcatcctttgtattgttttttggtctctagttcatgtagttttgctctgatctttgtcgcttattttcttgtaactttgagtttggtttgttcttatttttctagttccttcaagtgtgatgttaggtaacttgtgacctactgttttgatgtaggcatttagtgctataaacttccctcttagtactgcttttgcagtatctcacaggtttcactatgctgtattttcattttcattcaaggaattatgcttcattcttcatcgacctttttagtgaacacccaggaagttttcctgtgtgcttgtagtctgcctccctttttccaattacaacaccttggtctttctttgggcaataagctggtgttctagagtaagatggtaaggatgtgacccaatcctggcaatcacagcattccacctatctcacattaacaattggtttgggactagtgggtgcttaagacttgtccagtaagactcatcctgggatttctattcaagtattttcaaagagagactcatttactacagttattaaactcatgggaaagacaataggagctgctagtagctaccttgaaaccacatgaggataccctaagaatgaagccagtccaagagaaagcaaaggcaagaaatggacagagccctatgacatggtttggtcactggatatatttttaggtatatgaggctaataacctccatctcacagagtgcatgactaaccacagtaaatttaggattctgtgcttctccatcccttctccataactagtttacctcttaaagggtatctggaatttcagttgtcatgtaacatgaaagttttgaaatgatgactggcccatttactattaattttcttgacacctccatgatgctagccaacaatggtctttaattaaagtcacacattttcaaaattttatatgtatttaaattaagagctttttttgtgagctaacatcttaaaatggaagttagcaaaacattgttagataacactagtataaagttacctaatttgctgtctaaaagtgttggagtaaattaagcaaaagttgaaacaagaagatagcactttagcatcaaactaaatctccaagaggaaggaaaactaaagttcaaggctaaaactctaaattgcatcttaaaggaaatgaaaacaatacattaaatatcacacagtttttaaaaactactgtctctatgtggtggtattacagaaaattagaacaaaaataatcatatgcatttcctaaattgtctgtctagaacatgttatcttgataatggggaaaaatgagcttttaaaaataaaagacaacgtaataatacaatttaaagataatgatatgtttgtccattaaaacttcgtaagaatgggctccctccatgaaaaattactcataggcctttactgaaagaacctttaaatggtaaggtacgccttttatgtgtttttgggtatgttttcagaatgtttcttaggatcaccagatcagaaggccacaatgaccaaccaccagcttgggcaagaccatgcaaaaccaaacttcagatttcagctaattgtaccccagaaacctcccaaagaaaatgtcaaaagcagctgggcacggtggctcacgcctgtaatcctagcactttaggaggctgaggcaagtggatcacttgaggtcagaagttcgagaccagcctggcccacatgacgaaaccctgtctctactaaaaatacaaaaattagctgggcgtgatggcaggcgcctgtaatcccagctactcaggaggctgaggcaggagaatcgcttgaactggggaggcggaagttgcagtgagccgagatcatgccattgcgctccatcctgggtgacagagcgagactctatctaaaaaaaaaataaattaaaaaaaaaatgtaaaaagcagtcttgatgaggtgttaaatcctaataaggtcttgcaatcaagtttttctcaaagcataacttcaattccattttatacttgaacaataaatatacttcaacaataacattttccttttattataaaaagaaacatgttcttccaactcctcaaaatataagatatctagttatgtagctgcctcttaactttttagcggtgtttttaaaaataggaaactatttgaaaacatgaacctactgattccaaagccctgcaatgatttagtgaagctcagtgtctcatactttgtttgttcacagcgtgaaccattatggagaaagcttattaaaaagttctcatttcacattacaaatccataatctaacgcgctaatcatactcattcaattgctgcacatccataaatgccattgtacacaatcatcattaaaattcactgtggaataataacttttaaaatctcatcttgaacaaaaagctatttgaaattaccatattatctttatttctagattaaatttggttaaatgcctttgcacgctttttaatataagaatctaaatataatgaagaaacaacccctaaaatattccattaccacagaaaatataaactgttaatacatgcataaagtccaaatgaaaacaaaagcttcagcttagacctgaaggccagatccacaaatattataagaaccttctgaaaggacaccctttgctttctaaaggagagagtatgtgccaaacaagctttgaaaacaaatttgcattctatttaccaaagaattccatgtataatacatgttcaaggtgggggttggggagaggaagtgacatgagtataaaaatcccacagaaagatactctgcttggagctagaagtgttaggccttggatggtaatagaagaaatagcctgagaacaccagaagttttcctaaagcaaggccctgaaatgtgaacacaagagagctaacagcgtgggtggttactgcttccagcagccccaatggtactgaacatgtccaacttcgtgatctgggtgctggttacagagtttcttcagtttgtgaaaatccatcagtatgtgcaccatacgatacttcataatccctaaggatctctgtgctctcctttctaccaactctccaatttcacatcataccactctctccagtcacacaggcctactttctattccttgactatatcaagcaatttttgacgtcaatcatcctgctaattgcatctctttcttctctcctttataaagacagggtactcctaccctaagggtttgtttgagatgataactcagtaaagtcttttctggccacctttgcgaatttattcccccctcatattactaaccacacttcctgaaattattccttctaattatatctgtagttgtttttcagctgtctcccctagtaggctgtatgcatcatgagaatggagaccatgtccatcttatccacttgtgtttccccagcacagtgccttgaatacagaaggtattaaaaaaaattggctgtatgaatgatatttcccaaccccttaagttttcaggtattatgctaaaagggtaaatatagaaataagtaaacaagtagttaaaaattaaaaattagcttgaatacaaattttcagactgctttcatgtgccttgctttacccacaaccagcggtagcagcttcatggcactaatgacaaaacaataaaccaacagctcctcagtaatctgacctaccctgttaaacaaaaaggatccaccacactgttaggatatccttagcaaaagcaaagctactaattcattcttttctcctccctgcaaaaagactgaaaaatcactccacacacgcgcgcgcacacacacgtgcgtgcgcacacacacacgtgcacagcacacacccccacacacacagcacccccacacacacacacacacacacacaggtaggaatggctcttcagcactgaactggcatcttcacctactacccaaaccactgggacttcacaatccttacacactgtcttggccccagatgcagagacattttatgccaaatctgtgggtggaaaagtcaattccatccttcctgtagaaggatacacagatgattgttatacaactttaggatgacccatgctttcctgtctcaggaagctcccagagactccctaactgcatctcattcacccacgtggtgggtttcaaacttgctctgatgataaagcactgggaagcagagctgcctattgaggaaaaatatgaaacactgagatactttgcttctttttatgaacgaggaataatttttctggcagaaatggcagtatatgaatgccatctaaaaccatagcttatacgtacctggcaggggagattatttcaaccctaagaaagaataaaaaaacaccataccctaaacttgcgtgttctcaataaaataatagagttattaaactaactggttgtgtccaaatttttctgttaacattcttttactacttattcattcattttcactaatactcaccaaaagagatgtggtagcaaatgccaaacacttatgaaatgttgacaggagaaaaacatgaaactgaaaaagtttctattagcccattttattttccttctgtggattgagataggccattattcatttttagcagtggggactactgggctgggtcttttgaagtccaattattatcattctttgccaaagataaggaaaatagacttctatattttgaagaagtttctaattctcaccaagtttatactcatcaaaaagtgaaatgattatttcaaaataaatttgttaaaaattataccaatattttgaaagagccaagaagccaaatgacccttattaccacattgtattataatgtgcataaatgttaaacatgaagtagtttaaacattgactaaacagaaaatctggaatcatatactcttattgagagcaacaaagtcaaagccaattatgagacaccaaaggatgtctttgatagtaacactttaaaaataaagataataaaatagtacattttatcatactagcgtttttatttttctaaacagaatacacactgtatagtaacatataaaatacaaataggtctgtggtctccaaaaatgacactaaatcaactgaagcagaagaaaatgcacaaatggtattaaatcatgacacagaaaaagagagggtagcatctggcacttctggcgtgctactaagaacacactcggggaggaatacaaattctacagtctctgaactaggcagggtggctgcaatttgggaagctgtttttttcccttaggtagaataaaatgttcatcagaccacatttgtaagtattcactcaataatgaatacaacagtaaccattttaacatccaagtagtttttaaaatcacacacttagaaatacaactgagaattccaaataatttatgtaaatattctgcccacaactgggaagggcaaaattccccattccttatgcaagggctgtacgtagtggcctccttccaaaggaggtgggccgagtcactttacagtggagaaatctggcagcggattgcatcggccacgtgatcaagattatgttgacatgatcacatcagtgataagtcatgttgacaggatgtacccctgatacaacaaaaatggcacttaacctctgtgggtcttcccctagtctaatcatgagaaaaacaacagacaaatctgaggaacattccacaaaatacctaaacactattcctcaaaactgtcaagatcatcaaaaacaaaaaggtctacgaaactgtcacagccaagaggtgcctaagaaaccatgaacaacgtaatgtagtgcccagggtgagatcctggaacagaaaaggacattaggtaaaacctaaggaagtctgaataaggtacaaactttagttaataataatatatcaatattggctcattagttgtaacaaatgcagtatattaacatgtaaggtgttagaaatacttgttccccggtgacgcaaagaaacagcactcgaacataaatttaatcatcttagcaaggccatttttattaaatgtatgttcgaatgctcatacatttatttctctgcagcaccagggaacaagcatttctaacataaggtgttagtaacaggggaaaatgggtgcacagtaaatggaaactgtactatctttgcaactttcctgtaaatataaaactcttccaagtctcacactgtccccctggatctcaatctgctggctaagtaaatccatactgaatttagaacagagattattaggcaaaaagtttttaaagttgcagcgaagggagggtaaacggcttgtgcaccgctgctagctaatatccacagcttccccagggactttaatgtggtggcacttgaagagattggtttgccaatcgatgggctgcttttgaggctcttgattaacatatgtagagttccaaagtgccttgaaagctttctattatctcagcactccaaatgcagtttctaaatgctgatattcagtttcagctttttccagtttcttcttcagccttccacattcatgatcacctgttcacccttagcgagcctcagagcagagtggagttgcttgaaacccatgtgggcaagctgacctactgtggataggccagagtctaactgagggacagcaagattttcagatggtctttagacaacaaattgaaaatggtaattccttttctttagcagcagggcataacctgtgaatgtcttcttgtttaatctcccagcactctatgatgtaggtcctgtaaatgccctcacttaaataacaaagacacagaataagccagaagaaataactcccttcagagtggcagagcagaatcctaacccatgcctctttgcctaaaacctgtactgtctctggcttgcatgttcccttccatgaatataatgcagtaaaacaccgtgggaaacaagcctttcaagaattcaaacagtattactagacagtaacgacactaagacaatttccctcccatgttttctacagcaaaaaggaatcactattctggtaaaaatttccatcaggctgggatcttcctttccagtatttcaaatttggaaatcataaaaaataactttaaacacaatacaaatggctaaacatgaccggatattcaacatgaatattactgtcataacagggtaatggggtgatataatgacggggaaaagttagtatctttatttatctctgtctttttgcagaaaggaaggaaaatttataaatctgagtaagaagagtataataaagaaatggttaagtaggagttcacaagagggtttaagcctttctatgtgctaaaatatgacatacacactctattttcttgaacactattttaaggcaacttttttattatcattagttactgattttccttgaattactttaataaccactattggaaatactccataacataagtaggctcgaaaagcttttctgcatttgcaaaaactgtaaccatagacaagccatagcccctgtatcttcagacagaatctgaacatttttagcccctgtatcttcagacagagtctcaacatccaggtgctcctctaaattaaagcttaattttcacaattggtagaaagcagaaatttgagtcaaccagctgttaacagcccacagaaaaccagcaagcagacttagttattttttccttaagtgtagaataaattgactgactgtattgagctgtttttgtgtttccccctccagagatgtcacttccctgaagaatttccaccaacatataaccaatcctttcaaaaaacaggcgttctcttaaaattaattcttatcattttctaatccacaacatcttaaagtggaaaatgtaatttttctaagcagaagtatattttgtttgtctccaagtagattctaaattccaatcagatttagtccaaatgccacttaatgactttgtgttccaacccagataacaagacaagctgctaacttaccatttggtgacaaatacctctttcttcaagtttcccccactggtgttattattagcaatgaagagagtggctcataagcagactttttcaaaagctaaagcagagcagggtaaattttcatccctcatgttttccccataatctgtaaaatatttcacttagattatcatgattttctaaaactttaatatatttactacagggagattttctaaatatgctgttaattagtttgttcattccacaaacatatttaattgcttctaaatgctaagcacagagaaataaaattgaatgagattgaagagactaatatcttcaattgagggaggcagggggcgtgttttccttgtttaggacgtgcctccaaggcctgtctagcatgaggctccgctcagcaaatattcactgaaatgtgaacaacaaagctctgccttcaggatgtggataatccttgaagacaagtgccaggcactcttctagattctgtagatagaacaatgagcaaaacaaatgctgtgccatcatgacacttacattcctgtgcaggggagcacaataaactaaactatatatataatataatgtgtgacaggggctctaaagtaaaaaaggcagtgtaggaagatggggagcttttccagactgagtggtcttacacttggaagaagtttcagatgagctgagatttaaatgaagtgagtggcaaatgttgcaaatattctagataaaagtgttctaagcagaaggaactaattaatatgcaggcaactaacgataacacagtttgcagctagtataatgaggtatgtggccgagtttggtagctgtctaccaaaactccattttgtctttctggtcacccagctagaccacatgtctcagctgcccttgcagtttgagtggctttgtgacttgtctttaccaatggactgtgagagaagtggtaggtgtcacttctgaggcaaggctttaagaaacaaatatatccactccatgctctcttctttaccctttcacataaaacggaacacaatggggctagcagagccataacgtggaaagggcctgggcctatacatcactgcaaaaaggacagtcatccaggctcacgcctataatcccagcactttgggaggccaaggtgggcggatcacctgaggtcgggagttcaagaccagcctgacccaacatggagaaaccttgtctctactaaaaatacaatattagcagatctttttccattgtcatatccctaggacctggcacaaatcctggaaaatggtagatattcagtatttattgaataaatgctactgaaagcatgaaaaaagcaagtaggtcaataagtaattgaggcaagggttcagcaggggtttatgacagcgacactttaaagaatggggcaagtggcttataagggcctggtaggatggttggggtggatattcttggcagtggaaagcgtataagcaaagaaaggaagaaaatacatgacacatttgagggacacggatcccaaagtgtttccatgcttgtgtgcttttcattcaataaacatttagaagcatctgttatgcgctgagcactactataggtgctggaaacacaaagcctggtaaggccaggccctggtgaagaggaagcttgaagcacacaacacaaggaagacataaaaagaagagtggtaatgctagtggggtcactacaccgtcgctgcgtcctgaaattccagcagacactgtccaggaagattagctgtgggcaggcacattccagcaaaggtacgaaacagcatggcagctcacagaactgcgaatagtccagccccctcaaaagtaggctccatgatggcaatgactttgttttattcactgctgagtctccagtgcctagaacaggccctgcactttgcagattttgaatgcctagacatttgaggggaggggatgaggttataaataaggctataaaggaggcataaactatggcataacagaaggaattcaaagagctctgatgggaaacagtaaggccagatttgtgttttacaagagcattctagttgaaacatgcttgaaggggtgtgatacctggacaggaaaagcaggtagtagatgactgcaatggcccaggcctcaggagagaggagatgaaaactgaaataagacaacaggaggaaagcaggggtagaaagaaaatcacaggccgggtgcggtggctcacacctgtaatcccagcactttgggaggccaaggcaggcggatcacaaggtcaggagatcaagaccatcctgtacaacatggtgaaaccccatctctactaaaaatacaaaaattagttgggcgtggtggggcatgcctgtagtcccagctactcaggaggctgaggcaggagaactgcctgaacctgggaggtggaggttgcagagagccgagatcgcgccactgcactccagcctggcaacacagcgagactctgtctcaaaaaacaaaacaaaacaaaacaaaacaaaacaaaacaaaaaaacaggatttaagaactatacggggaggactgagaaggcttgtgatacatacatgtgtatgtgtatagtgtgtgtatataagtatataaaaagagagactaagacgactcctaaatttaagaaaaaccaggcttggggaaaacagtaattcaattttgcatatgttacacttgggatgctttagagtattctaggaagaatgtgtccaaaaggtagcttacataggcatgatgttcccagaaaaggtttggtctagggtcaaaaacagaacagcattcaggtgaaagctaatgtcatgggagggaatgaaactgcccaaacatagccaccacttactgctgtgcaagctgtgcactgcacaactcctggggctccagttaccgtgggtcactgcagctttgtacagctattacgaccattttttggtagatgaatataatgtatcttgaaagagaggtacctgtttgtaattcatcaaagtcatcacataacaatatgtttgttaaaggaactgccagagcaagcagagatgagaggagggaaagagaagaaaccgggagaaggcaggtgagggtgaagaggggcaaatctacttcatttttgcctaggcttcattttaaagctgatctataaaaaatcttacatcctctacatttaagatctcaacgattttattaagccctaagctttcagggtcttaacagattgtgttaatacaggaaatatcaggaacttcctgaaagcagtcctcgccctgctttctcatggacatctcagtgtttgtcctttggctcatacatttgaggcctccattttcttcataaaataacgatgacaatgatgaaaacacccctacacatacacatgcacacagacacagttaacagttctcctctagctttccacacacttttcaagaattatgagaatggaataaaaatcacttcagggcattttcaaatggcttttccaaaactagaaataagcataagtaactgaacagctgtaatggcaaagaatgctagtgagtttctatagcaagacgtgctgtgtcaaaccagtggttccaaaatggaggcaattctgggcctccctgagaggacattcgataacatctggagacatcttggttgtcaccctattggggaagggtgcactggcatctagtgggtagaggttggggaagtctctagatgttctataatatacaagacagtccccaccacaaagaattacctggcccactacgtcaacagtgctgaggctgagaaaatctgtgctaaatcataagctccttgaggcctagaaccagtaagtactttttggcaaaaagcagacacacacacaaaaaacgtgtgatgagacaaaattaaatgggagacagttatcacactatattgaagaaatgggcaacaatttcacttttccccagcccctcctgttatcactgccttccttctagactcccaatccaaattacatgaaagccaataacaggcattagaaacctaaatgatacatacagtttacatgcttttctatacaccaaatcctagcatttctatcaaattcttaccccaaatgagtaagatctttgaaaagtataaacatcttttcctgtgtaaaatccattattttctaagaatcacatgaataacaacatagcctcctacgaatataaataaaaacacttcttgattattgttctcctacatactaataaatgcaattctggcagttaatttagattaatgaaagaagcaaacagaatgaagtaaaatcagaagctaaatataggtgatctaagttaatctcactgagtccttttatcccattattaattaatgcttcccacacctaacctaagtagccattcatttgttgccccaaattgaaatgagggtaaataactttcacacattttttaaggaggcatccgatttaactgctgaggcttgggtcttgacattaaaattgactgtgtttctaaatttttttttttttttcttttttgagatggagtcttgctgtcacccaggctggagtgcagtggcatgatctcggctcactgcaggcttcgccccctggggttcacgtgtgtttctaatttttaaggccctactttaatttctactgtcactaaataaaaaagaacaaaagctttttcttttaaaaaccctagacatcatgttcctgcttctgctggaaaaagagacaggatatcaccatctcaaaccagcacctttcagcaactgaagcctttttgtcctcaccctgagtgttaagacaatggctccctcacacgtcacaggccctggaagtgctacaacagctgaatgggttttcatgggacataaatcactttcccactacctgccacctacaaacctacttctcatgaaccttggatcctgcacaatatggctcgtcatatcctttgtgactgctatgaacaaggggactatttgcatgagtagatagagggcatttttccttttgacggttggtgtttttcccccttgttccttgaattttttttcattaaaatcacagaaacattcaatgtccacatgtcagttaaattttcaacttatacttgcatgtttcatataactgttgagcactttaataagattcttgaaagcatatttatctgtccatttcctaatatatctccatattcttataattttgcatgagagcttttgagcaaattttcatcccattttgggggccttaaagaactgaggagaaaatatacacagtagaccacgcatttactgattgacaatgttttcccatatacaaatttcctaaattcacttattcctcttgaaactgaattgctgaaaagaataatgattaaagatattcttgtggatgtgacaccacctacatacatctcatcccattgctctgtattaaatttggactgcttaaagtaggagttatatatacttgttatggggaccaaaaagctgcctggaattttgtagcctttatcacaagcagctgagaggctgtctgagagtcacataagtagatcacagctgccaatggtcagtccaggtgcctgtgttccctcctttttcagtggcctagagtacatgcttcacctgcatgccccattcagacaagaacagatgctgctgcaacaaagtggtccaaccacaacaaacaacacttctctgtgagccatgttatgccaaagcctctgcaggcacagatcatgaagcaatttaatacaagcttagataaaaagccaagtgaacaatctagaagccaaaagaaaacacaagggaaagttccttagttttagcgaggagaagaaacaggcagagtacatctccaggggaaatgagaggaaaggggaggggaggcaacagctgtccgccaggtctatttcagggaaccggtgaaaacgttatttcccttactctggcaactgagattatgagtccttataatccgtgcttataattctcaactctttctagggtcaggaggagcaagtgacattgaacagagcccaagcagaacaagaattatgtgtgctgattgtgctaaacacaaagtggagccccagcatttttctgaaagtggctggaaagcaatctctagcttggcttgtaaaaaccttatggcgggtgggggtggggaaatgagggatgcatctctcccctaaacaagtctcacaggaaaaaatatccattaatgaaaagacctttgcattagaaaaagatggcagtggggatgtatgctgacaacctcgagaataataccaaaggctagagccaaaacatgtgattccagtgtcaggccagagcccagctggagcagccatgggaaaaaaagataccatacagaggagaagcagggggccagggctgagtgaagtgggtgacaaattggtgctaaggcaccacaagcggcaggcttgttttctcccgcctgatgttgtaagaggcttttacactggaagcctggatgctgtggaggagggcgggtggcatatatgcagctgagctttactctgagacagcaggatgctgtcaccaccagcatagcagggaaaacatgacgcaagacccatctgggacaggtgggtgcacagcccttggcaggggcaccgcacgcaggacaggagattcaaaccccaacacaacacattccctggggccaacgaacaagcctcggcctcaagaggaggaatacaaatactggagctgattgtagcagaaacagctgtgctgcagcctacacggccaagtgcaggagacgctggcatgatgtcttcaagagggtgcaggctcccgagtagtgcagctacaaagctgccccccagggtttaactggccaattcttgcaaaggggcactcaataaataatttgaaatttgaataagtctctccatcctgcctactcccagcacaaaatccatcaacagactggatcttctcgtaacctgttgggcctatgaggacgcagaagtgcaaaatacattccctgccctcaaagggtttattgtcatctaggcccgatggttccttccaaattgtgggtagcctcctacagtggatagtcaaaatcaattaaatgggtcaaaataaacactgtttttaacacacacaaaaaaagaagaaaatgttcctgtggaactcttaattaaaatgtatgtgcccatcacaacattaaaatatattccttactatgggacaaattaaaaataatttcaaaaataactgattactgaagaaaccaggcacatctaaccatttacaaagaacttttacacaattggttttacagaatccagaaatcccaggatccagctatcattattatgccttttttcagtggttcggagatgtggctgccttgttcaaagcaacacagcacggttgggatgtaatcgcagatgggtctgcctccagtatgtcctcaagtaccacaggaggtcagagaagatgatggtgagcaatgagggctagacacaaaaggagagagaggaaacctgaaaggggcctggaaaggcagggaggactttggccagggcagtgggtcagagaagtagaaacgagttcagttagttgttggcggtggtggcggggcggggggcctggtcaggcgagtgttcagtccaatatagccgtgggtactggaagttcagagcagactaaagggattaaacagactcatctggtctccatcagtcctgagacttctctagcctctttgagtttcactttcttcatctgtaaaatggggatgacaacaggatctacttgaaaggactaaatgaaataatacatgcacactgcttgggctcaatatatgatagcttaaaaaaaaggagtcacatcacctacgcagaatcttgcaccaatagagaaaatgaacacttgtcactgtatttggccctcacaacaatcctatgagataggcaagatgggtttttagagctcaggaaactccagcagacagacagaatgacttatgctggggcttctgacccagtcctcttattccacagggaaacaagtagaaaataagtctggaggccaggcacggtggttcccgcctgtaatcccagcactttgggaggccaaggcaggcggatcaagaggtcaggagatcgagaccatcctggctagcaaggtgaaaccctatctctactaaaagtacaaaaaattagctgggcgtggtggcacgtgcctgtagtcccagctacttgggagactgaggcaggagaatcgtttgaacccagaaggcagaggttgcagtgacccgagatcactccactgcactccagcctgggcgacagtcccccacccccagcccaccaccaacccaccacaaaaaaaagaaaagaagtctggatcactcagggaggcagacagaggacctcagaggctaggcaaagaaatttagactcccaccaataacagttagggcttaaaagggttttgaggaaaggagatggtgagtgagggagagaagatataaaggctttgaaataaagatagcatactgctcttagagttaaactttaaaaagccaagacatgcaaaatcatcctggagaaacagctccaagccctaaagaattgaaagtattatatctaagggtaagaatgtcaatcagaagggcttggtcagatttgaaagtggaggaaagcagatagtcaaagagaacagcaatggccttgccactcccagcaatatgtagtgagaaagggcctgaggcaacctcctgagccttggagggtcaggacccactggcaaagtcagcctcactgtggagaaggatgcaggcagctgaagccaactcacttggggtattcccactggcaagcctcctgactgtgaaatggatgcctcggacttaaccttgatgccatctgacacttcacttctctttgtttttattccataccagccaagtaagcatctgattatgatttggcttcccacgaaggcctgactacaggaagaaaatgtgtactagatgttcccacaccagaatcccaggccatgaaatggaaatagaaacagttctattctcattttaaggcagtaagcagacaatctggttttatatatccacttcctgaactgggataacacgatggagagattagctctggctaggctcataaaatcagtttctaagccttggtcctcaggggaccaaggatgtccactggaacacaccgccctgcagaactccttgggaaaacccactctgaccatctgcagggacgtcctattagaagggatgtgggaggcagcctgatctggctgcggcagagtgcaggatggctgggggtgctcgtgtcagcaagctagctcacaggctacagacataaggtgaccaacagtgtaaactagagtagaggcagtaggaatggagaaaaacagaggaaaatacaagagacactaaggaagtaaaagaaatgcaaagatgactggagtttctatctctgggactcagagtggggcccccaccttggcaagacagagaagaaaatttgctgaacctggatgtgatttgagatatgttcatttgagatgacaccatcaaaactatactcagtccaatgactggttgggaccatgataggaccatattcattagattgcttggtcactctattcatttcacaaacatttactgagtgtctacaatgtaccagatattactctgcctgtcactagggacccctgccttcaaggaacttacatggtccagtggtgttggcagagaggtcaatttactatcatagtaaatatagtaggttctatgatggggatgtgcacagagtccaaagggaacatctaaaataatgaacaccaagagagagagaacaaaactttttcagccaaaggaaatcaattttctttaaacagaagaatcaatgttatcctttcatcttcttgaagttttgaattcatggaaatgttgatttttaaatcaaacatcaaaatcctatctaattttacttcctttcaccctataagtggtaaaaaacaaatagcaagaggactgaaaaatactcttagctgagagattgcagcaacacatgtagaaactcccaaaaaaataaaggtacatgccagatctgtgacagcccacagaaaggcaaacatctagtacatgggccaaaaaccaaaccatacgtaaggcactgcctacgtaaagaccacagattcattcagtttcatcatctggcacaaagtttccaaactgcaattcatattaacaattactttccattgactgaaaatttaaaagatcacaaatgacaagaaaggtaaaactagagaaatgtgccttgtctatagggcatatataaatgctgactgcaaatttcagcacttagcaaggtggagggaaaaaagaaaaatgccacgtgaaaagacacaaacgcagtgtctgagccagcttagagccaggataggttaggcagagggaggaacagaaacagagagagatggactcaagaaagtatccacatgaagccatatttgcctttgagaacctaatgtgacctaagcccttgaccaggtaaacgctctcccattttgccatctctcctctttcatactccaccccacttatgtccacatcgcacctcctacagacctgagccaaactggctctgagcaacgcgtgctggggcctcacctaccagtaccctgagaaggcctgagaacagggcctctcagggtgcctgagaggtggaggttgcagcgagccgagatcgcgccactacgctccaatatgggcgacagagcaagactctatctcaaaaaaaaaaagaaatccatgtagtaaaagttactgtaactcactcagaggtcaatggaccacttgtctattttcctcattctagcaagttctagcagccctgatcatctggctttcaaatcaaaggcttattataaaacagcaaattcaaaatggagatgggctggccactagccctactgacaaaagcaaaaccagacagccaaggaggggacacacatcacataaagggcggtgtgaagaaccgcgtggaccctgaagtccgtggccactcatggagggcaggctgcacgggggagcgcagaaggggctgctggcggggaggagggagtctggggaaaggggaagtgcacagggttactgcaggggggtggctggcaaaccccaggcagcctggagcattgcaaccaacaagaagttctcccacaaaccgttctggcttttttttttttttttcaaatttacaatgttagtataatgactaaaaacagtaactaaaagcactactaaactgataacagcatttttattataccattctgggtgaggtaagtaaaaaaaaaccacatactgtgcaaggttaggaaaatttgacatcagaaagggggcacttgtgtgtgtaaaggtgaggagctacccatacggtggaaggttagccttgaggctgacaaacctggatgcaaatcacggctgctcctctcagctgtgtgtatgtaaaatgggcatcaaactatctacatcatacgattttgtaaaggaaaggacccagggcagtgaccatttcctttggtgaattagtttgttcacacgttcaagaaacaagtaacaatatgtactaccagacattgtggatataacagtgaacctccaaaatttctgctgtcaatgatattacagtccggtggtggagagagacaagaaaaggcaattacaatataatgagagagacattttatttatttatttatttatttatttagagacacagtctcaactctgtcacccaggctggagtacagtggtgcgatcctggctcactgcaacctctgcctcccgggttcaagtgattctcatgcctcagcctcccaagtagctgcgattaccaccacacctggctaatttttgtatttttagtagagacggggtttcgccgttaacaattttttccaggctagtctcgaactcctgatctcaagtgatccgctggtcttggcctccaaaagtgctgggattacagccatgagccaccacactggggcagagggacattaagaccgtaagcataggcacaatgcactctagggtccctgaccaatctacaaacagggagaacaaagcctggacagtgacacagttgtgaagattaaagagctttaattaattcccacttacttcagcaaatatttaatgtggctgtgtaccagcactgttctaggggccagggtcacagcacagaacagactgagaccgctaccttcatgaagcttacgtttgggaaagcaggaaaagtaagatcataaacactataaagcctactacgtctcagacattctgttttcagagggcaaggaagacttcagaaagagttcattcaaagtgattaaaagaaaaacgtttatgcttaatgggggaacccctcagctatctgaaaagttagctgtccaaaataacacaatcctagcactagctgaggttttagtgtgctccccttttaccttcttgacttccttttctcttatacccattaaagtaaatatggagatgaaaagatgttgtaaatacatttccctcacgtagcacctcttcctcattcacctggaacatgtttacctagtgtgacaatgaacagtccagattgtctaactcatgagaaagggccatgtcacaatcacagtgatttgtttaaagaatcttgcccactgcataattagcctgtaggtcaccatctgtctctaagtcctcataaaactaaccatatgttgttttcatcaagggctgaacaaaagtaacatagacccttctccaaggaaaatgctacacgtttcttatggagaaagaggatattgagagaatgcttggcttcccagttattaatgcttggcttctcagttattaccatatttcctttatatttagaaaatttttattttgttctgttcatgctttgaccatggctattaacccaagcaacactaacaattgctagaagtttctgaagggggctcttctaggagacattgggtaaataggcttagggcctccaaattttatttttcctctgtggtttgacctcgtaatatgaagagaaaaacatacaagcaaatatatcttataaacagttctatctattgtccattgcatttaaaaatgcaaactcatgaaataacaactttttaaattttgtattttgtacagatagagtctatgttgcccaggctggtctcgaactcctgcgctcaagtgatcctcccatcttggcctcccaaagttttaggattacaggcttgagccaccatggcccagccgaaataccaacttttaaatcatagtaacactattctaaagtagataacaactacaagagaatctaaatcatcacttgaaactgtttgaaaactgtcatcgaatactattttgatttatgagagcaagaattctcaaactgttaagtactgatcttctcacatcacccaccaaggactaaacaatcttaataagaagcagaagtacaaaatgttctgaattttagtttggtttagttcattttttaaacaaaatatggataaaaattatcccaaaaatgtacatacagcttaaaattacatggcagggaacactgaagcatttaggtaactcaggaatgttagaatctcatggtacaagtggatcattaacactgctcttatgatgcagagaaaccagttcatcaactgccttccctgagggcattacaaaattaatctgatccttggtctacagattcacgcatcaactgtatttacaaaactggccacaatgtcatcattttaaaaaggccaagagtttcctacaaggctaatgatcccatttggcctgggaaagtatttgttgaactgaattgaatggtgcagagaagggaattttaactttccatatatcctgactcattaatcctcaagttaacccgttaccaaaaacagccaacctctcaaacctttaaaggtttatgcgcacatcatatttcacctacttactgaccttgaattgcatctcttcattttttctaaacttaccaacagttgatgggcagggttcctcgtcatagagtttcactaaaggtttattttaccccctgcactgagagcacttacctttctcacgtgtgtataatttaagcctaattcttacaggatatttaacagttatccctcagagatcttgagcattctcctagagacctctttaccttatggcactaggtcttacaatgaatgtttccagtctaacagggccttgatcttcttagcataagctgcagtgcttcatccaagggccctatcaaggtttctccccttccttccacggcaatgtcctagggtgtcacaaagaatagtaacagcagcgtgatctaagggcagagagacagacctggcttcccatcccggctcatacacttcttgcaatcctggtttcaacttttctaaatgggaatgccatctcctcacccttattcagggtagctatgactattacctaaaagcacgaagggtgcctagcgacggacctgatccccaacagacacatggtaaatggcaacattactgaagaagttagaggccgctctgcctggtgaagtctgctttttgtaatccatttaaatggtctttgtccactgtccaatgcatttaagtcctcctaaaaaagaaaagggcaccacgaagattaagagctagccaggtgaagagggtggcagctggaatgttctgggccacaggaaaagcacagactccggagtgtaggagctgagaggtgcagacaagggccagagccagagccagagccagcacgctgagtggagaaggaaacagagtcttgtgaatcccctctgcaaggaacacctcatgacacagggaaagcttacaatgtagtggcaaatttttaaaaataaagtacaaactcaacatgaacaaaatggatccatatatacaaatatctggaaaacaaaaaatatagaaaattatttaaaatatgtaagtcatcagagataatcgctactcacacacacattctctctcagatttatacataggctttctgaatttttcacaaaagtatttgagcacatagtatatctctaacaggctggcgggctcttttttttttttttttaaagcccatactgtcagtctcttttcaatgagacaatataactcctaatctttcagatctaagctcttcaatacacatactacctgagaagtttgaaagcccccagtgaaccttgttccccagctctttctgctgattcccttctctctttctgctaacgagacgtctgtggttatttactgggtaatttcaccagccagaaccactggggctaatccaagggtttcttttcctcagaaacaaaaacaacagcagcaaaatctccttatttataatattcaacacctcccacaacagtcacataatattctagaaacttttcctctttcatctacaatatcctgaatattgtattcaatgccattcccatccatctgcgccccccaccccacaaaaaaaaaaaaaaaagtggctgggcgtggtggctcacacctgtaatcccagcactttgggaggctgagacaggcagatcacaaggtcaggagatcgagaccatctggccaacatggtgaaaccccatctctactaaaaatacaaaaaatagctgggtgtggtggtgcatgcctgtaatcccagctacttgggaggctgaggcaggagaattgcttgaacctgggaggcacagattgcagtaagctgagatggcaccactgcactccagcctggtggacagagcgagactccatctaaaaaaacaataataataataaaggttattttatgtcctttctcagcctctgataacttaggttattctgttgctttctggatattcacattatttacaagaaaattaaaaaaaaaatcaaacagtattaatttcctctttccccctcaattcatgtacacaatccactttgccaacatattaaacttcaaatgtttcaattaactcaaaatcaacctgcaatgttacaaaacttaaacttacattgctaagtctacaatcaccacaaatattgcctttttcaaaaagggaaaatttttaaaaacatagttgtatatcaaccaaattagattgtctgaatatgttgatttttatctagatattttgatttaaaaaatgtcatggggccatgagcagtggctcacacctgtaatcccagacaacatactttgggaggtcgagatgggaggattgcttgaggtcagaagttcgagaccagcttgggcaaaaaactaaaaaattagccaggcgtggtggcatgtgcctatagtcccagctacttggaaaactgaggatggagggtcacttgggcccaggaagtccaggctgcagtgagctgtgatgatacctaggcaacaaagcaagaccctgtctcaaaaaaaggccaggactaagaatgatttttctttcagcatacacctatttattactttattctgtttgtttgtgttgagacagtgtcttgctctgtcgcccaggctggaatgcagtggtgcgatctcagctcactgcaacctccacctcccgtgttcaagtgattctcctgcctcagcctcctgagtagctgggactacaggtacccgccaccacatctggctaattttttgtatttttagtagaaatggggttttgccatgttgaccaggctgatcttgaactcctgacctcaggtgatctgcccacctcggcctcccaaagtgctgggattgcaggtgtgagccactgcacccggccatatttactgcattttattaagtctcccctcctggtattcatggaaatagaaaataactgttttatattctgctgaaaaatgaaaccccaatctaaaactcaatttgagaaaaaattattcatacttctctctcatatttctgttaacagagaagccagaagcagtgccatccctactttcaaccctaaggctcacacattatattaaagttttgtgaagtacctggcacttctcatgcagaagttactgacatactgatttaaaatgtttaccacccttaaaatttgccaagaaacttgccaaccagaatctttattgtttccccccctgaaactccaagtcccctcatcatttgccttctcccagcccagagacatctacctacctttccctcacagcatcgctccataattgacctccagtgaaggacctaccattacataagtgatgtcatttgccaacaactttacctgtggtacctatcagggtccgtttattttggacctgtactgtatcaatttttgctgtttatcacatttgacaaaagtgtcagcaagtagaaagcagcaatgacgaagccctgaggaaaactggaacaccccagagaaagaaaagagaagcaatgtcacatggcctttaggagcactggctccagagcctgactctttcagcccaaatccagttctgctattcactggctgtgtcaattggctgtgtgagtgactttacctctctagaaatggagatacccataatactaatccttagggtgtttgtgataatgaaaacagatcaaggaggtaaactgggtaaagtcctcagcacagtgcccggcacatggtaaacacaataagtattagctactttttagagatctgtctaccaattcaggaattaagaattccctcagagattcagcattattaattataccttaaatctgtgtgagttggcagcatcacattagatcacaagattcaacacacatcctattttttggcacttattaattctggagagctaattagaaagtgaaagttattttaggaaaggaatgcaagcagttatgcagaattaatcaattatgcaaagctgtgtggtcaggacacagcccaagtctcacagaacctccccttgagacatgaacttgcaacatgaactggaaaccccatcacctttatccctgcagagccaacacatctgtgaaggaattcattcacggtacccttaaatacttacatttaaagtgaaagtaatcgtggaatgatattcagtttgtctattcacagatgaattcctcttagctcttccccaaataataacttccctagacttttctccttctttcattaagtatttattagtatttattttatttttttgagacagagtcttgctctgtcgcccaggctggagtgcagtggcacaatctcggctcactgcaacctccgtctcctgggttcaagagattctcctgtctcagctacccctgggattacaggcacacaccaccacgcccagctaatttttgtatttgtagtaaagatggggttttgccatattggccaggctgttctcaaactcctgacctcgagtgatctgcccacctcggcctcccaaagtgctgggcttacaggcatgagccacctgtgcctagcctattagtacttattatatgccaaactctgtgcaaattgtctttggcactattctcttaggtagacagtgccacttttcctccagatccaaagcagactctcccacctccccagtcctctcagccaccttgggaattctttcctctaagttacatatgacacctccctaaagcacacctcccactacacatgccaactgaaagcttctatagggtaacaatgatctattttttacctttgtatgccccacacccttgactgcactagcctgtgtgcattaaaacatagataaatatcccccatgtagttactaataccaaggaaataggaagacgtgctggatggggggctctggtgggtggctgtcctccccacaaagctgttagagcagaacaggtgctacccgtacacctccagaaagggcatagtcaactgcaacacagcatccacaaccatcctccacccccaagagcccaggctggccgtcacgttctcagcttcacttcagcatcttccagcatcctcaaacacgctcttcttcctttatcaggaatgccatcaatcttcatcacaggaagagaaacaatactcaccctccacaaacctatgcccaagtgcagcattttacctataaaccagagcaaggtacatttctggagccctgtactattcttttaggtggacagtgaataagctgagagagagttaatatcaacccatgcaactgtacaggaaggattcatggttctgttttttaaaaagagagagagagctgagtaaatgagtgtttaaccaaaggacagggctctgctttctattaagtttgactattttttaaccatttctttgaaataacattgttattatttttcccactaaaattgtaagataacaaggcagacaagaaaattgcgttacaagaatgcacttcagcattaaggctttcacacacagctatcacttcccattaccaatcctgcttttcaagagtttctctaatcccagctgtcttatgcagcattaggacagttgggcttagctatggaaggcgaaagctcctgactcctttattcaagccagatcttcataaacaatgtgaaagagacaaaagacagcaaataatttggtcccaattactatatgaaaatttatgtgaaatttttcacacattcatattagatgctgaatagattttttaaaaccctatatacccaaaataatgtttaaattatcctctaaaagaatgaacgtatcatatatatgactataatagtaactgttttgtgatattttaacagtactcaacagctttctcttcttattagtgattctctccatgttttcatctaggagaaaaccttccatactcattagtggagagaaaatagatatgttagttgaaaccaaaatttccattatcttctttaagcaaaataaactcttgcacaccaacattataaacatgaacacatttatatgtatgtttcacacacaaagtctctgagaaactattttaggatgtggccacccaccatatcaggtcagtgcagatgggggcagatgatgtggactgcacagttgagtccatctgaccccaacaaaacagttcatagaaacatcatctgactctgactgctctatcccagcgaggcaagttgtccagctgaccttttttactcttatacacactgtggaaagatgagggtaaaattactcttggctcagacttccagggcaggcaggaagccccatctacaccagcttcaatcttccttcacagggaggtgggtgatagtggaacaagccgacctggaaaaggtttcccagagagaagtcagcaagagaagagcagacaccagaataccaagatgatggccttgaagtccaagatgaggaacaggggagaacaaacaattaaaaggaaactagggagggtgtctaatgcattcataaagagagttatttatttgattttaaagccaaaccacagaatgtttaataatttagcatgaaaacctgtttttttattcaaaaatgagaaacctgccactgagactatttataatgtcagccaattggagacccgtacaggaagaagacagtttcctctttgctgcctgggtaggggctacaaaggacaaggctgacagagtctgattcctatagtcttttccctctctaatttctgtggaaaacaaaagattctggctagatctccactttctcctctctactgcctcttctcaaaccactcctgttttggtcaaagttaataactccaatctgaaagcacaggctgaccattagaaaccccagagtcaatataaaggggaaaaaaaaattaacgggaacaatctgttggcactgagaggcccaccatgcactgatataaaaactagtactcatttgggggaatccctccttatttggctttcattttctaggatttgtgcagaataaatgaccaaaagatctttgaataacaaataataagaaataagtaaattacagaagtgaaaaagccattctgaacacacagcaaaataccaattgaggaccggtggcttggctggaaaccaagcttaaagggaaaaatctgatccacctcagaactccctcacttctattaataatatgttttaccaacccagctgtatcactactagatgcaaaaatgtataattagagtcaggaaaggtaaaaaatcaccttaaggaaactctatgcctcagcactttctaaacgcccctgtcttctaggcaactctgctcttgtctccttgttcttttatctcaatcttgacggctaatccctctgcagggtattaattactctgtcacaattacgttattccacaaacaagaaaaacataatacaatgaaatccaaaacggattaactttttattgattgtattaacaacctaatattctgtgattgcaccattagtacacattttgctgcacattaaaaagaaaagggtaatttcttccctttgtctctgatcagcttaactgatttttttaaaaaaacaccagaaatatttcaaagtaacctgcgcagccagtaatttgcttatagatgtaatttttgtctaagagaccctctgcatgaaatcaaatttcattagactgactagaagttgaagtcacttaggggtatacagtaaatgcacctgatagcagtaacttaagcgtactcttaagaatgattctgtatggcagatgcccccgaatgtgttcagagttctgagctagggatctggaagtggccaccccagagatctgttccttgtctatgaggaacatctgagctcccggcccatctcttgtgggacatgggctgtagggaaatggaggccccgagttttggcatgaatgaaggttgccaggtggaatcgttaaacagagtactaagtgaaaatgcaatataaactgcatagcttttgcaagtgattgcggttctcttgtccagcgcatagccgctgggccctctcccctgtatgtaagcccccgacgcaaccgcatgttgcgtttgctggctctgggtcacttcttcagcctcctgaacctggtgccatccccactggagctgacggcacaacagggacccagaggacagcagctcagacgctgaccaggatgctgagccttaaccactcaaactgaggttctgtctaggattaagttcacacaaaactgcaaggaaaagaaacgcccatgacatgtgcactaataaagaaaatgacatagaaaatcacgcaaagagatttgctttccgttttgacagtcaaaacaggcatttgccacacgttgacttgccacagatgtgagcacaaatctcatctccaaaaagctcactgtgatctaaacactagacttcaagtcacaaatctcgtggcaaataagtctgcagaacaattgtttgaggagttcaagctgcttgaaaaatgaagtccaagatatctttctaacagcttattttccacatcactgaagttcggagatggattcatacactaagttcttcctcaatgcctccccagcactgaccccactatattgtaaacatgtgcccccctcattaaactgcaagctccctggaggcaaggattatgttgactttgttctattaaggcacttatcactggaaagaagaaaagtgagcttggtacccacaaaagatgtcaaatagctgttatgagttgtgaattccctttgtcagacaaaaagcaaaacatattccttggtaccgtataaaagcactggagggagggaaggcagatatacttaccattagaaaatagaacgttgtatttatccatacatcactcacctcctaccctcatcccctcaacccaacttcgacttgtcaactgaaataacttaaggcaaagtgggttggaagtcaaaactgtgtatgtgattcctctattttctacctcattttatcagtttagtccgatattttcacttttattcttaagaatccagaataattttccttcattttgtctcccttttttaggcccacttatttattgatataaagcctttcatttttttaacttttaaaatgcaggtttgttacacaggtaaacttgtgtcatggaggtctgttgtacagactgtttaatcactcaggtattcagcctagtacccattcgttgtttcttaatcccctccctcctcccaccctccaccctccaccaggccccagggtgtgattgttcccctctatgtgtccatgtgttctcagcatttaacgcccagcctttcttatatcaataatctctaacaggcaaaacagaaattccattttgatgattaaaaggaggaagaaaattaacttcatggtcctgacccacgttcaacttgataagagaggagagagcactgtgtgaaggcaagagctggtaagctcagacaacagaaagaccgggactaactcctgctcatcacttcactacacggccttggccatgctgctgatcttcacagcatcaggttcctcatgggtgatttgggaatagcaactggaccaagcctcacagggtgagaaagaagaataagtgagagaacgcatgtaaagtgcccaggaggagacgtggctcctgcacctgtgattgctattattcattgcttccccactccctcttcccatctgacatccactacacagtcaatgtagggttttgtgatttttcacacaaatacagagaatctggaactttgccatgcttgtccctggctccccctccctctcccactcccaccttccagtctcaaataaccccccattccaaaggccaggggaccctactatataccctaatgcaccagagcttgttttgaggaaaataagaggtgagatttttacggagagcttccaaattattttttcaaagagatgcggtctttctttgttacccaggctggagtctagctcctgggctcaaaggatcctcctgcctctgcctcctgagtagctgggactacaggtgtgtgccaccacacctggcctgaaatactcttactaaaataaggacacttgaactaatgccatcttatgggaaagttattcaatcattcccattatatgcaagcagtgaaaatactcatttctttttattttaaaatgtccagttactgaataagcatatatgcctaagtattactgaggtcagagattgcgtacaatactcaactctgtttcccaagcatgttcacagtccatagttgaatgagcaaacaaatacactgtcagtgcttgagtcagcaggtaagaaaacatttacaaatgaggaatgaatacacaaaagtatttgcaaagatattacacaccatcttctacttatatatgtagactttccagttcaaagtcatgcccaaaatcctgtactgtatttgaaaaatcatttccttgctaaaagtctctttataaagactctgtgattgcctcaggctaacttgttcttatcccaagtttttaagaggaaaaagcctaaaagacattttatctcttcatgcaataggcctatcgccactgcaaagcatggtaaaaggaacttcagaaaagatggagtgaccaagagaattgaatgtgtcttgaatgagaaggcacaatttatcctcagagtgctcaaagttccacattcaatctaattccttctatccacaacaaataccactaagaagggatttaacatttgaggatacactgtgtcctccttccaccgcttcccaagtaagctggctggtggctggcttaaagagaatagcattcttctcacaatttcttcacccagctttacctctgacagaactcaaagcaagtgacttatctgtgtcaggactaatgttgaaagagcactagatctgcagtcaaaaaacctaatttttaaaaagttttttcaaaattcttatacatttagggggtacaagtgcatattttctggtgtgcatatattgcatagcaacaaactctaggcttgtagtgtacccattacccgaatggtgaacactgtaacaaacaagcaatacttcaacgttcagcctcccacctttggtagtctccaatgtctattattccactctctctcttttttttttgaggcagtcttgctctgtcacacagactggagtgcagtggcgcaatcttggcttactgcgacctctgcctccggggttcaaacaattctcctgcctcagcctcccaagtagctaggattacaggcatgcaccgccacacctggccattttttgtattttcagtagagataggttttcagcatgttggcaaggctggtctcaaactcctgacctcaagtgatccacctgcctcagcctcccaaagtgctgagattaaaggcgtgagccactgcgcccagcctattattccactctctatgtccatgtgtatccattgtttagcttccacttgtaagtgggaacatgtagtattttactttctgtttctgagttatttcacttaggataatagcctccagttccatccatgatgctgcaagatgtgttaagaagcctgttttctagtctagactgccccaaaccagatggatgcccttggcaatttatttcacctctctgggtgccaatctcctccactgtgaaatgagacactgtagaagatcagtaaagttccttgttctcccagaacttgcaggctacatattcaggtgggaagatgggctgaaattttgctctctagctgctaactaaatcgtatttttaaattctgcttctcagactcttgaaaagttggcctgagaacataagacaccaccaaacaatctggaagaaccagtgctattacaacaaagcaatgagagagtcaagattccttaaatgtaggtctggaattcaatgtcaattgatagctgatccttttcatgccagtgctgccaaatgtaccaggaaagttctttaaaagcagactgaagttttaagagtccacactattattttcttcttaagtctaggtaaaatcccttccaattagtttaaaagtagtattttgaaaatgttaccaaaataatacatgtttctcactttttctccttcctctcctttttctactaacgactgaagacattttgggacaatctaacctttccccattaactgacttgtctgtgtgaagaaaccagactgcagatttgctgttggccttgtgtaatttctgagccagggcatggtttccaaggtaacaagttaaaaaaaaagaaggcacaaataggtctagcacatttaatatgtaaatgaactaggtcactaagtatttcactaataggcaagatgatagattaaacccttctattctttttcctccatttaccctaggaggaatttatttggggcttttacagcagacataatgattttcctttggcaatgcagtttccaaaatacaaaactccaaagagagtttgttacagttaatcaagcgaaaagcagcttctgttgaggaatctaaatggagaaaggagagggggtcctgaagcactgaatctaattctagacacttgtttttgcagttctcttacagataacacacaatagcgtgcacatgcacccttgccaactcttcacacagtgagagttagagttcccattctcatattcccaccaagccagcggcatgcacaagaaactcacagttctgaagctggaggagtgactttggcttccaaagggaaaaggggagccaaagtggtcgtgccctgtcctgccccttggacaaaggcagggaattgaatgcaccggcagttgggaggcagggtggggcaaaagccaagggtgagggctgagggagagcagcttttccttggatggacatccttcgatggccagcatgcagcgcagccatcacacatgccaagggctgcttcccagcctgccttcaggaaaagtggagggcgccaaagaagggcattcataacaatgcagtaacaaaagcagatagatgctctgggggacatgggcagagaagaagcaacagcactgtgtgtgccagtgatccaattagaaagcccagcttccacacgcaggctgaggcttccacagcttaaaccccgtggtatccagacaccatgatttctagagttcttagttgcagacaaagccccactgtgttttcccgggtgaccatgctgccaatttgtctcataccttccaaagaagcctaattattagcttcttcctcggctgtctggctttttcttagctccatgaagactgaacatatatttcctcctctaaagaaggtaggcagggttggggaagacaagcaagtctggaacagaaactccgcccatccataccccagtgaagcaaggcacatcgccatctccataaacaccaaggtgctggccgggcgcagtggctcatgcctgtaatcccagcactttaggaggctgaggcgggcagatcacgaggtcaggagattgagaccatcctgaccaatatggtgaaaccctgtctctactaaaatacaaaaaaattagctgggcatggtggtgcgtgcctgtagtcccagcttctcaggaggctggggcaggggaatcgcttgaactgaggaggcgaaggcagcagtgagccaagatcatgccactgcactccagcctggtgacagaacaagactccgtctcaaaaacagcaacaacaacaacaacaacaaaacaaggtgcttggatctggggccccaaaacctatccaagttttcaaataacagttggtctcttcggcatttccctgaaggtgttcactacacttcttgccctgtcctttcactttgagttcctaaatgaaacccgtcgtcggccatcctcccgccctgcacagtctattctgcaaactagatattctgtgtcacacttttcagagtcctttcattttcctgttttgtaaaagtggttgtgtctcggaaagttaaaacgaattaacttcatcatggcctgcaggatgaaagagataaaatgaaaaaggattaggctttcaagacatcactgagaagccttttaaatgagccaagtgtgccgatgtcacatgaatggggtggccagtaacagagaccgcagaagatcacagaaatctgtttccaccgtatgtttcgctaagtaaagaaaggacagtgctgggtgttaacttcggttcaaaaaaaaaaaaagttaacaacatcccttttctgttcccaagtctattacttctaaaaaagatattttaacattatcactattttttaaagaatgtcttttctcatcttttgctttgaatatatttaatataatttattctctcttcccataggtccttcatattatttccactcattattgttgaaatcttccagttttctcattattcccaatgcttcaaaataaaagagaaatttagtaagattaaataatggaaaaaggaagccaaagaatatccagttacgatgttcaaagagataagctggccctgaggcatatttatctgtcctaaaagaacttcaccaaagagaaatttaagctctacaataacttgtgtgtggcctagaagacttcaaatgttgtttctctaatgtgaatgttgaaataatgtcattgagtttacatttaataacatcttacgtttgcagagtgctttgttttttaaggtgtcttcatttataacatatcattttatccttttgataaaaggatagattaacaaccctagaaagctggctagaaattaagctatgattactgcattctatacatgagaaaactgaggcccagcacaggttaagggcctggaaagggacacacagcagaaatgtgacagtgttggaaccagactccacactcctgatccctaatccagggctcctgcttcaacaccttcctctttgatgctctctacgtgtgaagaaagttcaccctagattagtacatgctggaaacaagtggaaacaagacctaggttatccttaatgccagacagttgtattctgccacactgtgaattccaggatagcaagcactggtcagcaaattggcgcaaacatatatttgcattataatatttcttatgggtcaattaatctcctggaactaagaacaatcctggtctggaagcatgactgagacccagatgtcagtgcttaacagctgcattactggcctgacttagagaagaggccggaaatactcccagagttgttcacttaaggcctgtgatgatggccctagcagacaaaggaaagggaaggagggcaattaccagagaacttaattccctataaacaccaattggagtgactgatgagggcatgaggggcacctttctttcctccttagcaggattctttacattaactggataattgcttcttttctccaactgcctagacccacaacccggaactggcacgccagctacgcgcagactaccagaattaggttcaaaacagaaacagcaacaatgtaattaagctttttacaaacatgataccatggcacaaaatttttcattaccttgtgttaatgaaaaccattttctctgaccaacgcgtaaaatgttggagcaaaataaactgaatcgtctatctggtgttgcagtgtcagtgcaggcctagcatgggaatgtctctgtggaaggtggtggggtttttctcccctttttctctttaaagaatctgctgagttatttcaatagcacttctagctctatttacatagtcacactacctctctcctgtgctgtaattacaggaaaggtgctaccaatgatcagatttactttcagtatcccatcctactgtacgaaattccagtcacatcactgcatatcacaaagacatgctgcaaaggtacacaacacagaccatgaaatgaaacggcactacccccacttcaaaaggtacctttaacaaaaaccatctgctaaagatggtcccaaactcttatcatctgattctcatattcaatttataaaatgaatagggtgctgctaggcatacaatttatgtgaaatagggacctgagccaggaagctgcccaataaaggaaggaaatgaactcaggtttaccaagtgcctatgatgtgccaggcacaacacctatgactctcacttatttcatctcatctaattttccagaaaactctgtaaagtggatattcccatcttacaggtgaggacactaaggctcaagagatgaattggccaggcgtggttgctcactcctgtaatcccagcactttgggaggccgaggtgggcagatcacgaggtcaggagatcgagaccatcctggctaacacgctgaaaccccgtctctactaaaaatacaaaaaattagccaggtgtggtggcatgtgcctgtagtcccagctactcaggaggctgaggcaggagaatcacttgaatccgggaggcagaggttgcagtgagccgaggttgcatcactgcactccagcctgggcgacagagcgagactgtctcaaaaaaaaaaaaaaaagagagagagagagatgaattaacttgtccgaggtcacagtgctgatcagtgtcatgttctgaacacaggtcaactgaactccaagactagtctattatcagctcactaagaccccacaagggtgaaatggctcctttagcctaattaccagcattaagataaccatccatccacacaggaacctgagaaggcaagcaggaacacacactttgggtacctgtaatcagtaaacctcaaagactggtgtgtacatcaagtaggaaaccaacttccctaactcttggttcccagtcatagcccaatagaaatgagcaactttgccctgccatgcttttccttttttttgtttttttgttttttttttttaataagtgaaaactgcttttatttacagacatattttttttaggtaggaagttctaaagtgtcaacaaaataacataccagagctagtaaacactttcaataagttgcagaatataccaggccaatacgcaaaattcaattatttatataagttgcaatgaacaattaaaaactaaaacatgaaaaacaataccattaataacagcacgcaaaaacctgaagtacttaggaataaatttaacaaagtacatgcaagaactgtacactaatacctgtttagataaataagacacttaataatacacttttaaattcattttttgttaagaatactaaatactatttatttgacaattatctccaaattgatctatagttattttgttcagtatggtatccatgagccacatgaggctactaaacacttgatatgtggctagtctgaatcttaattcagactaaggtgactaaggtgtgctgtaagtgtaaaaacacaccagatttcaatgacttagtacaaaaaaagaataaaatatcatatcaatgtttttatattgattacaggttgatgttttcatatattggggtaaataaaataattattaacattaatttcatggttttttttctttttaatgtgtctaccagaaatatttaaattacatgtgcttacatattttgacatgcattacgttcccattagtcatcatttatctataagtttaatgcaattccaatcaaaactgccacagggcttttgctaaatcttgacaaactataaaatttatgtgaaaatggtaagaaccaaaaatagccaaaagaatttttaaaaagaacaatgttgaaggacttatactcccttatttaaagatttattataatgctacagtaatcaagacagtgtggtatatggccaagagatcaatggaacagaatggagaatccagaaattgacctacacacatatcctcgatttttaacaagatatgatagtaattcaataaagaaaagatacacttttcaataaatagtgttataacaactagatagccacatggagaacaaatgaaccattacctttatctcatgccatacggaaacgttaatttgaaagagttcagagaactgttaaacaaagtggaagagaagccattgtttagggctgaggctgtgctctaggccccaaaagaccagacagaaccagtatggaatcgctcctgttcggtgccacataatgaaactgaacttcaaaatgagccagtattcaaaaaaccaggagattcacagcaaccaatcagaaagggcctggtttacctaactaagggatctctgttttttgttttttttttttttttttttattatactctaagttttagggtacatgtgcacattgtgcaggttagttacatatgtatacatgtgccatgctggtgcgctgcacccactaatgtgtcgtctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttttttgttcttgcgatagtttactgagaatgatggtttccaatttcatccatgtccctacaaaggatatgaactcatcattttttatggctgcacagtattccatggtgtatatgtgccacattttcttaatccagtctatcattgttggacatctgggttggttccaagactttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagcatagtttgaagtcaggtagtgtgatgcctccagctttgttcttttggcttaggattgacttggcaatgtgggctcttttttgattccatatgaacttgaaagtagttttttacaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagtaattgtgaatgggagttcacctatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagccgtgagagagggcatccccgtcttgtgccagttttcaaagggaatgcttccagtttttgcccattcagtatgatattggctgtgggtttgtcatagatagctcttatattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggttttgtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcatttaattgtgatgttagggtgtcaattttggatctttcctgctttctcttgtaggcatttagtgctataaatttccctctacacactgctttgaatgcgtcccagagattctggtatgtggtgtctttgctctcgttggtttcgaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcggtgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcgggtggtaccggttgttcctttccatgtttagtgcttccttcaggagctcttttagggcaggcctggtggtgacaaaatctctcagcatttgcttgtctataaagtattttatttctccttcacttatgaagcttagtttggccggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaggcttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacatatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttactggctgctttgtttacctaagcaagcctgggcaatggcgggcgcccctcccccagcctcgttgccgccttgcagtttgatctcagactgctgtgctagcaatcagcgagatttcgtgggcgtaggaccctctgagccaggtgtgggatatagtctcgtggtgcgccatttcttaagccagtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctcctgttttttttttgagacagtgtttcttttcacttctgtcacccaggctgcagtgcagtggcgcggtctgtgctcactgcaacctccacctcccgggctcaagcaattctcccacctcagcctcccaagtagctggcactacaggtgcgtgccactatacccagctaatttttgtttttgtagagatggggtttcaccatgttgcccaggctggtcttgaactgccaagctcaagcgatccatccacctcagcctcaatctcccaaagtactgggattacaggcatgagccaccgtgcctggcccctcctaaattttttatgtgccttagtttcaggtatttgagagagagtctcattttctacgttcaaaggcaggaataacaggaacttcagagttattgaacataaaagactcaggagaagaggaaaatgcaccagaaagtaattctgttctgttgttatttatactccttaaacaataaaaggacaaagtttgccaaagagcaacaggaaaatcctgttaaaacatacacttcaaaaaatctccaagagctttctgaaaataacacacaatccagaggctatttagaaagaagcaaaatggacaaataatataaaagtgcgaaataacccccaatttcatatagattataatctaaaaagccattttaatttttttttatttttgtttttagagacagggtctcacagtttcacccaagctggagtgcagtggcataatcatagctcactgtagcctccaactcctgggctcaagggaccctcctgcgtcagcctcctgagtaggtaagactacgtgcacatgccaccatgcccagcaaaagtcatttttaaactggtcttttcaaacttggaaagtcaaatctaaagaaacaaggtcataatcagcagtaaaatttacaagaagcaccacaaatgtctttactttttaaaagaaactttttaaaaaaattcaactttgaggtataatttacataaaataaaatatattcattttgcattaccattaagtgtgttttgacaaatgcatccaaccatgtaaccatccccacaatcaaaatatacagcattcccaccaccccaaaaagttcccttgttagtacccccatgtcaaactccagaaaaccactgatttgctttctgtacctacagactagttttgcctgttccagaacttcatatgaatgaacattgtatgtggtcttctgagttttattcctttgactgcacaatttttctggaattcatgcatgctgttgtatgtatctgtaaatttgttcccttttgttgctgagtagtattccattttatggatataccacaatttgtttaaccattcactaggtgatggattcttgggttgtttccagtttttggccactgtgaataatgttgctatgaacattcacatacaagtcttttttgtggacatgttttaacttatcttgggtaactactaaatggttttccaaaataatcacactacagatatatcttggagatatgcaggttccattctagaccacagtactaaggcaaatattgcaataaagcgagtcacacaatttttttctcagtacacataaaagttatatttatactatactgcatctagtaagtgtgcaatgccatcatgtctaaaaaatgtacataccttaatttaaaaatactttatagccaaaaatgctgaaaatcatttaagcctttagcacatcgtaatctttttgctggtggggggccttgcctcaatgttgatggctgctgactgatgacggtggtggcgctgaaggttggggtggctgtggcaatttcttaaaataagacaacaatgaagtttgcagcattgattgactcttcctttcacaaaagatttctctgtaacatgttatgctgtcagatggcattttactcacagtagaacgtcttttgaaactggagtcaatcttctcaaaccctgttttatcaactaagtttatggaatattctaaatcctttgctgtcgtttcaacaatgttcacagcatcttcaccaggagtagacttcatctcaggaaaccactttctttgttcctccataagatgcaactcctcatccattcaagttttatcatgagattgtggcaatcaggcccatcttcaggttccacttctaattctagttctcttgctatctgtatcacatctgctgtaccacatccactaaagtcttggatccctcaaagacatccatgagggttggaatcaacttctccccaacaccagttaatatttatatttgtacctcctcccatggatcatgaaggaccttaatggcatctagaatgatgacttctttcctggttttcaatttcctttgcccatatcaatcagaggaatcactatatagtctatggcagcattagaaaatgtatttcttaaataataagacttgaaagtcaaattcctccttgattcatggactacagaatggatgttttgttagcaagcatgaaagcaaattaatctccttgtactataagagctcttgggtaaccaggtacattatcacactggaacagtaatattttggaaaggatcttttttataagcaataagtctcaacagtggccttaaaatattcagtaaaccaggctataaacagatgtgctgtcatctgggctttgttgttccatttatagagtcagcatcattcttaaaggccctaggattttcggaatggcaaatgatcattggcttcaacttaaagacaccagctgcattagcccctaacaagggagtcagcctgtcatttgaagccaggcactgacttctcctctctagctatgaaagtcttggatggcatcttcttccaatagcaggctgtttcatctacatcagaaatttgttgtttagtgtagccaccttcatcaattatcttagctagatcttctggataacttgctgaagcttctacatgagcacgtgctgcttcaccttgcgcttttatgttatgaagatggctgctttccttaaacctcatgaaccaactttggctagactccggcttttcttctgtagtttttttctcctctctcaaccttcacagaattgaagacagttagagccttgctctggattaggctcttgtttaaggagtgttgtggctggtttgatcttctatttaaaactttctccatatcagcaataagactgttttgctttcttatcattcatgggttcactggaatagcactttcaatttccttcaataacttttcctttgtattcacaacttggctaatggtttggcccaagttttttggtctatctcagttctcaccatgccttcctcactaagcttaatcatttgtagcttttgatttaaagtgagagacatgtgactcttcctttcacttaaacactgagaaaccattactcatcagcctaatttcaatattgttgtgtctcagggaatacggaggcctgaggaggagagacaagaatggccagtcggtggagcagtgagaacacacacatttattaagtttgccttcttacatgggcgtggttcatgtcacaccaaaacaattacaatagtaacatcaaagatcactgatcacagatcaccataacagatatagtaacaatgaaaaagtatggaatgtcgtgagaattaccaaaatgtgacacagagacatgaagtgagcacatgcgattggaaaaatggcactgatactcttgctccatgaagggttgccacaaaccttccatttgttaggaagcaaaaacccaaaaaccaaaaacataatatatgtgaagagcaataaagtgaagcacaataaaacaaagcattcctgtgattaatggtaaaaattaaaggttgacccacaaatgtctttttaatctgcagcatgtctgatacgatcactattggtctgataaggaggaagcctgtggtataagaaggttattgagaatttcctctccttttttggcaaaaccagaaacactttactcatttcaaaatttctttttgacaaagcctcacttacctctcttccactccctcttctccacagatgcctaggtactcacagctctcatatcaaccctactctaaatccctgaggaagctacagaacctggcctaccctcatttgaagtgttctgtttccaaaactacatttttctcctttccctctcttcttcccctacaatcaacgcttttgccctgcgacagaattgctcatgcagaagattaggaaagcaagctgattaaatagacatttatgcaagggactggtaacccctttaaatgaagatgctcaaacacgggtgcaagagatggctgtctccataattctacaatgctgctcttcttccaaacaggctcctaacacatatgacatacagcaatgcaataaagtgaagtgaaataataccaggtataatagcaatgaaaaagtttggaatatggcgagaaggtggctgtatgctgtaaagtggggaaaattttactttaccactgtagtgtgggaagtttactgtatttacagtctagacctacctagccaaattctctgtccctcaatgttatgcctgcttttcacagcttctttccttcttctatacctttgaactcaaaaattctcaaaagtctcaggttcttttcattagaacccatagtaacagtggtggcaaggagatgtcatttgtagactgcatatcgccatctgtactacagtaagctctctaatcattttacctactagttcctttagactcccccctaccaggcactttgctttacagctttgtcaatcctaggaacaaatacagacatcctttgctgaggaacatctccccaccatatcactgatatcacacatgttcatgatgttgctaaaggacatttaccctgggccttttataaaagatcagatttctcaagtataaaagcaattttgctatcaaaacaaatctgttgtcaatacattttgaggctaataccatgattagttggccagctcaaactagcgcatggaagaaaaacaaaatcagtgccttggatacaccaatgccactgtggtgtttgtcttctgctatctcaattcatgggaataaagttacccagagagcttacctatcaggcaggaactggacagaacagttgtggcctatgcaaccatctcagagtgttagtggaacacacacactcaagtggatcagaactgtctcaaacaatataaatttaatgtggtggttgatcttgctgtgggttacagatgctcatctccttcacaatggaaaataaaattggtgcccacttcagctcctcagcatttcttatcttactctctggctacttactctgaaggctgaaaccagctccagtcatcagagaacagaaaagccacaaaacccctctaatcacttccgagttatgcagactctaagacagcccgatcctaatggacacttgagaaacaactactttcttgaatttctggaattactttggtcattttgaacgaccgctctattggactgccatttccttttccctgtttgatgcttactgaacctctggagtgtatgaaaacaggctgaactagcatgaaaaaaaaaagagagtatcagtcatttcaatcacgcagcactgcactgaggtcttggcactctgtgatctcgtagtactgcagcacccagtaaactcattatcatcactccgggaaatgaagccaaaactcagttcatgtaactttccccatcaccaatcacccaggcttcaaatatgttctattctttacaccaaacccctaaaaaaggggtggttattttagtcaattcccgggctttgtgaagacttctttccacagaaatgaatgctttgtaatgctaagcagattcttacactgaaaactgttctaacatctcgtcatcaaaatgacagagccactgcatccttgacacggtgctgttctggaactgaattggtgagatgaatcagcaatgaactgtcttataaaacagctaacatgacatgatatgtattaatgggaacaaggcacgcaaagactatgaagtaatgtctttaccattatctaggcagtagtgggatttatacttgaatactatatttagtctgaggtttccatttttaagatgtacgaacaaactagaataagcccagggggcttacatttagagaaatatctgttcctaagtgtggaagaaaattttacaactacaactaccttcatacccaaaaagagggagagagaaaagagaatatttactgagcacatactacagtctcagtactccttatgtgactatttaatctctaatacaaccctaaagagcaggtctcatgccatttgtcagatgtgaaaaccaaggcttggagatgttatgcagcttgctcagggacactcagctgagattcctcaacccttttctcccactcagacttcactcttacaacatccaactgctaccaggcactgtgactcagtagatcccaaactgaattcactcgctctacattttaaattatataataaattaaatacaaaataaatatttcagtatttccatgaaagaagtcagtttgtgaaggtttaaaaaacaataatggtaagttattgcttatgtgttatctcttttctcttttttgttgttgttgttgttgaaacaaagaactattttcagaaagtctggtgacctactgacatcatcaaaaaccgcaaggtttgaaagagtcaaacattttaatataaacttgaagcagtaactggattatcagcatatcagaaaaaatgtgccaattatcaaccaacaacttggctaaggttcaattgtgggggcactaatcagttcactgagcataatatcgcatcacccttccaaagttggtgccagaactgtttggtggacaaagtaaccaacacacgaccggtcagctgagaagagcagagacatacctctgccctgccctacctcctaattcagcagtcactactcactgtgacctcctgcatgaatcacttgagtctctgacccaaagaatgtccaaaagatgacaagcatacaatttttaagaaaaatactccatagtatactgaagttcacttataagactaatttaaaatacccagtttatacagccttttaaatggcttagccacaaactgtcaatccctcggaatacttcatccctgtgaataatcacaggaggaactaatttttaatggcttctcaacagtctaaaaatggaggtgtacatgtggctatttaaaattcacccatttatagttaatgtgtttttgatactatatcttagctgcccatccagcattggtcaaaaaaatcacgaaccattgtgaaataaacacctccctgtagctcctctctgctgtgtggacttcacggagttgtccccacacaaccctgcctctggaatccagcttgtccttgttacctgaggtggggctcatgttgacaccaccatttgttttctctgtctatggcatctgtatgcacacggcacatttctccaaaagggacactgaacacttgtttctgcacagcagtaacagctgctctgggcaatcaagaccatctaaaattatgcacatcacaagagcctacattttaaatcagaccaccctaaacaaactccaatcgagtgaaaatctacctagccattttcatgtgatgcagtcacagagcaaaagaagcttgattttatttctgcagattacctttatctttgaagccatctttgctacataaggcaactcatcaagttcaattgttgtcttaccccattctgaaaggtttgcccttggatctgtacttttcaaaagaaaacaggacaaacacaaaacactcataccataaagacttccaaagcattcttaggtttgctttatgagctactccaggaaggttacggaaacatctttccacactacatgctatttctggataaaactataatggatatacaggtagataattcttaaacataaactatgtaagtgtctaaatatttgacttcccctcatcctccaccctacatcaaacaccattattaagaaaacatactttgaagtatttatgtattagggttcttggttatagttttccaaaacgacaaaaaagctattattagcaacagcttaagtgagacagcttatgcaattattgaacatatatgaaaggcaatgaggaattaaatgcagaggtttttaaaattcctgaatttttgtgactctttttgaagaaaaggagcagaaaagaaagctctgcagtttggtaaagaaacgtcatttggttctataaaggctttacggtgattctcactccaactttaaaaatatgttttcatctttagggggcatttatgagtagtcacaaagtaaattatgtgcaagaaggtgaaagaaagagtacttcctaaagaggcgaggtgcagacggatggctgcaaagggcctcctcagctcaactccccatagtggggtggtgtggcagggggaggtggtgaggcagttgggggaagggagcagccgggggacctgccatcccagcagacattctggtcagcatcctccatttccatagcaaaaaaccatcactgtgcttgttaagttgtcatttcctgaaggaaagcacctgtcaccctcctcattttccccgctctgggcagttccacagagtgtaatcttgcactgcgattcccagcagctaaggtaactgagttttcagaaaaacaggggagagagttcatcaaagaaccacacatccggagatgggtatcccacacaattagttttgtggaagtggaaagcaatcacaagagaggcatttctgtatgtttggtgaaagtgttgaggaatgcgacatgtgataaagtcttagacatgaaccccagaaagactgtcttacctaacgaaagaatttgctatctttaagtagaaattctaacatccactgtgtttctctttttactttggtttccaggaagctcattataaatgtaatgctcaaataacctcagtagcctaagttatttggcatgatttcccccttcctccatatagtttttgtgatttatttgtattttatcagtcctattgcctacatatacattttgttacaaccttccttacatgctttttgcctgtatttagagtacacagttgggaaaaaaaagaaacaatctgtgatgccttaaatgaaatttttttttttttttgagatggagtctcactcttgtcacccaggctggagtgcaatggcgccatctcagctcactgcaacctccgcctcccaggttcaagcgattctcctgcctcagcctcctgagtagctgggattacaagtgcccgccaccatgcccagctaatgtttgtatttttagtagagagggagtttcaccatattgcccaggctggtctcaaactcctgaccgcaagtgatccgcctgcctcgggctcccaaagtgctgggattacaggcatgagccactgcgccgggccatgaaatttatatatactatacctattcataagatggtattttttcctgaagatttctcaaaaaataagtttaatgttagaaccctattcgttatagcataacacgctagacataagctgcgggagtgtgaacgaacaaagtatctgtttgaattcacaggattctagactacatcaggcagacattcccgttccctatcacagataaagatacttatgataggaattcttcacttcctttttttagtcactgggatcctttaggactctgatttttaaaagccatggaacttcttccccagaaaaggatgtgtaccctcacacaatgtttgacatatactttccaggcattcacagacccctggccccatctgggttccttcttgctacagaaatggcaggtaaaataagtctccactggagtcaatcacatggagtcccttctgagcccagcacagcaagctgcatgttcctaacccccttatctctccgcaatcagtcaccacggagaggaacagtcttctgtgacaatcccaaccctggcaggtggcagcggaagaacgaggcccaggtcacctgaccccaatgaggatgctgatgattttcctcctctccactgttcagaggcagcatgcttctctccaggaaaaagaaaaaaaaagaaaatccacaacatgttgccactgttaggggggaaatagactatgtaaacgcagtgctgtgtttttaaccactaaaaacctcactgtgtcttcttcatcagtctctctcctcgacagttctctctgacttgaagttgaggacttttcccactaagtccacaaccttatactcgccctcagagagatgttcgtttcttcttttccccaccacaccctgtaaactcttttctgtcgctcccacaggaaacaaaacaaaacaaaactgtagttactaacacatggcacttatttctgcttactgagcaaggtatctcttatcataaaaaccaaactttacctctcactctcttgcacgagacttacatttagagggtttcaggtagcaagtcaggattagactaagaaatcacagtggtctagagggtagtaacaggaatggatgcaaaaaaaatgaaaagaaaaaaaacccaacagctaccaccactagaccaagattttcaatccccactgtaacatttaaattcaactaagaaaccttaaaatatatacacatactgctgtccaagccccatgcctgactatttaggtcggatttgctgggggtgagctctgggtgttgggagtttttaaagctcctgcgttactctattgtgcagccagagtggggcgcacccaaccccgaccactggctgggggagagggccagggcagtgctcggaatgctggaggtaaaaccagatggcatcactgcttgtccctttttgctggtcctcctgggtagacatgatcacccaagtcaggtgtgtacaggcagcccattctctgaaaaacagtggcaacagccagcagcccctgtaacacaggacacaagagtggagcagtgaaggaagctccccacgagcactgtcctgaatacagtctccagcctctcgtgtccaggtgcaggtctactctgagcaagctttcctttgcaatgtattgaaggacaatgtctctgggtgcttaattactctcatcagcaccacctctcagttcaggggtaatgtcccaaactcctcttccctgggtggtcaaggcattatctgtcccttacctagggaggcaagaagaccccacacccagaaaggcaggtctgggagagaccaggggagacagggctgagcctgacggacagtgagttgaaggattctgagcagaaggggagggcaaaggtaagtcagaggctgcctgactgatttctctggcttcataagcagaatgccttgcctctttcaagcaggagggctcctcatttaacacaaacaggctaatataattcgcagaggcattagcccagctgctgtacagcaaaggccccgggcctagacagccttctctccctctgagctcatcttagtccattctgtgtcactatgacagaataccacagactgggtaatttgtaaagaaataaactcatttctcacagttacgaaggctaggaaacacaataccgaggagctggcatttgcaaagggccttcttgttgcatcatcccatagtggaatgcaaaagatgaggggcagcaagagatcgaactcagcctcaagcccttttataatcagcactaatcccctcatgagggggagccctgatgacctaaacacctcccattaggctccacctcccatcacggttacactggggactaagtttccaatatatgctctttgggggacacattcaaaccatagtagagctccattcagttgctaccagtaggaaaaatctttctttaacaacttaatgacaggtaaatcaactccaacttccctcctatttgaggttcaaaattatctacataagtaggcccttcatgatgagcagggctggccctggccatcttacaggtaccttcaattactagaccacacagcacccaggcaaagaactggcgctcagcacgtatctgtcgagtgaatgaactggttccaagaagcatattcaagcgtatgtacaaagagctgcctattcatttagggctacagtaggaatataaaatgctctgtggtgccccttcattatacatctctgttagctaacaactcacttagggctgctcacccaccctaaggctgttcagggaggaacgaggactaatgtggtagtcagtgccccggcatcctccccgctactctttttagtactgaactcccctagctctagtcaggcatgtgattccccctgaccccgctccccaggtatagactatatttcctaggctccctgggaactaggtttgttcctgtgactataccgtgatgtgatatgactcgatgtaatgtgtccaactttgaggtcaccctcttaaagacacagccacttgcaccactggctaagacatggtgacaaacggagccatctggacagccaggcatggaggaaggcagaggaactcctccaaccctgacttcttaactctggactacgatctgaggacacactgtactactcagggatgtccttgtcacagaagagattagtccacaccttaacatattccagaaggaatatgagaacctgttttccaaccctgaaacaagcctctaatttgtctagggcaagtgagttagcctcccccttgcacaatttcctcctttataaactggagatgaaagcacccggtcaattttattaatactaagaatcaactattaaagcacaaatgcattgaaatgtgatgtgaagcagcctctgtgaatgaaactatatccaggcagcacacactggtgggaagtactgccccagaaggaaatctgccataccagaatattactatttttgacaagaagctgaaatgtgagctcagcatagcattattctaaaataatgaaaatatgccagatgcttaccaacatgaactgtacacactgattgcacaaatatgtccattaaaactaataacacaccaggggagaaaacaagctgcctcgtctgtgaagtggaccaatcatagtttcaattgtgccttaccaggtaagaacagggtcttcccaggcaagaatgtgcgacccagaagtcactgaggtttgtcccaggcagggctatcaccagcccttttggcacctctgaaggagtcaagaaatgggcctggtgatttgcttgcgtaagaaacagaaaagaacaccctcttcctccagactgacccagctccatcccctggcctgggccgtggagggtggcgagtgggctgcatttcagtggattccaccctcatttgcccttcagccaggagcccttgtgtagggaaccaccacacaactgcatgcagggcctggtcccaaatttacaatgcacatggcattgttatcaataatgtagttagaactaatgtttcctaggaatcctaattctacacagacactgtcacctgtcagtaaatctgccagaattccctcgctggaaactgacgtatattttattccaaagaataactaagtgaatgctctttcccatctctcttccatctgaagagatgagaagcaggaggaagaggagggggaggaggatggggaggtgaagggagaagaggagtggggaacaagaggagcaggaggaagaagcaagcaagttccaagcaatacaaaagggttgtaggtgaatgaaggcttacagcccagtcctgcaagcagcagacaggatgcagggaatgaaaaggctggaagacaacagccaaatatcaaaggatttacaagaacaatgatgtatccttcaattaaattcttttgcttaaactaatctttcagttcttgtcatgttctcaaatgaaatccatttacaactcccaacacaaagccatcagacaccctagaatttgcttagcagacctaaacagtgacactgctgtaactggcaaggaccccttttcttttaaagggacattttggcaagtcatttcataaccaagacactaaggagcacagaatagaaacagcaggccacctgccatctctgccaggagcaccatcctctcccgctccccgcggggctccccccgctcccctatctctggccacaagtcccaatcatctcagctcttcaaacccaccaagccctctccacatcaggcctcccttactctgtcccctcagcctgaaatgctccttcctccctccccccacagggctaacctctccatccctgagttttcagctgcggtctcacttcctcagagcggccttcccgcccatcaaaactacattctttctgccagtctcttaccccgtgttttattttttcaccgtagcacttatcacaatttacaattatggttttttccccctgcagtgtttatcatctggcttcctcacagacgtacacaccaagaagtcaagaatcatttctgtcctcttcaccattttagatgggtgcccaggcccagaactggagattaagtcacaacacatctgggttgagggcaaaacctttttttttttttttttaattccacgggtgattcagatgcacaatgcccttttgagagaagtactaacttgacattttcctagcaaattaatatactgaaataccaagtaaatcactccatatgaaagaaaaaatttacagtaatgctacaatttctgataagcacaatctcttcataaagcagcaggcttacaaatgttgcctatgctttctcttatggtatttccagatatgtttactagaccataagttattgtaataaaacctacccaggatattatggtttcaacaagcacacagaaaaggtattttgcaaatgaacaagaatccatataaactaggctagtttagtagttgcaaccattttacccataatcctgtgctctctaattatgcaaatatggcctctgcaaaacaccaaggtccaaaatcccttcccttataacacaacagggtcccagactgcttacttcaatgactgttaatatgccaacctttccccataaaattctctagtccctattgtaaacatcaaaatatctgccatacaaccaagaaaaaaaaaagtgactgatgtaatccagtcctaagctatctctcggtggtggttacagcataaattattacaggttgatattgagggtggggaatagagatgctggttgatggattttaaaatgcatggtcgctgttactactaaataccagtttttcatttcaaagattccccccccaaaatgactcacgctgcattttgacattgctttccaattttatccctccctaagcacaaccaattatcacttccagcctttatctagccggctaaatggtcccttgcatcactttatcctctccttatttctggaactctttttctcctagagcccttcactctgaaatttttccaaacaaccaccaactgcctaaacaatgatttcattttcaagaaagtagtttagcagtggcttggtatctcaaagcacaaatgagttttacagtcttcagagttttcaaaagtcatttggtgttattcatctgtagtttataagtgtagatgcagaaaactgaaatgaactgcctaaaactttggagtcttatgtctaaatcaagaattctgcctggggccttattctttagtcccgtaagtcagactcacaggctccccctcttcaattccgtcatcagcctgtcacacccactgacccagctccatccccttgcctgggctgtggcgggtagagtgggctgcatttctgacagaaatggagccaggctattttacatatgggggacaaaggtttccacaccttgtgaaaccctaggcccagccaactggacccaaagtgaacatatgacccagaacagccgatgcaaacccagctcagcagggccttccaagaggtcaagaggggcttgagccactcttgttttttaaagttcccaataacattaaaaataagaaaatgacaaaacattttaacgcctatattgaacaaattaacatttctaacatccaaacacttataactaattatgctcttcataaggcagttacaagatttataaaatgtattaattcatagtgcactacaggcagaatgtctattaatgagaaacatatttaaatctggatgacgaatgccatcttctttcaatcctgccagtttgtctctgtgactaaacgtacaagttcatgtggagacaacatgaagtaataaatctgaggcccttcatgaatgtcaggcccaagctaaatgccatcgcagccaacagctgctgccatcctccctgatatatacactatgccctattggccaacaacatagggcaacatatttaattcaagtgtctacttcaacagagatgatgccaactagctaggatcatcacagtcaccgtagcagaaatttcaaggaggaaagagtcaccaaccccccagtgctgccttggatcgggaaccacgtgacagcccatacctgtgtggcccagccacagttcatatcctcagatattctcaagattcccatctgccttgccacgtgtaacctgctatgaaaacccctgctacagagtttttgtgccttgggaccaagagagcctaatgccacaaccttcctacaactggacaggctgcccctgttcaaaattcacacaagcctggaaacctcagggacaatgacaatacagtacttttccctctctcttagcaaattgttcccacctttaaggttgtcatcgccccttctttccaatcattttgttctcaatcactcagcttctcttcactaaaaatgtcccgtgtttgactatcattatttctagattctcaaatgcagagatttccgaacaatgcttttagggaaaagaaaaaacctggcattaaacacagacgttgatggccgggcgcatggtggctcatgcctgtaattctagcactttgggaggccaaggcaggcagatcacttgaggtcaggagttcaagaccagcctggccaacgtggcgaaaccctgtctctactaaaaataccaaaattagcagggcgtggtaatgtatgcctgtaatcccagctactcaggaggctgaggcagaattactttttgtatacacacacacatattgattcttagactcgtcggaatttcagacatgtttagttaatgccttagaataaaccaaagaagataagtgtgtcacacttacaatgaggggcaacaggtggaattaaaggagaaatggccaaatctggatggatggcaacaaagttctgcgaaatgtcagggcacgtggcaactacagcaagagaagaagcagaacaagtgaaatcaaaaggaaacaacgaagatgctaagattcaactgccagtgcacacaccaccccggagagtgtttccaatttcccagggctctgcagaagaatcttatccaagcactaggtggttctacaaggcccttccttctgcttgtccttttccctcactatggtttctcagtccccacgttagctcaacccacttggcccttgcttcccttgcattccccagaatccacatcactcctcagaaccatacctctgcttccctcttggagattaaaacctcatagaaaaggaattgtaggggcagaggtaagaggtgaccccttatgaagaaaacttctggggcctcagcccagcctctgagaaacagcccatgtttacacagaccatgctgaaaaggaaacccacggctcctggagtttgtgctaccttgaaataatgcttagaaatatgggtgacggcatttcagcatcgaacaggtcaaggggaagttaaagagagatctttacctagtgtcactctgacaagagctgtttaaaaacaaaacaaaacaaaataaaacaaaaccagcccaagaggcgctggatggcaagatgaacaaagcacagcctccactctcaaggggagcatagcgcacagcctcagactcaccctgaaacatttttgggcctcaatctcctcctcttagtatgaagagcctctagtgccactgtaataatatgtttctataattcgacaccatgcttttcatactttgcctctcaaacaacagttgcaaccagtattgttccaacaacaaatgggacaagatcatttacgagagagggaattaatgggtccttctctccataaaataacgatacactccaatttccaaattcttgaatactagatattgagaagctccacgtaaatttttttttttttggaaacagagtcttgctctgcagccttgacctactgggctcaagccatcctcccacctcgacctcccgagtagctgggactacaagtgtgcaccaccatgcctggctaattctttttattttttgtagagactgggtttcaccatgttgcccagtctagtcttgaactcctgagctcaaacaatcacctgccttggcctcccaaaatactgggattagagctcacagaaatctttaagaaagaatttatgaacaaaagaaagggtgtaggtgtcacttacacagaagtaatatttgtgggactcactattcaaaaaaagcaaataccaaaatacatgtatacctaaaaattatttaatcagatttggacatcagagatcatctcacatctatggtatcatctagtctggcctcttcattttatacataaagaaagctaggcacagagagattaagtaattcgcccaaggacacccagctagtgagaggcaggacaaacagcagaacctagccaagaatgatttaattattccaaaaaggtatcagaggatgttagcaaagtctgtgataagctcctagtctttggaggctaatgtcaaaggggacagccaagccctcccacaaagcactgcttactgctctacacaagccagaactcaggctgatcagtgtaggggatgcatgtatccttggctcccacattcatgcatttccgtcatgccaaaggtagcacatgtcctgcaaggcacagtagctgacaccccttctaaaataggccaacagctccaaagtggttatggccttctcagattgcaggcccagtttcccacctcactgttgttattgtaccacacacaatcacctcaccaaaccataggaagccaaagctagcggtgccagcccaccagctgagtagcagcagctgccccaaagacatcaccctaggacctcacttcctgttctggcacttaagcctgtatccatgccagttcaaggtctggcccatcattttcaaagctagagctggacaggccccagatatccaagaaaccatctgttctagaattctccctcctccaacttcacttcacaacaggccatggcatctgccactgtccttggtcttctgaacagaaggtgtggagctcttgtacacaaccttggagagaacccaggtcattctgaccctgtccggaaagggaagaaccactgttttaaatcaaacatcctgaagcaaacaggtccatgcattctatctggcagctttaactcccacagatgttagaaaaatgtagaaaagtgcattcaattttctaaagtcctagaattctggaccatttccccttttcaatttatatttattctttaataaatgcttttcaaaaaaaaaaagtcaccagtataaaacaaagacaaagtaggaataatcacactattaatgtactaatacctcagacctaaggcactgtgaacttactttccaattaagagcaaaaccagaataaaatcaagcattctttgaaagccattcaagtattactatatacaaattctaagtaaaccccaagcaattacatttgtataatagcagtcgtaataactaatattgattgagcttcactacgtggcaaactgcattaggctctttatatgtacgattcactaaattcttctaacacctctgttattacctcctcctttttttaagcaaaggaggcatatgaaggataagtaacttgcctagggtcatatcaataaaaggggcagagtcaaggttcaaacctaggtccacgggactctaaagccagtgtttttcatattataccacactgccttggggtcttcagtgtgtaggagcaaaaactaaaactgcattttaatttagtaagcagcaatcaccttccattttaagaggttctgtgtaactgactgccctgaaaatttacaggcaaagacagggaaattggcactcatctaacaagtctatagcatagctgtaaagcagctgtgcagaagccgggggacaagtgaatcgtgtgctaggcaaggctttacgtgcctctgtctcagacttgaaatttttttttaaactggggagccaaggagaagggaaagataatctttttctaaattctacagagagtattaaataaacatgatcagccccataaagctctgataaagtcagtcattaaaaataaaaaactgtatctcctactacctctcattcttcacccaacaagtataaaaatccacgagcacacacacaaactctatcagtattagcctatttaaaccttaaatttttaattctgcttatctcttttgggaaattcattcaggagacatttggctttgcttatacttctgttgctgttattttattgcaggcgtcaatatgactgtctcttgggtggcagctctcagacatctcgtgcagtatcaatattcacaaggcagcctcagatttactgctaaactgagatcatgagcatgaaacaataaacctacaggccactgggcatatttgctgttgatcatgcttggatcagctgcacaagcttgtgatgtttatgatataagcaaatggctttccttgctctaccttttctaattcttcccagtcaacttttatttcaaagtcttacaaaccatctatgtgccagctactgtgctagctgctggcaatactgtagtgagcaaaataagcttactgcctatttaaaaaggcagaagtcaatcaaataatgatgcaaaggagtgagtaattagaaaagagcaccgtgaaggaacacagattgacgagtgtccatctgttcaggctgctataataaaaacactataaactgtgtaacttataaacaatagaaatgtatttctcacagttctggaggtggggaggtccaaaatcaaggctccagcagattcagcgtctggcgaggctcatctctgcttttcagatggtgcactctcactgcgtcctcacgtgttggaaggggcaaacaagcttccccagcctcagttataagggcactaatccaatttcacccttaggatctaattacctcctaaaagcctcatattattgcattgagtactaggtttcaacacatgaattctgggagacacaaacatttagacgtagcatggagaatttgggcagtttttaaacatggctgcaaattctgaaactcctcccactgagaggtgaggtctatgtcccctcactcatgaatatgggcagccttatgacagcttaaccaatagaacatgttggaaatgacgctatgtaacaaagctaggtcataagaggccatgcagcttctttagctcactcttggaaccctgagctaccctgtgagaagtctgaccacccggaggccacccagtcgtgaggaagtctaagccacatgaagaaaccacagtaggagccatggtcaacagtccccgctgaggctggtcttggagtcatcccagtccagacagcaggcatacacacctgaggaagctcccttatgattctggcctccagctgttcacattctcccatcatggagcagagataagccttcctcactaggccgtctctattcctgacctgcagagtccacaagcctaagagtggttgctgtttaacaccacagtgtttagaagtgctttgtcacacagcagtcgacaataagaacaaaggtgctgcatataacagaggctgccttgtgccaggaagtcatgcgagcgctctccatgaaagtagcattagggctgcgatctgaagggtgaaaagacctccattaatggaaagagagggagaagcaggctgtaggcacaggcactgcaatcagagggagtgtggctggcacagaaaaaacagcacagagtgagaggagagtaaaaaggctgacaaggtaggcaggggtcagaccacattgggtgctttgctggtctggtgcttgacagcacttagaagtccctggaggggttgtctatatacatttttttaattgaaaattcacgtaacataaaagtcactgttatgggttgaactgcatatccccaaaattcacatattgaagtcattaccagcatctcaaaacgtgactttatttggaaatagaatcattgcaggtatacttaattaagaggtcgttcagggtagatcctaatccagtatgactgtgtccttataaaaagacaaaatttggaccacagacacacacacaaggagaccaccatgtgaaaatgaagacagaggtcaggtgacaggtttatacaccacggaatgacaaagatggctggcaaaccactataagctaggggagagccacggagctgattctccctacaaccatcagtagaaaccaaccctgtgacaccttcatctcagagctgcagcctccagagttgtggggcaatacatttctgtagtttatgccacccagtttctagaacttcattacagcaaccctagggaaccaatatgtcactttttttttttttttttttttgagacagagtctcgctctgtctcccaggctggaatgcagtggcgcgatctctgcttactgcaagctctgccccccaggttcataccatcctcctgcctcagcctcccgagtagctgggactacaggcaaccgccaccacgtccggctaatttttttgtatttttagtagagacggggtttcaccatgttcaccaggatgctctcgatctcctgacctcgtgatccgcccgcctcaggctcccaaagtgctaggataacaggcgtgagccactgcgcccggccagatgtcaccattttaaagtgcacagttcagtggcttttagtaaattcacaatatagtgcagccagcaccactatctgattgtagaacattttcatatcccaaaaggagacctcattcccaccccccccgcagcccctggcaaccattaatctgctttctgtctctatgatttttgcctattctgtacgtttcatataaatagaaacatacaatatgtggccttttgtgtacggcttgtcacttagcataatgttttccacgttcatccatgttgtagcatgtatcattacttcattcctttctataccattgtatgggtataccacaatttgtttacccattcatcagggacaattatctgagctgtttctactttggggctattatgagtaatgctgctattgaacattatgcacactttctttttttgagacagagtctcactgtgttgcccaggctggaatgcagtggcacgatcttggctcactgcaacctctgcctcccaggttcaaatgattctcgtgcctcagcctcacaagtagctgggattacaggtgcccactactatgcctggctaatttctgtatttttcatagagacaaattagcctgttgcccagactggtctcgaactcctggcctcaagtgatccacccgcctcagatccccaaagtgctgggattacaggcataaaccactgcatccagcctcatgcacacattttatttgaacacctgttttcaattcttttggaaatgtatacctaggggtaaaactgatgagtcatatggtaattctttaacttttttgggggtccaccaaaacactttccacagtggttgcgccattttcattcccatcagcaatgtctgagggttctctggagggcttcaagcaaatgagatattgagttgtgcttagaaaaaaagtcatagaaaccagcattcatgagagaacatgagttcagttttgaaccgatgggtctgacatgacttttaaaacattcaagaggacatgtcaggtaggacagtcagtctgaggcttaaaaatgaggtcagtcagctctggagttaaactttgagactcagcaggtcatgggcatggaagagattccatgagagaaagtgcaaagtatagaaaagaggggcttctgaacttttaggagctctgaaaatgagtggtgggacagaagaaaacgtgtctgcaggaaggagtgtgataagcagaatttaacaaaattataatattggtggactaagaggaaggagactgagcaaagacaaaagagactcatcattttgtaataagaaacagatttgtaaatggtctaaattgtgacattttaacaaaaaaggataaacaccattttacttctttctacatttttcctttttaaaattcctttccttttttaggggaggggagggtagtggtggtggaaaggaaaggttttaattcccttagtcttatgtgtaagaggttaaactacttgacctgttatcagaactggtgaataaatgcttttcagactggacatcaaacctatctaatttaaaatagacctcccccaagggaactgcatgaaaagaatctggtcatgtacttaacaagtttctattgtttcatcaaagggtctgaaagctggagaagacagttggatgccacttcaaagtatcactaagaaatcaacaacgattaaagcaggagaatcataattcctccacacaccctccctgctgacaagaaggtatttaattagagtccaatcaaaagatgagaatcctatgaataaacctgtaataatatcctctgtcccacttcaaaattatagcttaaattattttgttcctcaaaagccatagttccagagattataaaactctctttacatatcaatcacgagtgtagctaatcctttcaagtctacaatgcaaataattaaattttaactttgtaatcatgagaacaaaggactcttgggattaaataaacattgcctttagaagagtataggaaacagttttagctcaggccggtggcctttttgagatacaacccatcccttactcctttggtggctttcaacattaatacaaaattgggaaatttaaaattcactgtaattcattacagtgagttactttatttgaaaacaacacatgcacacatacatatatacaattccatgtttcctctgtattcacgtactttgaaaagttcaattttatccatttacagaagaggtgtcctcccagagtaagtttggatattagttatttaaggtaagcctatgtcaggtggaaatatgattgatgttaggaccctataaataccttcttttgctttatatgaaactatgaaattggttctaattatattaccaaattgaatcatattgaaaaaaagtaataaaatcattgcattagtcacaatcagccacatttgctggtattcaggcctggtatttgacatatatgttattccaaagccttacaaaaacccaaatagaagttattaccatccctgttttacagacaaaagttcaggggcagaagatccaaatcttacctttagaaacacagaattgaaatacaaacctttaaaaaaaaaaacaaaccacaacgctaggactgcctctaccacactatgccttcatggaactgttatgagagcttttagaacattattgccaagtacagactaagtgcagcataatgatgaggagataaagtcaagaatgaaagtaatggtttcccagaggaaaaaaaaatacgtattaacataagtaacatttcattactaagagctccataagaagttacttgatttaatctaggttgggtttttctgtgttttttgtttgtttgttttgtagaggaggtgtaaaattttagatacggagtgatactctgttgtaaaagcaagagcaaaaattttacaaaacactgcttccccacagtacataagaaaaagtcttctcaatgtccctgtccctagttcagagaatcagtatgacgatagtacttggagaactataagagcagtaacttacattaattagtagttaatggggtagagccacaaacattaacttattcattaattctcaacatacttccctgaagcaagtctgagcttctctttgatagagggaaagaaagtcaatgttacataagtgatggcagcctacttccaggaagtgatcataaatacacaagactaacgccacacttaagactttagattcctcctatacagagaggcattaatgaacgtatttttagacacaaccaatcccaaaaaaaccatcattgaaaatttgtaggattccaaaaggcaaaatacgatttgaaagcactgaaacataataatgataataacaacaacaataataggaaagggaggaggagaaaaagctaataattgttgagtgcttataatacaccagacaattctgtaagagccctatgggcagtagttatttatgcctagtgttccattactggaacgctaagcatgtgggagttttttatacccttctgctcaaggtggttgccaaggtctgattgcaaaaattcaaaaaattgcaacctcagacataaatggattaactctcaatccttacaatgagcttgtgaagcaggtattatttcccgcttataaggaaatgaaggtgatgtgagttgcccagtcacactgatagttccgagcagaatttggagccactttggttccaaagcccatgaaactgaccaagattttacccagttaatcaaggtaagacttattttcatgttcaactcaagattacccatgcaagattgacgttacttcaccaaagagaaaaaacaaaagtctgttatgttttgccctttacatatttccagggccagagggccaaaccccttccttcctgtgaacctctggtgcaatgaaatgtcaagccagatctggtccactctaaaatacgactcacttgctattactatctttaaatggcttcatccgacctactccctgaaaccaatttcctcttgaatacatttaattgcttctttatgaatgaaccctattagtagcatttattcattccttctgaaaaccacgtttaaaagcaagaaaatagtatgtcagagtagtatgtttatttcatcaaatacacatcttctcttggaaaaaaaaaaatcactttgcttattagatctttctgtgccaggtaagttttaagagaaaatttatactaccacatatttttaagttgagtactatgtttatgagaaataaagcaatgagtggaaacacttcataactaagtatctctaaaggattttccataaaccaattattcactcattcctcacttgttactatatttatcaacatcaacatgttgttcaaggaccatccacatgagaatcacctggggctggctgttgacaacacaggtgagatctaatgaatgctggtttcccagtgaagaaatctgcatcactcacgaacagcccaggtacatgctggtttcccagtgaagaaatctgcatcactcacgaacagcccaggtacatcttatgtattctaaaggttgaagaccactgagtcccctttatgtgctaataggacaaacagatacacaaagggcttatcataacctcccataattgatcttaaattgatctctctgcttctaaccttgaccccatccctacatacctgcttattccgtaaacaacaaaaggatttttaaggcataagtcagatcatgtaacttctctgctcaaaattcccccagagtttctcatctccctcagtggcaacaagcctagaataatctccctgctctgcctttctgactcatttcctaccactctcctctcccctcctgcttggctccagccaccagaccgcctcctcctcacccctggcccacctggtgcagcagaaccttcacccctacaggctccctctgccgggaccgctttcctgcagctagccccacagcctgttccttcccttccttggggttcctgctccacaatcactagtgtgggaggccttccctggccactttatcaagaacctgcccatcccttttcctgcctgattcgatcctctttagcgtttatcactatctaatgatctaatgtacttgctgttttacttattttttcttgttggttatctgttaccctccactaaaatgtaagcttcatgagagcaggttttttttttttttttttttttggtctgctttgttcttaaatgtatcccatttggcacgtaatagacatcaaaaaatatttactggctaaaaggatgaatgaatatcatcaatgctccaaaaaagggtacttgattaatgaagcattgtaagagagagcaaccagcttggggtagggggcagagcgcctagctctcctcgtggcaggtaacactagtggggttttcaaggaaggacagaaaacatctcctaagaaaaggaaggacattctacacatcagctggcctgtaattaaaagtgtcagtgtcatgaaagatgaaggaagaatgaagaatgcttctagaatgaaggagactggaaagatatgacagctgggtatgagtgatcctgaaccggatccttttgctataaaggacgttactgggataactggagaaaactgaagggattttatcagtgaaggtttataggagttcttattttagtatttttgccattttcctgtaagtgtgaagttgtttcaaaaggaaaaaaaaaacacaaaaggaaccagaataacacgagtaaatgcaatgcatcaaatgatctgtgaataaaatgcccactgaataaaacagggaaaaacaacaactatttcttccaaatgttcctatttcccttactcccccattcctccatgaaaaactttgggcctgtatcatcttggcttagagtcagccaaatacggtcattcttctttaagtataaatgcaaataaaccccctggatttcagtgggaacacagcatgcagcagaacatttgtgtgtataaactctgtagtaaatgacatctctcttctccctacagagtagaagcttgatctccatgaattgctgtaactcaaaacatactttttacacaaaaataatgatggggttgaaaatagaaaaagtaaatctttggactggactgctgttgtgagccaaagagaatgattaaatataaaacaagagggaaaaaaacaacagcactaggttataaaagaacagattgacatagattttttgaaactggaagttacaggcaacatgcctagaatttagataacagtattaaggactgaacactcatccaaacatctacagctcccctgacaggtcaaattccattacaacaaacaccagtgcaataataatctgagtaatccaaagcattcctggttaacgacctccttaactcaagcagtatgcaatatctaacaccattccccattttaaacacaaaagtacaaacgtaaatacagcaagtgattgttcactgtacaaaaggactcatcagaagtctccataataaggtataagggtttttttcaacatctagactagtgtttgtggggccattttttaaatacagaaaaaaaaattaacttacatgcaacttttgaaggacatgtctagatacagtggacccaaaatgttaacagcaactgaaagcaagcacaagtttaacatgacaacaggagcatctatagattgactcatgtacctcccaagtcccctactttcctctgtaatgtggggtacaccacactgcctggtattggtttaatttgaattttcttccaaattattaaagttgacaaattctcattttttaaatatgaagttccagcctctcctggaaaatggttagatctggcaacacaggtacagattcctgggtcaaccaacagctaatggaaaccagctccctgataggcatggcagaagcattgctgacccctttaccacactccccatcactccctattgcattcccagcacccttaatggcttattttctgcctggtccttctaagcataggaatctgcaacaccagcttttaaaacaactaaaacaaacaaacaaaaattactactcaacttgctgatatatcaaaactgagctgtatcatacattgtcctatgatacattgtacattgcagagagaaggcatgctaagttaatattatggataaattactttaagatttctctaaatgacattctcacaagcatccctggcaaaaggcaacatctataatctttaactgaaaacactttgctttggaaatgggaatgctttgaatgtaccttagcttatcaaagcataaatttacttgtttttaaatgagttcaaaactagccatcatagttatttatgtatatgttactgcaattaaataaaaaggaaaaaatgcttataaacacacacatattatcctgaaacagaaacaataagcataattactctaaagtggcaaagaatggataatttgtctatgaactatttcacagtctttgagttgtactgtgtattacacataaccagaatatcttcagtctcaaaaagactatttctgagcacacaaccaagattgcaggcaagtcacacaacccctctgtgcctcgatgtcctcatcagaataatgtgaaaaataatagtgcagacatcttaaagggttactgggaggattaaatgagctgatacatacaaacagcacttataacactgcctaccactattgcccaaccttgtatcaatcgacacactagcctaaaatgctgataaattacgttctcctaatgcaaacattctcatctctgctctggtttgcagaatgaagcagtctcctggtcttttatccaaagcacactccagtattattaatttaagttgctgctaaatctcaaaagtcattaataaaatgtagtgatttctcaaatggtttatggtcagccactctaagaggtacttaatagaaaagaattagctcaaagctggtatccagatgatttatcaaaacaactatcaggtttaaagaaaatccccagggcagtaaaaacccagcattcaaaaaacaccaatgaagaaaaagactgttgctattcacaaaggtacagactgttagtgagtgaataaatggaagaataaatgaatgaagatcaaatgggttatttgctgctgaccacaaacttatgcttccctttcaaaaaaaagtatttttaatcagatcctctgcttatatttgtgtcattgttaaactgtcttgtcatacttacataaccaggtaataataatctatgaaaatactcgactaaccaacccaaacgctttccctaaatcttaacatatgcactgactgcatttggtgtggtcagagatgggccctgtcctgaattcacgctcgagttggggaacaaaactaaccaacaaggattaagtggtaacctctgagtatctactaaacagcatcagagttcctggagggttatgcccagggtaggctgcaagggtgctcaaagtgaacaagaacaggacaaaggcaaagcagaggaggcaccaaacgaaaagcactgcagctgttccagccatgaggcctgatggagaaaacaacatggcacatgttctgctcagcaaatccctacccgcctccaatacatacagcagcaccacctcctctaaaacattccctcattacctgatctttagacttatacaccacttctcgtttatgtgtgtatttatttatatgtttttcctccattggactgagagctctcaaagcacaagaatcaccttaatccatcttgtattgtcatccgaggcacgcatattccctaaacatccctggattgaatgaagatgacttagcaaagggagggattctctcaacccgggagactgtgcacataactagaaagggaggggcccacggaatccaacgccaagcttcctgtgcattggtgctacccaggagaaaggagtgcccctgtcctcaagaaacttaagtccacttagatcacaaaaagttctctgagaaagtatgtgaagggctctatttagacagctatttattactctgaatttgaagccctcctccccttgaagtaaggcctactggcttaagggccctgcagagctaaagatgtgaggataacttgccactggtgcttagcacaaatagcgaatgagagttcactgggaagtacaaacgaagggaatcaacttactcataaatctcaacaccctttcttttgctcactggctgagaaactgccatctggaaggctcagcagatagatgaaaggcattatcacagttctactggaatatttctgcttggcaaagaacacaagatgccagaacttgaaaaaaatcatgtaattctgatgacctcatttcacctttcttttcagccaatccaaattcagcctgttgtagatatttaacaattagagaaaccttgcaattactttgctgaatcgctcgactggcaaaacgtccacaaggcctgcgcatctcctacattctaatgctctggtagctctgagacccacggcaagcaaggagagcaccccctacagacaacattcacactgagaagtggcaagaaagtgaggaagacaattccaggtccctgagtccaccaccagactctcatcaagttcaccccaatatctgggaagcatatagccttcactgcacatgttccatccctgactccgggtgggtgcacctgtacctgtgaaacaaacacacccacacacaggcaaacatagcactcgatcttttttttttggcatttgctatgtcatctggtatccctccagactgcctgggcctccacgagtcttagatgcctgaccctgcagggccaacatgaagggagccaccacttcaaggtcccatccaactgctgctaggaagccaggcctgagaggggctctttagtgttgttctgttttaagacctcaggctataggatctgataaaaattatcttcagactagtggtgtcataaaaaccccttttcccctgaagggacccagcaatttgaaagtgccttgcaaagcatgttctcctggattcttcagagcctttcctgaggcagacgagcatctgctccaagtcagacaggaggaaactttgtctctggggactcggccataataggccttagaaaccaagatcttaggccactttttagtttttcactgttagtaattcaacaagattcccctggcaccgtgcacactaccttctttgagtctttacatcagtagagaaatggatgcacagatcatctgtgtgcctctcactgagcccccgctaaacacacgactaaaaccagctctcccctagaatgcattttgtttgtttggccaaacacaatgcaatagtgtccttgaccccttccagttgaaagtctgtctgcctctgactggcagaagtacctaccctctgccaccctgtgttcattttccatttctgtaacagtcttggtgcctcccactatcatattccaaaatcccaggtgcacagagagtgttcttacctcttaaaatgttaacaacaggcacatctgtatatgctgccagagtttcaagaagataaattatcttcagccagaatcaaaattcagcaacagctcccctctgaccccccgaccctggaaccaggctctcccactctgggagcctgacaataaaaccttttacctgaatgactacatatcactgggctttagaagggatcatcatatatgctgtcattcaaaatgagagtaactttgaaagtgaaaggggacactattaataaattacatggggacttcaggggtataccagcactgtcacggaaaaccaggacctatggagcacttcgaaaaccctgccctgagtgtgggtgctaccatcaatgctgcattaaaaggacagccacttccctctggaagttgactgcctagcgcaagatacagacaatcaaataatcacccaaatatgcaataatgacctcacctaattatgatgtatgctctgaaggaaaagtcctgggtggtatgacagaatattccaagggttaacttgactggggatggggaggaggactggagtggaagagaaggaagaggagaagggaataaggctgcaggtgggccctgaaggagaaagcacagaccgggaggatttgatgctgcaccaaaagcagcagaagctgtggaggtcactcatagcatgaggtgtcgtgatcagacagacatgaaggaccactgaggtccagggcaaagcatgaaccgtaggcaggaacacggaaggcagacagcaggaagccagggcagttgggaggatggaggctcagaccagggcactggttggactcatgagggcaaagggagagctgaaaaggtaatacccaaaggtgataggtgagagggttaccaagattctggcttagccagaaaataaaagggccagtacataaaacagcaaagccagttccttatataaccctaaaatgccttagggtggccttgtaatctccttagtacagcatgaaaaatcccttgcaaggtaatgttaaaatgaaatgcaaacactaaaactacgctacaacagttttccctcacccacaaatcaatgaacctttcaacagtttaaacaagagagactcacctaaacaactcaataattctcagtgtttgcagcgacctgttcagttatgtcacccaataataaaattgcagatgaagttatgagtcctgagtgatacaggaagtttgccttgagtgtacagagatggtattcaaatctcaaaccctcttcaggattcgaaatctctaaaatcatatctgacccctatttatttcatcacttcgatgaacaattttatttttaaacagaatttaaaatgatcagcactcaccctttgagaaaatctgataaataaacacacaggaatggtttaggttacaatggctgcactaccctgaaccactgcccgcaaagactggatcgtcatgaaatatatcacagacaggaaaaggaactctgcccatcctcttttgtatgtcatgccaagaattctcatgtacttaaaagtgatcaatcacggccgggcacgatggctgacgcctgtaataccagcagtttgggaggccgagacgggaggatcacctgaggtcgggagttcaagaccagcctgaccaacatggagaaacctcgtctctactaaaaatacaaaattagccaggcgtggtggcacacgcctgtaatcccagctactcaggaagatgaggcaggagaatcgcttgaacccgggaggcagaggttgcggtgagtggagatggcaccactgcactccagcctgggcaacaagagcgaaactctgtctcaaaaaaaaaaggaaagaaaagaaaaaaaaagtgatcaatcacaataaaaattactaacaacttctatgtttatatcatactctccatttcacaaagcactgacctttttcagtggccttggcagcacaagcaggcaaatatacatgggagtatcaagatttatcacaagggcttgactggcagggagtggcagggctcttccatatgctatctctacagcagatgggtacaaggggccttttgccttgccctacctaagccaccaaaggaaatctctctgtgaccaatgtctggattatagcatataaagtttcctttcctgagactgttacctcccaaattttctagaaaaatttccatttcaaatactgtcaattgacatgcacaaaaatgtactttttccccttttggggtaaatgtattattttcaataaaacccatcaaatgtggtttactttgcatgctattataaaacacttgctgtaagtccacacataaggagggaaaaacgctttgtcagatgctttgtcccaaattaaattttttataatatataccacctccttttcttgaaagacatattcccagctcactgaaaaaagggttccaggaggtatccatgaaacacgaaggaaggatctgagaaacgatagcatcctgagcacccaaaatggtgacagataaatttctacagatgaagaccagaacagagtggggagaatgaggagaagataatgaaagggattataaacccaactggacagagtgggagaagagacaaaagatgtccattctttggaaagtcctttgggttggaactgaaatggatcacagaagtggggaccctatactacttaggacttctccacagacagacctgtgagtgatttgacagaccacagcctttcagggtgagaggcaagagagctggacagaagcacaggtaaggaggctgccatttataacaggcactttccattcgccccagtctccaccatcagctgcctgctcctgcacctgcatatctttccacatcacagaagggaaaaaatattagttgacatttagctaattttacagttaacgaagcactctcacattttcttatttagtcattcatgcattcaaaacaatttatggaatgccttccagaagccaggccctggcaaagcttgggataaaacccccttaaggtcctatcccatggggaactcaaagaccagtgagaaatgggtcctctaactgacttagcaccaaagaggtcatggtgacaagcctgggcctgatagtacaccctgtggaggtactatcccaacaatgaatcccctacatgaggaagggatttattggctgatgtcttttatcttttcaccatggcttagaatagttccaatggtggatctagctagatagaactcagcccatatgacatgacagcttgtaaaactcacagtttaatagccagcttgtatttgaaccatttaaacccaccttcgatttatcctttagaagacaaacaatttgctgtgaatcaaagaccatcaggtggaaaataaggtgctgaacgggggaaaaaaagagactacagcaaaacagattgcccagagccattcaaactgaaaaagcacaacatgccagactagcactctttggctgagagcgttccacagccccctcttcatagatgccatccacctggccagaagaaaattagacaaatactctttttagtatcattatagatttaggtattctttatgatttaaaaatattgccaacaaagagctataaggaatatataaagactgaactgctaaatagggtctccctaaataatagggtagggatagaagaagtttaggaaagagcacccaaagggtataattctggaaccaattttgcaagagtaacaataatagcagcagcagctaatcaagccctgagctaagtgctttgtactcattacctctttattctttacaatcttattgtaaaggtagacaccatacctttgatggaaggtagacagaaatggcagaaatatcatttaaagcagaggtaagcgcaaagctacagagtcaagaaatgtaaataagggcataatgtggcagttctccaagtcccaattcccacaaggtggtggaaaaaggactgacacctgcatacatagtggactgctttacagtggaggacccttgaactgagggagcctgaatattttataatggacatcaaatatgccctacacctttgctccatgcaggtaagactgtggaacagaatatggatgagaaaatatgagaggtgacaagtaggcaaggttcctataatggtgcctagctttaatcttttccaaattaagaatatttagctatttaaagcaggggagtatgacataatcagaattgctgctagagaaatctcctgcagtagagtggggagagtggcgctttagggaaggatgggaggtattataacaatgcaagtgagaaattactcatagaggtatgcaataaaaataattttacatataaatattatctctattaatctgtgcacttaaataacaccttgtacataaaattaaaagaaagtcaagtaaaactgctggaaaaaaatgcggctggcagcttcttcatctggatgacaaatatactggactgaaatgtcaaatgtaattatagccagactattaattcacaaaaaagagttaactattttgaacatgaatgatcaagcttattctttaacataagtgaacaaatggtttacttggcttcacaggtacaataagagaggttcagcaactgcaggtcttttggtctccctaggcccagtggagaccagctggagagtggaccctggtgtgaggtttcttagcccagtctacaggataccaaagcacctgatgagcagtccttgtcaggcttaggaaccctcccccttggtagggagcttcccagcttccccatgagaagccccatcaccagcaagttcctcttcaaagagtgagaggcacaggcagtagttatcacactaacagaagtgtctgaagccatgcaacttaaaaggactgtccactttctatgccacttacttaagcctttgaaggactgccgttgctcctgcccttgatgcacacagcactgccacactgcacaactccagggagcatcacgcacattccagggaattgtgcagttcgcctcctgtgtagctgtacatggcggccctcagggataagaggtcactctcccacagatacttccccattaacatctactttctgatccattatttttttaatccctgtatccctggattccagcagtaactatgggtctcaactgatgaccacaggcagttaataattttcacatattattaaatatttagaatttggttttgactaaatgtcattaatattcattttgcaaacaacaggagtggtgtttcaacatcttatctcctatatttgagccctgggagtcctctttaaatctagaatcttaatttcaggcctaattattatatagatatattattcttttgatgggggaaggagcaaaaacttgttgcagtttacaagtaaatacacttttacagctctatcacaaagaaaaggtacaaaaacaattgttctgaacaaatgtccccacttggctttcattaactgcataacttaattataaatgtttctctaaatcgcccaaaccaacttcaagatgatctaagtgtcactctccaataggctggttaactgcttgaaagcattttatctataaatatcaaaaagtaaacttagaaattatctttccttcatgtccaacagtgctgaaaggtgaaaagaaaaagaaagaaagaaattatctgcctcagtccaatttcaacagagccagcctgtttctgagatcggctcttcctgctccttcttaactctgctccacggtcttggcctggactttcccacctgtctcttcttatttcagggccagatgtctgaccacccttgcgccttgcctctgcctgggttataattcgtgcccagtggggctgtctacgctcctgatgccatgagttctcctgcccctgccaccataacactggaccctgttgctccgcacgctcaaaaatcaagcactcccatgtgtcacagttttacatgttgcctcacttaaggtacaacaatgtcagtaaagatgccttggtctcccttggcactcagttccctggagatatactggccagaggcacagatatgaaatgcctgtgaagccttcatcaggtctaagggagctgagatgctctgaggagccacccaccatgaccctttgaaccatactttgtgggggaggcccgggtgattacctcctaaacaagacacatctgaacgcatttaactggctaggtatcaacttatatgtaatacaccggcatttggtttctttgttttggttattttacatttactagtttattattttaaaaaattacaatggatacagatgaagagattcacaggtaaaggtatggggcaagggacatggcgcttccatgccctttctagagcaccaccctacaggaacctccacatgttcagctcatctggaagctccacctgtatctggtcttgtttgattttaccctactcgcaaggtaataagttagcctgttactgtttcatagaagctggcagaagacatgagattcccgggtcaaggacaaaggactttattattcacagcatgattcagacaacaccagcatcatgtttacatcagtccaatggaaatagcgttgaggggcccagatggcagctgcacatgcagtgagcgtgcatccagctgaggaacctatgcttgggaaacctgctgctttatagtaagcagtaagtgagagtaggtcagtctttgtcccagaaagagacactacttcatccctcaaggctgctcattgcaaacacaacacgaagaaatggcccaggtaaagaacgttcttggtatactcagtaagacatgcaggagcacaagagacccatggagaagtgtctcccaacaatttgtgtgtattcccaaacttagatgactatccttacggggttcttggtctcagcaactcctccacatgaaccccctgctacactctcaatgtcatgggttacaaaagcagcagtacatgcctctcactggaaaaggattttgaaacactgatcttatctatgttatctatctattctaatctaatctaatctaatctgagacaaggttttgctctgtcgcccaggccagagtgcagtggcaaaatcataacttactgcagccttgaacttctgggctcaagtaatcctcctgcctcagcatccagagtagctgagaaaacaggcacaccccactgtgactggctaatttttttttttttttttgtacagacagggtctcatttttgttgcccagcctggtcttgaactcctggcctaaagcaatcctcccacctcagcttctcaaagtgctgggatcacaggcataagccatctcacctggtctcaccccataatgtaactgtttactccaatatcacagtgtaggattccccacaagcatatccttcgctcaatatggtgacccaacccagcttttgcttctttccttcctttctgtttcactttcttcaccattagaaacttatctatgtttagaaatgcacgagaaatcaagaaatgaatgactagtagataggacagaagctggtttcaatctggtcaaaacattgttccagaaatctttacttagttaagggaagaaaaaccatttatgacagttaaaggaaaagaaagcacttataatagctcagaaaatgaaaaaggatcagacagaattccacttgacaaatgctcacattctgaaaggcactaacttagggaagggagggagctttcctttactataacatcaatgattttttaagacatatttttacttctcagacagtgaagaacaatttaaaatgccagactccttaaacttcagcagcccataaaaatcgtttgcaacaaaaaaaaaactgtaatcatgcaaatataaattcaattagagaatctgtaactgccataaaaatgaagtatatattaataaattaagcaacttcctaaacatgcctatttttacacattacaaatttttgcagagacccagatggatgctaactttgttcctaggctaagaaatttatttcagattcaactaacgtatttcaattagtaattatgggatagctgctatatttcaggtagttttctaggcatatttatatacatgattttacggaaactgtaatgttctgtagatactaccattttaaaaaaacaaaacaaaacaggtaggtctgtggcctgaaaatgatccctgaggtaagacataagaaatgttggcgttgttatccagaaaggaaggactggccaggccatgtcaggaatggacgtggtggacagctatggctacacaggagaggaaattacagcccaggaggagaggaacatggcagctgctctgatgagaaaaccctcagatccagttgccaaaggaaagcatggagatacactctcctccaatgggtgggggacaaaggaaacaaagcctggcattagtgacaagttctattatacagggtacacttttctaacaaggaaagttgagggtccggacactgacaacaccttttcccaggtgacagtgaaccaaaagcccgcaactcccctgagtgggtcacctactggtccctcaattatcacgtcagcattcactgagtgctcagggttggatgtacatcatctcatggaatcttcacaatgatcctagaggtcgccactaatattacccactttttgcccaaaaggagtagttcaaagtgatgaagtaaccatccatggtcacacagcttggacatatcaaggcccatgtttgaatccaggcagtctcacccttaaccactgtcttacatgttgtaatattctctgcctagcattgggaagaggaggggagaaaaagttaaatcacagaaataaaaaagtaaatatcccctctttttatataatctcctactatctggagctcatcagtataaaacaataaaataaattccatggatacctgcattctgtaacaaaaaaaccaaacaggacatatgtgaatgtgtaggttatgttcgtcaccacagaaccttcaaacacctaataacttgtttaaatgaaatataaaaatattaaagatgacaaagaatttcaaataatgcctatgccatcaagcttaacttactcaatatacaattttatgtgcaaattaattggaaacctttgtgtttctgctaacttaaaggccacatatggaatccatatgaagcagaagtttttgagtctgctcattccaaagcatgagagtaatgcataataaataacctgaatagttacttaacataagcaaggttgatgttaatcaaaacgactgcgccaaaaccatttagtggaaccaaatacagtcaaagtgctgggacttgggaacttggacaattcagcgtgcacacatcctacaaagaacacaggccaagtgccgacttcatcctaattcaacatataaacggtaagcagatgccttctccaccagtctcagctcaaactccacccatgggtaaaatccaccaggactcccactgtcccctctgcacactgttcctacacagtgataccaagaacacagctgaggcacctgagatgctgggctcccagaagagaagctctgttctttgttttataaactggggtctttgcttaaaattttggttaggaaaacaaaggattccactatgaaaagggtaggcaaagtgttgaacagtgagtagtaaaaactaggacccaaattatttgtaaggtctctttcaacatataaatcctaagattatacaatcagggctgcaaaagaccaattaaagcatagttctaatacttgagtgctaaaaagattggccaaagaacaatgaaataagcatttgcacagctattcctgctcaaaagaattccaaccttctgttctttcatcagcaggtcaaccttcttagagcaagaaagaggtttagcttccctaaaagtaaaaagctctgtcttctcaattttggaattagaatcacagaaagaagggggcaggtgagggaaaaattccacagaaacaacacttaaactttaaaactggattttaaaagattcttagcaataattaatcatttgttggggtctctagctaagacttagtaacttcatagttcaaagagtttcttttctagcctccaactaataaccacaaaattttttttctgcttatgtgttagtttctaaaatggatctccagcttttaactttaaaacaagtttcatttagtttgcatatttatagtatactacagtaaagaaattttagtctcttatgaatgaaaatatttagaggtgatacggtcatttaggtagtttctctttttttttctccaaagagagcacatatctacagtcccacactacataacgacattttaatcaatgacggaataactgtggtcccataagattctaatgaaactgaaaaattcctattgtctagtgatgtattgatgatcttgatcctgtataggtctaggctaatgtgtgtgtttttgtcttcatttttaacaaaaaagttttaaagataaaaaataatttttaaaaaaaggcttatagactaaggatataaagaaaatatttctgtacagctgtacaatctgttaagctaagtgttattacaaaagagtaaaaaagctaaaaaaaggttaataaaataaaatgtgacagtaagctgaggttaattattgaagacagatattttttgtaaatttaatgtagcctaagtatagtgttaatgtagtctgcatttgtgtacagtaatgtcctaggccttccctttcactcaccactcactcactgactcacccagagcaacttccagtcctgcaagctccattcgtggtaagtgccctacattggtgtaccacttttttatcttttatatttttactgtaccttgtgtatgtttagatacacaaataccatcgtgttataaatgcctacagtattcattaccataacatgctatacaagtttgtggtccaggagcaacaggttatgccatacagcctaggtgtgtagtaggctacacaccgtctatgtttgtgttgtacactctacaatgtttgcacaatgatgaaatcccatgactcatttctcagaacatacccctgttgttaagcgatacatgactgtactttttttaaaaagtccaaggatatagatcagtatttaataagcatcaaggatatatattggtactatatattttatatttaagtggaatacatatgtatatatttcacaaaatatatttcaatttgttttgagacccctatcccttcacttctaaaatagtgactctgtatctttaaacatgacaagtaaaacaccgttttcaaatttttgtgcaattgtttcaaatcttcactggacagcaaaactctcaaagcatatagtgagaatattagggattattaatcttgcagggtcaggaaaaaatatgaaaatgccacatatagttgtatcatctagacagctcttcattcagtttattctttcaaaacccaatagatgaagccaaaagaacttggtaccaaagaaaacactattttccctaggattccagttatgagattaaaaacaaaaacagagtaggctttctcacaggagttgccctgtgggcagttgttgcccatccttggataagtagggcaccaataacgaaacaggtgctcaggaagttcccagcccgtcttctgcctccataaggtcatgctgaaaaacatctaaaactaacagcctggtttcttggggtttagttttcctgttactgaattacaactcctccctttttaaaaagtatagagtttttcaaatgcctaaaggagatttattgatttattttttttttctggttgtgtgaaattgatgtttattcacaaggtatttgctctgtttgttgaaaacacttattttaaatgttgtcctaagggggaaaggccggtaaagtcggaagaaatgcttaaaagccactaatgtaagagcacatttttcctttaaaaagttaattaactaaggtttgctaaattcaaggcctcatagggaaatacaactgaaactctaaaatatttttttcatttgaagtgtttgttcactgttctcggagcacctgacgaagagtttccacttttaatacagttgaaccgaaagaaaatattattgtagtaaatttcctttaaaaaagcaatattgatgttcccgtatttttggaataaaaaagcacccttttttttttaaattattatactttaagttttagggtacatgtgcacaatgtgcaggttacatatgtatacatgtgacatgctggtgcgctgcacccactaactcgtcattgaacaatgaaaagcaccctatttttaaaatgcattatgtaaatagactcattccaaagctgaccataagcaatacctatagtaacttgaaagaggagaggaggaagcccactgagatacagttcctaagcatttaaagttgacttcctgctggcctgagatacaatttcccaaagcattttccttctcatacctaagatgtaactactcactgggcctagggttagcaacttttcagaaatgggggatgcccctcttctctcccacactctcaacagaaaacagaacatggagtatgcaaacatttaaacacattccccaagcattttacctctagggatccatccacctcactaatagatttcagtttataaatgcatgccttgctgcaaattacttaagcacaagtgttccccaaagtgcgattccctggtgacttggggtaccagaagagaagttttagaacgtggcattaaatatccttcaatataaagtcactggttttcaactatcttttcatcctctggtctagttaaggagaaagtctccatttgatgccagaatgtcgaacacttgctacacttgttaacctccattataacaaaagaaaagaggcctctgactcaggcttaccaacaggcaccaataatagctacctagaagttagtaagtcatattattgtcattatatgcatttgaatagtgatactttttacattcctttttaaatatatgtatttaagattaaaatcagagtcaatttaaaagaaaagattgtttcagatggactatatctttgagattcaaagtgagatcagtgggccagagccatcagcatcacctgggcatttgttaaaggtactggatctttgtcccctctcactcctactgaaccagaatccgcatttgaacaacatatcccatgccacttgtatgcatattaaaatctgagaaactatggggtgacacaagagttggtccaaaaccatgcaggtggtttacaaatggctgaactttgggactcgctgctttagatcagctggcgacctaactcctgatcctcgctgaaatcagctagtggaggtcaggaggaccaggaagtaacatggttcgtgtttacgcaacagggagtcacaacccatctgaggaccatgaggttgattaatgaatctaaaccagcagttttaggggtgtttctggtaagctagagatgactttaaatacgcttctgttcctgttgtgctacatatatcattcttttttactaataaaaactacagtaaaaattctacttagacttatccctttatcccctgcttccccttgaagggctggggttttcagcatgccttctgcatgggaatgagtgacaggcacctactaatttagcacgccctggccttcctctcagagctgagcccagttatatggaagaggcaacttggaaatgtgacagcccacgtctcctgtgtcaggggacagtacaggtggcaaaaaaaaaagcacaagctctcatcgcatcccattatgccctagaggagaagccagtgagtctctcattcaccaagatgattagtcaatgatccaggtagttcaatccaaaatcctagctctgcatcagctggaaggacatataaggggaaaacccaagttatcaggatcactgactcaagtttcaccttcatgacctcaagaatttgtctgaaatagaggaaaaaaatgaccaaaatatgcaggatttatgataccataaagaactaaagacacttagttacagccatctagatagttccagaatgcccagatttaacagatgttgacaaagggtatctatcctccccaccccacccaggtgttaggcctaacaccaccacagctatccatcagaaactcaacttcccagtacaaaatactaataggagacactttgattttgcaaagaaaatagtgaatgtaactgggtaaagaaaaaagggaaaattaacaacaaacaatagaagcgaattcatggtctggtatccacgataagaactgcgtgccactcattacaatgaaaagaacactgtgaacatttgttagatctttttttccttttaagttattttgagaatgcacttatgtaggcagaatattacagagaacaaaaaatatatgttacaatgtaagattattttaatgattctgaaagaagggaaaacaatcaaaataaattatgaggaaaacagtataataattgctaatacctattgactattccaagcagtttacacatattaactcctcaaatcctcaggattccgagatagacgttatcttaatactactattaataatattaatactactaaacgtgccattttgcagatgaaggggagacttaactgcaaggtgggcaagtaacgtctaaggtcacaagcttgggaacatagctgggtaaaaatccagacacactcaaagtctaaactccttaacagcagactttctgccctcccaccacaagggtaccagaatgcccaagttaggatgaatctttcaatactctctcactctgaaccagacgaagaattcttctaaaaggtcagtgacctatggagtctccagttaaagggctaggccacattgatacaactataccttaaaagagaactaacttttggcattaaatgcatcatccatgattagattacttacttggcagaattaaatgttaaggctgcttggggggaaatatcaacagttggaggaaatttttgttggaagcacaacattatgctttgagaaatgcttaagtcaagtattcctcttttattaggactacttaattgagtacaatgcattaaaatagctggcctgaatatttattagagcaccagctgttccctccagatttttagaaattcaagccttagtgccaagtgtaatttagaaaaattttccaacaagtaaaaagagccctatgccttctaatacttatcaaaatagtaaatagtagctggaagtggtatagaacatcacttttcccttccaatgaagagagccaaaatgttttgccatttgtagatgttttgccatccacaaaaacaccattttgtaattgggcttagtgattatattacttaaaaattataccttgtgattcataactaacaatcctctatgtacatatggataatatcacagtgctaaccattgggtttgcataccattctggtttggttttgtttggttggcttttctgttttgttttgtttaaaaaaaaaaaaaaggagtggtgttagacccagtaaaacagctcagagaaataatacagagttttattcaaaatgttatttttcaagatttctactttaggaacccagccgtaatcaaagatctaactttcaaagggggtgaaggaaaaaagaaagttaagaaaataacaggaaaacactaggcataacccggatattccacattgaagctttctaaagaacactggcaaatatcatgtctgggtcttctgtatttgctttattgtcaactgtctttgtgacagtgctgcaagtttggatatgggaaaagaaatgtcccctccacagcattacagcagagggaattcaatgaacctgtcatgcagaccttgacgcagaaagcaactcccctcctacaaactgagcatagtcagggctggaggccaacgagaaagccccagaaaagggaggctgaaaggaacagcaacagtggatggggaggctgattttttttgaaggagaaggtggtctgcccttgttaagtgtctgtagttagagctactcaactgcactgacacacgcagagtggtccaggacaagcagggcaaaggaaccagaagtctagctcttcactgtgcctatcgaataaatggctagcttctagccctatatgatgctaactgctagcaaactagttgcagcaccagaggttctctttcaagagatttttctcattttgtttttagggctttcaggtttaaaaataaactggcgtttttggattaataaaaaattccatgagggataaaataggccaccttttttttctcgtaagcaaagaacactagcttcatgtgctggtgaaatggtcaccgctctacaccacccacgcccagctctcccacacatcccctccagggagcaacgggaaggagaggccacatcttcccaagaaaaacaagctaaagcttctcaaactcagctgggcatcacaatgacctgcaggaagttttgatttttttcttaacagaaattccaggaccccatcctggatggacctactgaaccagatctcccagtgggaagactgaaatttccttactaatcaggctgccacactacatgcataaaggggtgaaatatcaactaatcctacagaagtgacccctagttagtgagagggacttcccatgcatggagagattccaagagataaaaacccacacgaggagtaatttttttaaaaatgtactttggccatcaagattcaaagacatctaaaggctagaatactggttcttttctttcttaagtggtgggaccccttttttcaagcaaaatctttcttagtatcccaaaatatcaaactaataaccaagcttttctggaggaaagagaggtactgctcagtccacaccccaccagcacagacccacccacccacatacgcctcaaggaggcctaggattgctggtagcaggtttgaaatccaatgggccagaataagacatttaaatgggagaaataaacagaactaaatctaaattcaaataattaactggagggttagggcttctgattagcatatagcttagggggatggtttaatagagttcacttgaaaaagtgaaggttttatttcactaaaaagtcaatccaagccaaagtgttcgttggctgccagggaaagcaagtgcagtttagcctgggttaataactagtatttgtatttagagatttaccatttatgaagcacgttgatatgcatgatctcacataatactggataacaactttgcagaaaattattttcctggtttttttagatgagcaactgaggaactaatctgtgaaagtaacttactcaaagtcaattccagacagtagcagaggcttctgccaccaggcacagcacagcctagggactgaagggagagttcaagagcctgctgctcttcggatggttagaaaagcctgtgaacaacgtgtttcattctggttgctgcattaatagaggtgtgtccaaatgggaccctaggcagagcaccgtgaccagggcaaagaacaatctggaaacagtatatgtagacctaacactctaaaaccgaaccctgacatgctcttcaacatctcaaaagttactccacatctctgtactccaatttcttcatctgtcacaaagatataatatgtttggaagactctttgagatgcttacaagaaaaacatcattagtgtaaacacatggaggaactaggagcttttaaaggtggaaaacagaatgtttaggaatgacataatggctatttttaaataatgaaggaccatggggaaggaagataagtcttattttacatcattcaagagtagccgaggctcttcgccttctccttcctgaaaattcaaagccattaggtaggtccaatctggtaggcttcctacgtttacaaaaacgtaggaagagggatgctgtggaagcccagagcagggtatctcagggagaaaggtatccatatggggatgggggtggtggcacaggatgctagagcactaacagctgaggagggcagccccaggaggaaaggtggtggcagctgcagaagattggttacatatggggagatttaccaaataagtaaactgttaagaataatgcgaaccaagaatctcactgtcaaataaagcagttataaaatatggagaggaaaaactaaaccctgtggtatcagacaggaatttaaggtatgactgtaaactcatggttttaaaagtacatagatacagaattacagatgtacatgtgtgtctgtatatacacagagtagcaacaccctaatagcaatgagcacaccaagcaaccagatcttggcttctaaattccattctccattcaatagctccttggagaaatgtctgatacaaaagatgacacaggtaaatcacaaaatgagtttggaacatcttattctgccagagagcaagatggtgctcaaagactgatgggagttaaaagagcacaggagccaatgtgaaaagactgcactggccaaacctagggccattttaaataaagtaatgacagtaacattaaaccacactgaaaaaaggaagacactaagttcttactgatataaataaataacagattgaaaatttgatgaggaataggctatttacatggtttcaatgtaatttgccataaaacatttataaattacaaatgagaaaagagtaactatatggtagagaagcctggcagacaacaccttgatcaagtgaccatcatcagtaatgggacaaacagaaatcaatgccaccctgatagggtacaatgagaacgcagcaccatttctgtactattcctaccaaagatgcacagcctgaatctaagcttgtgaaaatggcacaaacacaaactgagggacattctgcaaaataactggcttataattgtcaaaagtatcaagagcatgatagtgaaggactgaaagagactaaaaacatgtaactaaatacaaagtgtggttctgacctgaattcttttgctttaaaacattatgggagcaactgggaaacttggatgaaatctaaggattaaatggtgttaatgtatcattggtaatttcctggctttcatggttgtactgtggtgatctaggagaatagtccagtttacagaaaatacatactcaactgtttgtgtgatagccaacatgctggcaactttgtctcaaacaggataaaaacaggttctctatactacttgcaattttcctattggtttaatgtttccaaataaaaattttaaatgaacagtaaattaggaggatggaaatgatggggagacagataacatctagtttgaacagatgaaactctacaattaaagtggtccaaaaacagatccatgcttagaaaggtaggcacgatacaatggagaatgcttcactgactaggaagttagaggagatgattcctacgtactttctgatgattttgtaattctttccttcaacatacttttttttttttttttttttttttttgagacagggtcttgttctgtcaccctggagtgcagttgcagcctcaacctcccaggctcaagtgatcctcccacctcagcctcccaagtggctgggactacaggcacgcatcaccacacccagctaatttttaatttttaatttttttttgtagagatagggtctcactatgttacccaggctggtctcaaactcttgggcacaagccatcctccagcctcagcctcctaaagtgttgggattacaggtgtaagcccccaagcctggcccaaacgtttatcaaaacatctactgtgtttcagacaatgcgcaagacactgggcttatgaaagtgagacagcccccacacttgaagcccttataatccagtggagtatgatttatttggaagttagaaattttaagacagtcatcagtattacacacagaaacaaacatgtgattcaagaatgctgtctacaatactccaattttcatttatgaattttcaataggctacaattattccaccatattcttgaagaacattttcatcctaacttttttgtgcttgtgggtggtgttaattgtggcatatgcaaaaactttatcacttttcgattatgaacagatgtaaatgacttacttgatgttttattttagaataacaagcatcttctaaaataagtctccacccaaaaagctggggctatcattacggaagagacttaacactctgaaactgaaccttgacatgctcttcaacacctcaaaagttactccacatctctgtactccaatttcttcatctgtcacaaagatataatattcttggaagactctttggggtgcttacaagaaaaacatcattagtgaaaagttctgttaaaaatgcagattgctttcaccttttgccagggactacctattactgtggacattaaaacaaagtgacccatctaaatgagtgcaacattttggcaagtttatggtggttgaaacatgatttggttttccaacttctccccacttggcttcatttcaatctgcggagtatatcaagtgagaatgcttctgcgccttcatactgccccacagagggagtggccacactaagcaagcctatattcaattactttccccactttatacctttcttacacttttcccatatgacactttcataaccatatttagctttcttcctaccatctccctgtaattcaaaacgcaatttagattcccatatggttgccatcgaagctaacagatgtctagcaaattaaaacaaaaattatgacttataaactgctgatgtatcatcattccagaacatcttgcaatttatagtgaatcataagataaagcttcctacttgatgccccccctcccccaccgccccaaggtttcctgagtctccctcctctctgaattaagccctgtggaagcaaattagaggcaagatcctgccatcaaccctggataaacttgcacttaaagacacaaggtaatatctgaaagcatatcaaaagagaaagttggcctcaagtaactgaggcttttctaatcctttgtagcaaagaaaacagaaaaatgacttggttctcccaaatcattccaccgtttccattgagttctttcctaacaagtcactataaaatctattgaatccatttgcctcatcttcttggcagatcttaagggtattatcattacctagtagtaatgatgccaaagtactagactaaggcattctagaagttctatagccctgtatggaaccagtataaaatctggagacaacaacagtaatgatattcactatttgttaaatattgagatattatgccgaataaaacattatctcactgaatctttaaaactacaacaccattaatgttatctttcctttataaacaagaaattaaggctcagtgccttaatacagtagactatatttttcaaagatggccacaacctacatgactttctgcaatgtgaccttgacacttctccatcaaaaggtggcttctaattcttcaccctttgaaattcagcagtctgcatgagtgctctaaccaatggaatagataaaagtggcactgccagttctaagtggaaccttaactggctggaagcttctttaagacttagagacaggaagaagccacgtgtaggtaggtgctccagtgacaactctggctaagctcccagcaagcatcagcttccagtcatatgagtataccatctcaggcatcctgcccagagggccttccggtaagtccaactccaactacatctcaccacaactgtatgagaccccaagtgagaactgtccagatgagcctggccaaatcacagaactgtgaactataataataaacaactgtgttttaaacaactaagcttggaggttatgtagcaataaataaccagaatattgagatcaatttacttgcctgggaacagttaagtatccagaatccaaaacagttaaaagccagaatccaaaagggcaaaacatctattaatgatgagtgatgggatgtggtgttcggtaccccaaagaaatgactttaaaacaaaatcctctttcttctccctcccccaaacccaaagcagtctcagggttttctgagaaatgtcccagtacggtgacaccctcaataaaatcaattcccttctgtcttgaattgttccaatatataacagaggaaacaagttttcccccaccagcctgtgataactaatgagaaaggaatctgtacaagatgttgactttgttactcagaatgtcattacaactgttatataaaaggattcagattttatacatgaagctgtaattctaataataaaaatatatttaatgactcacaggactacatttgagattcacagtggggagagagaagcacggacactataccaggaactgaacaagccaagaagaaattagtgaaaggttttttgttttgctttgttttgttttttttgagacggagtcttgctctgttgccaggctggagtacagtggtgtgatcttgcctcactgcaatctccacctcccgggttcaagtgattcccctgcctcagcctcccgagtagctgggactacaggcacccgccaacacacctggctagttttttgtatttcagtagggacagagtttcaccatgttggccaggatggtcttgatttcctgaacttgtgatccgtccacctcagcctcccaaagtgctgggatcgcaggcgtgagccaccgcgcccagccttggtttttttttgtttttgttttttgttttttgtttgtttgttttttatgaaaggatctttgaggaagaaatgaaagtaataaaactagtcttcagacaagtctccctaacagaaaatgtctataatttatcacgtgtcctggtatatactacttctgttataaattagtggccaaactcttctatttttcttctccagcatattggaactcaagaaactcattctgtgtaagaactagaaagaacgttataactcatccacctccttcaatttaacagctgagaaactgaggcccaggcagttaactgatgaagagccaaactgctgatcaggaaaagaaccaagctctcagtgctggtgccaccatatgttcaattttattttaccagaactatacctttgaatgtcaccagtgtatgtcaaatgtagtctagcagttcagtgtgaaaatgaaaattaggaaaccatgctgttggcaatctcttcttcataattgtatgggagtagcaccgagtctgctgtttttggcaatcacagacaggttggtgactctgtagagagcagaggtgtgtaacttttcagaagcaagctgccaagctactgaccccagcttttcagtcactaacatcttagtctgaattactttaaccaaaaccatatggttgcctttctgttgatcatcactagagaccatggtacaataaagcaggaaatttaaatatggggtaattttgaggcagagagcaggataggaaaggtatgagggagtatctgagaggaaggctttgggcacagagaggagaggaagggaaggcaagaggcagggtaagtgaagggccctcataaggaaggcactcacttaacaattctgcctggggcagctagtttagtcccatagcctaggtctcctttcaggcttcccatactcacccacccacctatgaagaccttcacaatcagaaaacatgcggctctgttctggacctctccaagcaagcactctgcaattctttgaagctctctacaattccaggggttttgctgcaacctaatccatagaaagggctaaatttgtctctatgcactccacagaattacagcaaactgtcagggaaacagacccaaatccttttatttccttaccaccccctgctaggaaacggcagagaaagtccctgggtgctttttgttgctgggtagctaaaatgtgcaacttttagaaatgttcaagtagaaacaagaggcctgaactcactaccccaaaaagaaccagtcccagttcggtagtccgtgcctctccaagtcacaaagtttcaagttccaatcaaatcagaatatcttactcaaaaccgtggctacccaccacttttaaacattttcacaaatggagaaggggcaaagaaagaaaataattccttcttcctgtacttgtagcagtgtttaattgcagggaggtgggtgactgctcccgggaatcatgcacaacactggcaaaaaactgcctgtggaatgatcggatatgacatccattcatgtgtcccctcattatctttattagtcctgaagacagatgacatgctgacacggaaagtggtctccaatcccttgcatttcccctcacaaaacatacatgaccaatgcaaggtattataatagaaaacagaaaataaaataacctggtaagagtgcggtacaaaaaaagaatatgaagagccgtattgacaactattctcacagatgtatatacgtacagcaaacagcccaaattaaaggagaattcaaataaatacattccgtgttcagactgctgtggataattattgatcctgcagttggagcattgtttacctcacactgaacagcaacttagagaaccccctacccagacagccaccatctttactttctatggaaatgcgggtgcccactgaggaagaggatgagatgggatgagaaggggaagaaaaataacatggtctttgaaccaacgttttccccttgtcctggagaactctttgtctggctgctgaacacgtttgccagatcaaggaaaagaatcaaaacaaacaaacaaacaaaaagagtaggcgtcccagcctaattacaataggttcccaacacattgcagtcccaagcagagcatcatttgaatcttgtgttaaagcatttgctctctcggttccccaataaaacatgcctcgcacaccttctcctttgcatttctacaaaggttcccccaaacggcccgctctgtgtcactcctttaaaaatgaggacgtggggcaggaacacactgaaatatatgttgacggtgacttattatcctgacgatgatatatacatacaaataaatccctctaccccgcacccccactgaccagtccattacgcacagggagcgctttccagctgaagaggagagcgtgcaggaaacgttatttacgtgcaattacaggaccatataccacggcatctgcatcctacacaaagcccgagatggtgcaagaagatacacgctgagcatggcacagaccagccgcggcaacacggagccaagccctcgtccaatcagatcgttgttagaaggtggacctcagggtcggccgtgcccgattagccttccctattatgacaccacgctctgcccaacatctatatcccaccgagagcaaatccaattcgtgtggttgctcatttctcaaactgccgaaccctttcttttatctgcatccctgctattcgttcctcaaaaagccaccagaaggcctcggtgccccctttccgcctcgatttctcttttcacctcttcccattcctcgaaaggattaaatgtttatctctccaacgcgcaagctggaaaggcggaaggcgaatgcctctatgctgctccggcaagcgcctgcggggctgcgaaaagtaaaggcaacgaacaacgtgggggaaatcgtcgcgaatcgatcggccacaatagttggaatcccaggagcgctccaacttacccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccgcccgttcgcgcgcgccctcccacccctcgctccgcccgcctctcgctccgcccgcccggccggctgctcctccgcccgcgccgcccgcagctccgcccgccgcccaagccttggctaggcgcgcgcgcgcacggggtcgggcgctcccgggcggcggtggcaccacgtagccgcctccttccaccgctcgctttatccccgccccttctcgggccaaccccaagcgccgctgaccccgaacgtcgctgcggggtaggtagggggtgggagggtggaggaccgcaggcgagagggagaaggaagggcgcccggggagcaggctggcagagtgaccgggattgatgagcggcgcagctctggagggacgcgggcgagagggtcgctcctcggggagagggctgggtgagtgaggacctgcgagccacccccgacaccccttccagggtagccacactggcgccccctcctccacaacaggcttatgtggctagagaagatgcgatgccactggacagggaaggaaagtcgtcgtggacttcgctgaatggaaaagggggtagttggggaaggtggagaaaagagccacgggaagtgggaggaaaggatgaagggatgggacgttgaaaaggaaagcttcctgaatccctgtgtgactctaacccaacctccccacctaccggagaaatgggttttatcctagaaatggggacgaggaaaaagagatggctcaagggagtcctggcccgggatgcgatcctcgccctagggtctattgcaaccacacaaacccggacagcgcacgctcccccctaccccgacagaatagtgcctaagaaacctgcttgcctcctaactctaggaaggaatccacaacggattccagggaggtcttctggggaatctgaattgggtttttggatcacgaaccattaagcttttgaactctggggaagaatagaacaggtggctggaaattgttttagaaccctacctgagcaggtgtgctcattagttgcttatccgccctcctcctggagcactttcataggtgttggcaaagcaggtaccagtatttcacggaaggagaaggaagaaccgcccaggactgtgtataaatgtctatgggaatatttttaaggattcaaaaggctagaaggaggtgagatcaaaaaatttttccagcaccacccagtgcaacccgatcctggacacagaaatctaaaagatgatacttaaatacttgagtttgagagcctctagttataaggtttcctacgtaacaacctctcacttttctcaaaaactggctagttgacaaccggcagtcaagttttggctagtcaagaagctactttttcctgcaataaaccacatttagagatagtactgggcttcagcaggattgaggctatattgaggtcgcaagtatgaacgaggtacccacagagatgggagggccaggagatcctactcattcagtacctcagaagctatgacacgggataacagtagcttcagccctttggatgaaataatcctcactccctcaaaagtgctctctacccactcaaaacacaggccatactaccaccaatctggtagacttcaaaagtaaggtctttcagcagcagatttccttgttaacaggaaggtactgacaagctttacctaagcctattggagctatgttgtaattctgtatataaatagaacagtcgctgcaggaatactggatgagtcagaagaaaggtctgtcctaagctgatgtgacacatttcaaaaggaccagaaattagatgcaattgatgactgagttgatctctaagtggatttatctttgaaataaaaatcagtggatatcccatatacccgaccccacaccctcccccattgtcaacatccccaaccaaagtagcacatttgctacaaatagtgaacctacattgccagatcattatcacccaaagtccatagtttacattagggttcactcttggggctgtatattctatagggttggacaaatatagaataacatgaacccaccctcatagtatcatagtatcatacagagtattttcactgccctaaaagtcctctgtacaccacctatttatcccttcctccccccagtctctggcagccactgaagtttgactgtatccctgtctccttagttttgccttttccggaatgccatatataaggaatcatacagtatgcagtctttctttcaattttgctgtgaaactaaaactgctaagaaaataaagtcttaaaaagaaaaatcaatggagaagggaaaggtaagataactaatcagtaatttggaggggggggtggaaaaactaattgaattatctcatttcgtatatccaaaataagttctatgaggattaaggagttaaatatattttaaagcagaccagaaggaaaaatatttgtcaaacctctgtatagaagtatttctcaacttagaggcaatagaaggaaataatcaatggatatgattgggtaatatcttaaacacttctacgtgtccagctttttttagtgtaagctaaaccagaaaaaaaattggcagcaaacatgaaaaataaaaacctgaatgtctatattataagtagggctcatagagctatagtaaaatatagaatcgcagtggttgagtataaacagaaaataaatcatataagaaataaaatatatggggaaattaatctagtaataaatgaagtatacattaaaactaataaagatacaaaaataatgagcactggttagcacatacattgttggtgtccttatgaaataatatgtccatttggaaagcattttggctgtatatatcaggtcagagtgctcctacattttgactcagcagtccctcttctgggaatctacccaaagaaataccccagcagatggaaaaagttatacactgcaagatgtatatcatagcattatttatattgaagacttggccagaaattaaagatcaaagagtaggggtgatatccaattccttgtagttacttggaccacaatgttccttcacattctgtgcctctgcacatgtcatttagagtttctgcctggggcattctccttgtctcttgtctgtgagctgatttctcttattcttcactacttttgttcaatgtctcggaggctccttctttattccctcaacacccgctgtgttcttccatcccggcacttaaaggctgcctgtaagaacttgtttacctacctgtctcctcaatctgctgtgactccttctagggtgtgacctaacccttggtaatcttagaatcaccagagctctgcagatatggcaggtgcttgataaatatttattaaaggaatgaatgagtcatttgctcacagtttttacagctcttgaagatactgcttatagagtatgtggcaatatatggatacattataatgttaaattttaaaggcactatatatggaattatctccaagtaatattgttaaattttaaaaacaaggaacaaaaacagtgtacacagtaggctatcattttgtgaaaagataagctctgttggcaaaagaatatccatacacatatttccttgttaatgggtaggctatctatggaagaaaacgaaataaactggtaacagcgagttagggtggaatggggggcaaactgggggactaaagatactgataggaaggagacatgttttatttttaaataacccctttagtctgtttttgaaatttgtaccatgtatatgatacacgttttgaaaaataaagcagtctacaaaacggtatgcagttgtatgaaaaaaagttaggagttaatttttgccaaataagaacagttataaggctgggtgattttgttttcatgtttctggtttgcaatttttaagtgtggttaaattgcttttacaattaagaagataaaattatacataaagatgtaagaaagtaactaagtaatcatatttatttcacgcaactccttcacaactcaataaatgctgatctattttaaggagaaaaggagaaaaattttctgtctgaatactgctaaggccacctcccttataactctgaggttgaaaaatggttaataagtttaactactgacaagttaatcagctcttcaagtggcagtgaaaacaggtaaagcgtgttcttctaatagttgcctggctgaggagcaagatatgacaacagcgttttaacctaagacaccaaacttaacgagcttgtctgtctccacctgtgctttattgttcctgcccaccttcctgcctccctcctcttgggctctgtcattgtctgcctctctgctcctctctgtttttcttttgcttctctgtagccgccctgctggttgcctccacacccctcctgccgccttcctctcagaaccctagcagctgtgttcagcgtccccctcttaaagcagccacatgctctgggaagactggccctctgcgtcacatctggcagtcccattcctcttgctaatgtgtggttcaggaatgggcaggtggcccaattctggtcaacaagccatgagaagaatctgctagaggtttccttgcatctaagaaatggtctctttcgcccttggacttggttgggtttggatgtgatgcctcgatcctctacagcctgatgacaaagaccacaccaaggatggcagagtggaaggataaaaagaaccagggccttccagcctttgttgtatggctgacttaaccaaccttgaaggtggccttactcacgacttcctgtcagatgagacaaatttcttggttaagatactttgacaggggttttccgtttcatacaactgaaagtatcctgacttaaacaccttttgaggttctgccccaagcctttattgattttctcctcttgaatcaccaccagcatttctgcatttctcttagtaccacgttttttctattccccacacccaccaccccctctcttccctagctgtttctgtctcaaacaatacagggaaacattttagggtgtctgacagatcacacccacccctttctcagaccttctcaaccacaaggtgctctcccacctccagcgaggtttgtacttcacagttgatggggtcccggtagattcaggctgggccaacctgagagtctgtctcagtaacaaagggaaccctgcgcccagctgaagtgcaggcaatgtttacccgaaagctgggggtgggtccgcatttccaggaggaagccaagactctccctcatcctctgcagaaagaggaaggaagcctaaacagagaaaaacagtagcagagtctgacagcctgggtgctgtgtatggttgtgcattttgtgctctgaaaggctcccatccctgctaaaggcctgcttctagatttaaagaggactctgtctttgaggtctatgagatttttagatggaatcattcatcacatcccatttgggctttagatactttgaagtgagtatctcaaattttcaaatcaaagaaccctgattaaaacaaaaggtcttctcacctcaaatcctttatgaaatgaggtcaacttaaaatactttttagttagctatgatataaaattaaactatatttttgttatagttaatgaattaatattgtatcttctgttccttagtcgaaaagtgagcagttaaatggtctatttctctaacaaaacaattaactgattcctcaggatttaccgcccactgtgaccctcttgccctgtgcccacacatacctactaaagaccagttttcagatccccaggaataacataaaatggggcatatctgtctcgtaaatatgattgaataagcatatgtagagcacagttgtttcacttttaagaatcaattataatcatttgtacaataaaatgaattatgtctttcacacaatatgacagagcagtaattgatttttttttttaattcggccattccatcttcttctggcacctcaacttcctgctgctttggagatagctagacctgtgtggatcaaggcattaggccctgatgttaccttaccaggggccaagcacatgacacaagttcagccaattagaagcttacttcctgatactgagcagagcaaagaaagagaccaaaagccacctggagttcatttcttgcagcccctggacaagcctgaagctgcccttgagacctttgggagcctcctgattcttctgccttccctctggtcccataagctagctgtcaggttctaactgatgtccgagttcccataagctagctgccaggttctaattgagatccaacgggaatcagtggatgagtggtgggtagctggaaaaacactaaaggaatcatagacagttttgacatggctttaccctctctttgggtgtgagcaagccatatgtacagcattagcagggtaattataccttttacagacagtagtggctccaagcccagcacaagctcacatgggtgatcacctaatgtgcctcacatggcttggttacataatgtgcggagctatgcgcctgcgctccaaacccattgagttatgctgtgccggaagcctgcctcagcctactcctgactaaagcacagccatttcccttacactccaccccctaggcctagggcatcctccaggcaggcacatgtgcccatagggcagagccctgaatccataacccacaacaacaatacagaaagcaacacctcactactaggatcccagctatgccacttatgactattagggcccagtgtaggccagagcctagggatgcccaccatctccacaggggatcatcagtaaggctctcaactgcgttaatctgccatgagaccccttgcagggctgctgttatgttctaccgattgtcaggaataaaggtacaacattgtgttcctaaaagtgcacaggtgcctccttgggcagcagtttctatgtctaaggctatttgattttgcaataccacctttctaatctgatcaacctcattggttaacaggaggggggccactcaagtgtaattcagagcccaagtggtgtgctgtgcaagagtggtaacttgtgcttctacggttatgacacccactccagggatagtcactgccaagaggcagaaccaccaggggactcgtcgcacttgcacaaaccgagaacatagcacctcccagttaagtgagctatctgggcaacttggggagaacattggcaggtaaggccacccccaggtgcaatgtccagtccagttcactggtagctaaggccaccctgtgtccccacagacccataaactcccaggggacacaaaatccattggggcccaaccttggtgaggccgctcgttccatcataccttcagtgtggtgacatgtattatgtttgcacaggccatgatgggtacccatcccacaggggtgttgccccaatgtggctctatgtaccacagtacctgggcttggggtactgcatgttcccccgctagccagccccacccatcataaacactacaggccagccagggggcgggtgtgctgtgggtcttacagcatcctttttcaaagcttgccatgttgcctcacagacatcagccatgggaccccaggtctccagccatgtccagttctctgcagatactgaatgtatgtgccaaggcaagccatctgcagctgctgttggaagggcagtgcagatccaacagatggaaacttggtcacctcagcgtaggtgtgggcccagtccaaatgcagttagagcatgttaacctacagttgaaatgacagagcaggtacaggtactaacagaggtaaatcatatccctcaggcaaaatacaggctaatctttcatccctggataacaatgcagccaccaagggcttttgctctgggtgatggtaccacacctcaactccccatggttcctttgagtcctgtatctgtgccaaagtcacaggagagctcataataggccaaacagacagtacacatgtcccccagaggagagttccttccctggctgttcccgctgtaggggccatgtattgaacacccaaggagtgatatacgagtcatactgtaggccctccccccagggagctccgatggccaaccaccagcagtggggggcttggagggtccatggccacagccaggttttctgttcccctgccatcaggggtgttggggcagacaacaacaggttacctttcatccccatacctggttgaaggaggtcatccttggtatgtatctgcaactgcatgggggtggtggcttagtgtaacaaagcctccaccagggctgggccacctttccatggctgttcattcaaggtttggagcgccaggtccagcctggaactccagccccgcaaagacggtggtataacatgcaagcgtaacccatttttcaacagtccgttatattgctcagtcatacccgcagcttgtggtttgtatggcacgtggaatccccactttatgtccatttgttgtgtccattgttgtacctgttgtccagtgaaatgtgttcccctatcactctcaatggacagagggcaaccatacagggcatgtaagtgttgcaatgccccgatgatgtgctgttggtcagccaccctgcaagggtaggcaaacaacaggcctgtgtccttgtccatagctgttaatgaatgcatatactcttgtgacttcagcagcagcctgatgtagtctaccagccatctggtcaagggcactgaagcctccaccttctgggctcaagcaattctcctgtctcggcctcccaagtcctgggattacaggcctgtgccaccatacccggctaattttgtatttttagtagagatggggtttcaccatgttgaccaggctggtctcgaactcctgacctcaggtgatccacccgccttggcctcccaaagtgctgggattacaggcgtgagccaccatgcctggcctgtttcattcttgtagggcaaaagtacttgcatgttcccttacattcctacctccaaacaatttcagaatgccatgccccagtccacaaactccacccttccatctgtcaccaaaatctaagtattttgcagagttaagcataattcaaccccttatgaaatctgccccatttaacactgggcatgctaatcatatccaataatttctcctgtcaccgtttggtttcttttaccttctaaaagctttacttctgtgatatatgcctttctgatggaactataattactggaacattgaatttaatgtccagaaacaggaatagatattagcagattaatcagatattcatttaggttttattataaagaatcaattgattcaacaacaaaaacttacacatcttacacaaaaaaacacatctcctgttaatgcacctgtttccatggttcctgccctaagattgtacctggaaaaaagtagacaaacaggagtaagaacatgggttagaatggtttcagtgctatagttccaacaaagtgtgatatgtgtatgataaatattcaaaatgggattgtgaaaaaacacctcttccaatttattcttttctatttttttcatttttcttttctgtactagtagcatttactaaatgcagttagtaggaataacaattagttaaattaaccaagtcttaatgccttatatctgaatcatttatttgaatgacatcaagactgagagaataagttttaaaatttaaacacagtggtgcatccgctgtggaaaacagtttggtggttccttacagtattaaccacagaattactatatgatccagcaattctgctcctaggtctataccccaaagaattgaaggcagggatccaaacagatacttgtgtaccaatgctcatagcagcacaatagccaaaaggtggaaagaacccaagtggccatcaacatatttcacatttt

SEQ ID NO: 1336 - DNA, 28981 bp, Homo sapiens
gctcactgatgtctcacacccctgggctcaagtgatccttctgtgctagctctccaagcagctaggactatggacatgcaccactatgcctggctaattttattttattatttatttattattggtttttttttttgagatagagtctcactcttgttgcccaggctggagtgcaatggtgtgatatcggctcactgcagcctccacctcccgggttcaagcaattctcctgcctcagcctcccgagtagctaggattacaggcatgcgccaccatgcctggctaattttgtatttttagtaaagatgggttttctccatgttggtcaagagctggtctcgaactcccgacctcaggtgatctgcccatctcggcctctcaaagtgctgggattacaggcgtgagccacggtgcccagccaattttatttttttaattttactttatttttattttattattattattattattattattacttgagacagagtctcactctgtcgcccaggctgaattgcaacggtgtgatctcggcttactgcaacctccgcctccaaggttcaagcgactctcctgcctcagccttccgagtagttgggaatacaggtgcccaccaccatgcccagctagtttttgtatttttagtagagatggggtttcgacatgttgatcaggctggtgtcaaacttctgacctcaggtgatccactgcctcggcctcccaaagggctgggattacaggcatgagccactgtgtccaacagttttatttttttatagagacagtgtcttgatatgttgttgcccaggcttatatataatatttgctgagcatggtgggttatgcctataatcccagcactttgggaggctgaggtgggagaatcacttgaggtttggagtttgagaccagtttggacaacacagcaagacactgtctccaaaaaaaaaaaaaaattaactggacatggtggcccttgcctgtagtcccagctaactggggaggatgaggtgagaagattgcttgagcccaggagttcaaggctgcagtgagcttgaacacactgcactgtactctagcctggatgacagagtgggaccctgcctctaaaaaaaaaaaaaaaaagctacaggggtccgaagtttgtttaaagcttttaaaaaggcatttgtggccgggcgcggtggctcacgcctgtaatcccagcactttgggaggccaaggcgggcggatcacctgagaggtcaggagttcgagaccaccctgactaacatggtaagaccctgtctctactaaaaatacaaaaaaattagccgtgcctggtggcatgcacctgtagtcccagctactagggaggctgaagcaggaaaatcgcttgaacctgggaggcagaggctgcagtgagccgagatagcgccattgcactccaacctgggcaacaagagagaaacatctcaaaaaaaaaaaaaattatttgtgtctggatgtggtggctcacacctatgatcccaacactttgggaagctgaggagggaggattacttgagaacaggagtttgagaccagcctgggcaacatggtaagacccccatctctacaaaaagttttaaaataaattagccagacatggcggttcgcacctgtagtttcagttactggggaggctgaggcaggacgatcgctgtagcccaggagttcaaggctgcagggtgctacgatcatgccactggactctagcctgggtgacagagggagactatctcaagaaaacaaaacaaaataaacaaacaaaaaaagtgtttgttggagaagctgacatttcctccttggaactgatttcttctggaatgggtcaagaatgttcgttcccttctgaatgtccctgttattgttcttctgtcttgataaacactgtcaaggaagatcagattttctctggcctggagccaggttagtggaaaaatcctttgccttgggccccctgctctggttcactggggcagtcctctgatcactgactgggatcaattacctctgcggtagcccctaaagggaaatgcagaattgctgaactctggaagggaaggagaggtttggtgagccatcattatagacactgtgctagtggcattgcactgcacatgctatctttttgcttctttttttttttttttttttgaggcagagtcttgctcttgtcacccaggctggagtgcaatggcatgatctcagctcactgcaatctctgtctcccgggttcaagcaattctcctgcctcagcctcctgagtagctgggattataggcaactgccaccacgcctgtttattattttgtatttttagtagagacagggtttcgccatgttggccaggctggtctttaactcctgaccttgtgatctgcccgcctcggcctcccaaagtgctgggattacaggcgtgagccaccacgcccggcctctttttgcttcttaccagcaccatctgagctaagcatcagcacctgcaaactccacagaggtgaaaagtttccctgaggggcctgtaactagtaacccagaactttctgaatcagagcccaggatcacagtattccagacttcagggattttagtgctttctgccacccagggacctgggaacaagtgttatccagcaatacattttcataactgcattttgtttccctgtgagctaggcctggcatggttgatctcagtctctagaaactggagtcagatattcaagacattacaaggagatggctggtggggcatcatggctcctaggactttgggaggttgaggtgggaggatcgcctgagcccaggagtttgagaccagcctgggcaacatggtgagaactcgtctctatttaaaaaaaaaaaaaaaaaaaaaaaggctgccctttctagatcaggaggtccagcctctggaaacctcggagggctgcttgatctttcttttctaattcctgacaagttagaagacctttggcttctgagaaccctattactttaagtttaagctcttgtttgggaagccactgggaggacagtgaagaatgcccgcctacctggggaaacctgagttaggtgtggctggagcgactcgagatgcgaggtgggcgggggcaggctgaaagttggagcaagcaggaagtgaactgagggccaccctgggaggaagccgactaggcgaattcacttactgaccggcctgggctgctctgagacatggtgagccaactgggaactaggaaagggctggtttaaagaggagccagagggggcttgggactgggggttggctgtgtcgggggaggagagttggtggcaaagttagagggctgggccagtgctgctatggcctctcttctttgacaacttggctgcaaatagctctgagctgtcctggcaggtgtttctactccttctccctccctcccctgacctctgtgctggtggggagctgggcttccgtgccagcgccgatgggggctccgaattccaggcaaagagttgttgtgccttcctcctccagggagcccgaggcgggtgttgtgacaccacaccaggcagcgcctgggcagttcccagttcagattccagcccagcggcagaagctctcctctccggcctttcactttatccccacacagaaacacaaaggatttgtgtgtccactgagtcctttgggtgtcctttctccattaacatggagaagagaactaaaggtttataagagaaccagaagttggttctctgtgataatgtagttctgacccatgccactggcctatttttggaggtcaagcggggaggagctaaatactatttttctctccttgttcaaaaaccttgtcatgaagcctccgagatgagacatcagccagggaggactagtcctccatttcccccaacacccaggcgggtatttttatttaatatctgcataagcaggcggttgcttggtgcctgcacgtgtcgcccagtggtggggaaagcagaagtgtgtggctcaacggctccaggcgccttctgggatacttggttgcctgttgttctgggtcacagcaatggcattgcggccagggccgtgctccggcagctggcttagagggacagatgggtggggctgggtgagggtgttctgctggccagcacagacactttcaaccagggtcccaagaaatcaggaaaggggggtggctctgggaattgtaaatagtggcgggctctgctctggaagggaacattgtgagatgctggccctgctgtattctacggccctctctagggagcaaggaagcagtggggagggatttagtgatgtgctgcttttccttgtcaggggccctaataaccccaaaagaagtttgatctagtctgttcagcatcacatctcaccttctggggcttacaaatgcatttatttttgattacagaagtaatacatgaaaacattctctttgtaaacatttcaagcattttacaaaaagcttaagtctgcctgaggccttaccctccccagatctctgagcccaagtctccagttcccccaccacttggtctaattaaccccgtgttgccgcacaggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacagtgagacagggagcccactgggggctggaggaaaacagggagggagggaatttctttttggtggggcaaaatggacaggagggccagaagtttgacatttctgttgcctttcacctggtttgggagctgatgtgagctgagtctccacttctgaatctgctctgctccacagattgttatggatcccagggaatggatcccatgactggggcttgaggtggcagctcgcccatagaggcatgttctgagaccgaaagctcagtcagcccatgcattctcaggcttctctcccgggaaacttgttttccctttgaagcctgcccatgacaatcatctgggtctgaccttcccagggcagaaatattggctctgaggaaacccccgctgtggcctctagccttctctaggagctgttagacaaggggtgggaaattgctggcgtcttgctgagtaggctttaaaaagaagggggaaagagcagtgaaatgctttgatcccagggtcccctgctagatgaaggctaaaataatatctcccacacatcttgctagacctcattcttctctctctccagccaggggctgaggccagctgtttcagggaggaagtaactccaaagttgagcaaagtctggagcctcaagttctgtgttcagcggggaggctggctctggctttctgagtcctgtgtgaactcttggctcttgggtattgctcccttgtctccctggggctcattgcctgtttctgtagcttaattgtagcttaatttggggagcatggccccgggaattttttttttttttttagacagagcctcactctgttgcccaggttagagtgagtgcaatcttggctcactgcaaacttcacctcctgggttcaaacgattctcgtgcctcagcctcctgagtagctgggattacagtgtgcacccccacacctggctaattttttgtatttttagtagagacgaagttttgccttgttggccagggtggtcttgacctcctgacctcaggtgatccacctgccttggcctctcaaagtgctgggattacagacttgagccaccatgtctggacaagccccaggaaatttagtgtctataacttgaattgctgggcatggggaagagtgggtggaggaggaggagttcccttacttccaaccctctatcctgtcctggtccctcctccagcctcagcagtcccgatggggcaaggagtcctggagctgcgagatgtgcccacctggagcctgcacccctcagtcccagggtctgccctcccaagggcagattttgctgccagtgttgtacccttgggtgtaagcaggtgtcgaggacccctcagtgtgcaggggtaagaagagaaaggggacccctagtcatatctaggtggagacctcctaggatcctgagaattctaaatttcaacccggccttccagatttttaggaaggtacatttgtcaaggtaggcagatacagcatttttttttttttttttttttttttgagatggagtcttgctttgttacccaggctggagtgcaatggcgcaatctcggctcactgcaacctccgcctcccaggttcaagtgattctcctgccttagcctcctaagtagctgggattacaggcgtctgccaccacacccggctaattttcttgtatttttagtagagagggggtttcacaatgttggctaggctggtcgcgaactactgacctcaggtgatccaccaacctcggcctcccaaagtgctgggattacaggcgtgaaccaccgcacccggccagagcatcttttatttagcagtttgttacctcagcttacagtgtcagtattaagatgtatggcttgagctgaacgtggtggcatgtgcctgtagtcccagcactagggaggctgaggtgggaggattgcttgagccctggagatggaagctgcagtgagctgagattgtgccactgcactccagcctgggtgacacagccagacactgtctcaaaaaacaaacaaacaaggccaggcgtggtggcttacgcctgtaatcccagcactttgggaggccaaggcgagtggatcacctgaggtcaggagttcaagaccagcctggccaacatggtgaaacctcctctctactaaaaatacaaaagttagctgggcgtggtggtgggcacctgtaatcccagctactcagtaggctgaggcaggagaatcaattgaacccaggaggtggaggcagcagtgagccaagatcgagccactgcctgagtgacagagcgagactccatctcaaaaaaaaaaaaaaagtatggcctgtgggctgcacttgtactcttataatcttgttccagtgggaggagccactgggtcactcactctgccttttccccaacagtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagcccccaccctgtctttattcctcccagttccattcattgtcacaggtctcaagaacaagaattttctgggagtcttggcatatggaaagttcaaaaccttcatagcattttggggtggtatgcaagatttttaagtgttcccattgggtcctgccatggccctgtagtactcttcttctggaattgttagctgaggcatgaagctggttgaaatcctcctgcctcttccaccagagccatctctcttcaacgaccctgtagtctagagccgaggggtggaggaaatggactgctattcctttccttgtgcttctgcatgttttatttgtcttttctctgtccttgtcttctgggacttagcaaggcctctgggtctcagttgtcctgagggggcaagcatctctccttggcatcccatggctgggcacagtcagtcagtcagtgtcacaggacagggccaatggctcttcttcccctctgtgcacaataagcctttctgtcttcaggcccccctcctccctaccaggttccaccatcactgtcactttttccagtgcccagtccgccttggtttgcagggagggttcttgctatctctgttcctgtttcctccacaggctttccagaattggaaacaacctgttgtcaggaagaaggggaagggttgagagtcagggtttgggaccagattggcaagtcaggctctggaagaatcatgctctgaaatttggggagggaggaggaaaggtcagaaaagacccttgtgatatttttatttttattttttcagagataggatcccactttgttgcccagactggagtgcagtggtgtgatcatggctcactgcaacctccatctcctgggcttaagagatcttcctgcttcagcctcccctgtagctgggaccacaggtgtgtgctaccacacctggctaatttttgtattttttgtagagacatggtctcactgtgttgcccaggctggtctcaaactcctgggctcaagcaatcctaccaccttggcctcccaaagtgctgggattacaagtgtgagccactgtgcccaggcttggggtagtctttgctacaacatgttaatcctctctctcctggattcaaggtgtaaggaactgaagtgaagcttctgccttgggacccaggctgtccaaggtgggggtgagtgtctgtgaaaccctcttggtctgggacttctgtattcacagaggctcagccccagagagggaaactttcaattctgttggtcaagagaggcctcacttgagggaccaggcccagtggctcacacctgtaatcccaacactttggaaacctgaggcagaagaactgcttgaggccaggagttcgagaccagcctggtcaacatagtgagaccctgtctctctcaaaaaaaaaaaacaaacaaacaaaaaaaaaaaaacgagggaccttattttaagatgtccgaggcagcttggagtagtggagaacaggtagctggtggtttctctgtagcagtgagaggacaggatgggtagattcggctcaggaaggctctgaagtggtagtagatacaccagcctcccccatcctctgactgaggagcaagtgcatggcgggtgcatgacagcacagagctgcacttgccctcatggtgaggaaagacatacagaaaggctagagctagtactttgcccatgtggggctgctttctttttgaatagaggtgaaagtcacacaatgtacagtttgttattttaaagtgtacagatcagtgacatgtattcagaatgttgtgcaaccaccacttgtctttagtttcaaaactttttgggtgcctgtttttggttctgggtgagatgcactcaccagggtgataaagaccctgcctggcttgttcatggcgtctccaggacctagtatggtgcctgaccgtggcactcatagggtgtttgttgagtgaatgaatgatgccttttcagctgaactcgagctagaagactccagggctcactccactgtgcccattccacagatccggccccgaggtgtgcccgttcaccaggcagaggtgtcatccgaattcaggctcctggggcccgggagggtccgactctacggacccaggtcgctgtggcccatcgctttcgatttgacttggtttctgtcgccactcgcggaaggcgcgccccccgccctcgctcggcggcccgccccgccccgcccctgctcttcctccggggccgctggcactgcggccgctccgcaggcagagaagccgggagcgggcgaggcggcggcggcagcagcgatggtgagggcccaggcggggccggccagccctgcgacgggcagagggcgagtggcgagggtgggagagaggagtccaaagtccgcgggctggggcctcccctggggcccacgagggccagacctgaggcggtgaccactgctggagcaggacggggcggaccctccactccctgcgcgccgcatgggagagaaatgcgtgagccccgtcctggctgcaccgcgcagagcgagcgggactcgggctccccattctcctgaagcaaagcggttaagagcaccgactttggagtcggactccgggctgggatcccagctctgtgacccgggacaagtcacttaacctccctgagcctccttttccgcgtctgtgaagtggggtcagtaatacctgccttgttgggtccttgcgaggttaaaggagccacagtggcagagacccgcctggcactcagaacccactgctaagaagtggtaggaaatgtaacgacctcgtcagccctttccgcagctgtgaggagccaagcctggctcaggagttggaaacttgagcagatggggtggcagaggccattccagccccatggcagggtgttggagggcgaactcctcccctagagaaagagaaagggagatgtttactctgaaagttccactgaagttatcagtgtatggcacaggcctgactccctgctaacctctacctagtgacacattcctgagttgagtcatccccactcctgctgcagatcctggcctttgtcctcacttgccatctccaaggcaaagatgtcaggaacagctggtgccagtttctccctttccctagggctcctgggaaaatggactgggcaggaagtaggcttggtgctttaagattttgccttggagaaactgacagaggtgtgatggatgtggcctggctaggggtcaatgcctggatggccttatctccagggaacttggaggcaggaagaggaagtggggcaggaaggtagcactgagctctgaggccaggccaggaagctgaggaaggctctgagaatagggcagagcccagagcccacttaagggtgtgcagggcaaggggtcaggcaggggtaggggtgggcttcagccggcccttagctctttgggagaagctcctgaagtgaaggctgaaggcaggatattttattgggggaggaggatactgggaaacctggggattctcacgggtacatttgaggcagtctgtggaggagaggctggggaggtcgctcctccacccatccatctcctagcctcttcctgtttcttctttcactcttgcccctttagcgctttccttccttccacccatcccctttccctccctggtccttcttcctttcacttttcttttcttctctatgactcattcaaccaacaaggatttcttggaaatgtccttcatgccagcatggtgacaagtataggggacagagcaggaacaaagcagtgatgggaaagatggaaatggaatgaataattacttgaattcattaatcttgtagatgatcctctctccaaagaatgtgtgtgttgagccacaggcctccctcatatgcacacaaattaggttggtagcatcaaccagattctttagccaatcagctaaagtgtctgacctccttgtacctgcatctaatttagcacacgggttacaaatgtggtgcctggagtctgtgttggttcaactcccagatcttctactcactggctctgtgatcttggacaggtgatttaacacctctgagccaaagtttcctataaaactgggaaaaggccaggcgcagtggctcacacctgtaatcccagcactttgggaggccgaggcgggcagatcacgagttcaacagttcaagaccagcctggcaaacatggtgaaatcccgtctctactaaaaatataaaaaaatagccgggtgtggtggcacacgcctgtagtcccaactatgcgggaggttgaggcaggagaatcgcttgaacctgggaggcggaggttgcagtgagctgagatcgcgccattgcactccagcctgggtgacagagtaaggctgtctcagaacaaaaacaaacaaacaaacaaacaaaataactgggttaataatatggccttcaatgggttgttgggtgaggattaaatgagacagagcaaatgaacagcaagcagcatagtgcctacctcagagtatgtgcccattggatggtggctgttattcttgctcaagatgtaaaacctcaacagcctgccgtgccagatgaaaataaactagatgcagccgggcgcggtggctcacgcctgtaatcccagcactttgagagagaggccaagccaggtggatcacgaggtcaggagttcgagaccaccctggctaacacggtgaaaccctgtctctactaaaaatacaaaaaattagctgggcgtggtggcaggcgcctgtagtcccagctaccctggaggctgaggcaggagaatggcgtgaacccaggaggcagagcttgcagtgagtggagatcacgccactgcactccagcctgggcgacagagtgagacaccatctcaaaaaaaaaaagaaagaaaataaactagatgctagttaccaagttaccaaaagcccatttaaagttctgagccacaggttagaaacaattatgtgtactatgtgtacaagtttgccatagggaagagcttgcttggctgtgcattttataaaacgaagaggttttactgaccacctgtattacacaattttttttttttttgagacagaatctcgctctgtcgcccaggctggagtgcagtggcccttagttcactgcaacctctgcctctcaggtttaagtgatcctcctgcctcagcctcccgagtagctgggattacaggtgcccgccaccacgcctggctaatttttgtatttttagtagagacagggcttcaccatattggccagactggtctcagactcctgaccttgtgatccacctgcctcggcctcccaaagtgctgggattacaggcgtgagccaccacacctggccatattgtacaattcttgagatctgactgctaaaaaaaaaaaaaggagctagggaaatgtgggccacatcaatataatagctcttatttattgagcatttagtatgtgtcaggcgttgtgctaagcttttgatttacaataagtcacataatccttagctaacattattatcagcactttacagaagaggaagtggaggtcagaaaggtcatatcctcagtctcagtcactcagctggtgagtggcagaagcaggatttcaacagacgggtgcaaagcagagccctgctcctagtctctgagctgagtgccgacttagggaggcaatgttataccggtacttgcgcccattcatctgacgacagttagaacagtttcttggatactagacaggagatggggagacaaggagagttaggatagggaggtttttttgtttttgtttctttgttttttcttgagacagggtctcactcctttgcccaggctggagtgcagtgcgcaatcttggctcactgcagcctctgcctcctaggttcaagcaattctcctgcctcagcctcccgagtagctgggactatgggcaggcaccactttgcctggctaatttatgtatttcttggtagaggcatgatctgcccaccttggcctcccaaagtccagggattacaggcatgagccaccgtgcctggcccagatggtgtggttttgagaactgcgttttcataggaggaatcaaagagattgagcccagaaaaacctgagaggtttgagtgtcatagaggggatattctgtacagggggcaacagtctgtcaagaacatttcctgtgtaactgccactctctggcaattacacaactgctcccctctcgccctggctcaaaattccaagccctgcaggcttctggcctcaggtctcagaaatgcctgtctcacccttcttcctttctccacgctctgcttgtcacccctctcccgcctggtggccatctcctggcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagaccccacaagataagaaggccttggtttgaagctgtggaccttcttaaaggtagaaaactggtatcgttttttgtttcttttttactttgagacagagtctcactctgtcgcccaggctagtacagtggcacaatcatatttgctgcagcctctacctcccaggcttaagtgatcctcctgcctcagcctcctgaagagctaggactacaagcctgcaccaccatgcctgtctaatttttgattttttgtagagatgaggtctcaccatgttgcccaggctggtcttgaactcctggatccaagagatcctcccaccttggctttccaatgtgctgggattacaggcatgagccactgtgtccagcctgagtactggcattgttaactgagggtgagacactagggctgaaagtcaagggccacaccggtgtttgagatgagtcaggctgggagggttccacggcaggtggtatagaaagagagcagacaaggccgggcgcggtgtctcacgcctgtaatcccaacactttgggaggccgaggtgggcagatcacaaggtcaggagttcaagactatcctagccagtatggtgaaaccccatctcaactaaaaatacaaaaattagccgggcgcagtggtgtgcacctgtagtcccagctactagggaggctgagacaggagaattgcttgaacccgggaggcagaggttgcagtgagctgagattgtgccactgtactccagcctgggtgacagggagagactccttctcaaaaaaaaaaaaaaaagaaagaaagtagacaagatggggaggatgcaggaggagactaagccttactgagatggggttgggaggagctggctcccaggccaagagggtgccagctaactcccactttgtgtctgggggtatccgcagagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtgaaggtccccaggttggttaatcccatctgtctctacccctagggctgcttaaaaagcccatcacccaaaggactccacccctgggagatggctccttcctctcccttccctacttgatccagcccgacacagacagggagtgtggatgcaagaacacaatggcccccaaagcagacccttgaaccagtcctccccatctgagcctgtttctctgagaatgaaatctattatttttctgtcatcttggggatgcttagaggaccaatgagactgtagatgcgatgacaaagaagaaagcacttcaccaattttttttttttttttttgagacagagtttttgctctgttgctcaggctggagtgcaatggcactatctcagctcactgcaaactccacctcctgggttcaagcaattctcctgcctcagcctcccaagtagctgggattacaggtgcccaccatcacacctggctaatttttgtatttttagtagagacaaggtttcaccatgttggccaagctggtcttgaactcttcacctcaggtgatccacctgcctcggccttccgaagtgctagaattgcaggcatgagccaccgcgcctggcccaaaaaatttttcataaggctctcaccttcagataaatggtttcccctctgaacacttcccactcctcaatttctctttccacattctatctacctcaagctttacatcagactgcagatgggggaagtgacagcaagagatggggaccttaaagcactccttggtattcccatctccctccctcccttccttcctttttcgacggggtctctcctgtgtcttctctccctccctctttcgacggggtctatgttgccgaggctggtctcgaactcctgggctcaagcaattctcttgcctttagtgctgggattgcaggcgtgagccaccatgtccagcctgaattcaggcttttcaaagctacagggccatataggccagggaggcagtgccttcagggccatagcaaagatcattgggcaaaggcatggaagaaggaaataaagccacaccaagactgtggaaacagggcagcctctgcctgggctacttagctgcagttcaaactcaggtgtgagtggcaaggggaattcagggtcaagtgtgtaaaataagcagttccttgctgggtaaagtgagcgctactgacagaaaccagaataagcctgagttgtgtggagcttcaccccttacagagcgtgttagttttactgagcgcattagcgtcttcctctcttgggaaagatggaggaaagcacttggccctgcagctggtctgcaacaccacttacagactgcaaatttgggcaagccacttctgaggtaaaaagggcataatgacgcttagctcctgggtctattgaggggatgatcgagcgtgtaaaacatacatcagactaacagttctagatgctaaatagtacctatcatccaaatcattgagtgcagtggttcttaaacctgcttcacctgcataatttatacaagtgccattgcccaggccccaccacagatcagttaaatcagaatcttcgaaggtatcagacacgggtgtttctaaagctcctccgcgcccattctctcctctgggaattcatgtgtagccaggaatgaaaaggtcttagtacaagccagcagttttacagaagctagggatagcaacgggctgaaggtaacagtcccatgagctggttgaggccccaggttctccggcaaagagatctctctcagttggggaggcttgccccaccctttattattatgcctaacacataagaaatgcgcaggaatcaaacgcaaactggtgaaccaactagagggccgcgggggcagaagtgtccggcggggatccggacagcgcatccggaagcgccatgggccaacgctcgcaggaacctgaacccctgggccagcgccgcctttgctcgcagaggcctctagcatctgtactgtcgaagccctctgagcttcagggcagactgaagagccttacacaccagacacttggacgcgatcgcgccagaaatccccgggaattcagtcttggctccgactccaaaacaaatgattcctcaccagccagatctccatcattggcgttagtctctggtcacctgacttgttcaagccaatgagagggggccgaattagtacttccgctttccgtgctgtttaacgagccactatgcccgtccctcggatactctgattggccagcctctctcagctcgtcagtttattggccagcgccgctaggccgctatcgagcagggtccgagggctgtgtcagaaggctgggcagccatggcgtcctatttcgatgaacacgactgcgagccgtcggaccctgagcaggagacgcgaaccaacatgctgctggagctcgcaaggtgggtgcgcggggcttggggatagggtccaaccagcaggtttctgggctggggctggctggagaaggcggattaccaggggcagcggattctggggaggacagatgagtaatctggagtgttagtacgggcggcgagactgaggggtgtggggatgagcatctcgataatttgggccgtccgttgggccggcctggggcaaggggattgcgggaaagattggagctggagagtggtgggcgtgggggcggaaggacagcaggctctgggaggtctcagagaaggtgaggcatgggggcggggttggggccgtgtgctgtgagtgggtatattcatcagtaacagcaggcactgctgttactggacctggaatctggcttggtcttggaatctgggctctaccaggttattcagcgtagcctgagtaacttctctgaatctgttgcctcatgtgtaaaatgggaataaacactttacgtgctggggcggtctgatagcagttgtaaactatttcccatcgtgctttttatctagtgagcatctactaactactaagggtagctattattcctactagctgggcagcgtgtttattaatgtccagtggattatggggacaaagaaaaagcatagttttcctttgttctgactttacatccccttccccaggtcacttttcaataggatggactttgaagacttggggttggtagtagattgggaccaccacctgcctccaccagctgccaagactgtggttgagaacctccccaggacagtcatcagaggctctcaggctggtgaggacactgattctttctgctatttgggccagacccaccccttccccaagccagactgtggtctggtccttcagttttccaggtcaggtgggggcaagtgtccttcaggagtgggagcttgggaggcagagcctgtagcagctctcctgatcagcactccttcctaaagagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataatagctgcccatcccctcacccataggccttcagttttggcccctgcccagcatgccttctttccttcaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaatacccacgtggttctgctgtgttatttgccctaaaggaagtgaggggcagagtgaagaatcccagtgcagctcagtgggcccagaaatgggcctttccgtaggctaaggcgtgcccactccacctccaccagacttctatcccctctgctgttcccagcccccaattcctgcagcaggaaaccccagtggtctggctttggcactgggagtagaaggcacctgaagggctggctgggtgagtgaggacaggtgacctttaaaaacaaaacgacaccgtggggtggggaagcaggtcatgcagctgtggcagctggcagggcccactcctccatggcacaggtgggcatgggatggccacttctccagaagtgaggaagcccagatcccaacagaatactttctcaaaattgtttttggtacgaaataaatggaaagaagatatggggtggggtgctgtggaggccgggccagccaccctccccagaccttagatcatagcgatgctctcgggggcacagttgaggtgggtggaggtgctgctgctcccggaggacttgcaggcccggccaggggtaggctgcagtgcagccaccagtgtgtctgaggagactgccccaaactcgtagctgaaggtgccatagaaaatgaggatatcgatgacacacacccactcacacagggctgccccatgttgcagctgagaactctcatggacaaagaagactccacctaaaacgaggctaaggaaatgttcagtaggacatacggaaacctggcaacaccccttctgcagtctcaggcctcacctctccaaagggagaggtgttagtcctctcccccacatggcagtgttaggcctccaccccccatcctcttgggagggagaaaggttgagctagaggatgagttcctggctgccccgtcctgaaaggatactgaggaccagggtgataaaggcgatgacagccagcacacttcgcagataggccacagccaggtccagcggggcggtggccccttggtaggagagagcacagtgcaggcaaacaaagagcagccccgcagggaaggccacgccagctccaacgtagtgcagagacctggcatgatccacctgggcccagagaagggccagttggtgatgtggccatggccccacctctccacccctccttcaatgaatctcctctctccctcttccttcctctccctctttccagccccaaccttgaggtgccacactgcaggcagccaggccttgttaggtaaagtttaaggtttgcaggggagaaggggaagcacctgaaagttgccaaccaccaagaggcccgcagcgttggtgcagcctgtgatgagtgccgtggtgttaacccaagagtgccgactctgctccaggagctgcccgtagcgcaggaggcagatcagggccactgggggaggagagcacagttgaggccttcctccagccctggccctgcccagcgagcctgtcagcttcccccagacgctgtggtgctcctgccccttctgaggggcagaaaggaacagacaggcgggtggtgaactaggtttcctcaggctccagccagcagggtggctgtgtgggagtcagcttttggccttcaaggaaggggagaagctgcctctattgccttagcccttggtggggagggctgcacagaagggcttcctgggcctttctgtgtggggatcactgggctgggcacgcagggtcagggctaagggtacaactcacccatgaaagcacccatgttgccaatgaggctgaagaggcagctttctgggggataggagccacacttgctgcgaggagggggaaggacagagtaagaggggtgcaggaggcccggggggcccccattttggctcactggctctcccctgctttacctgcacctgctccttagcaggcaggccactgatttatgtgaagatccagggtccctcatgaacaactggttccaggctgggcccccaaagcagagctcatgtgtgtgagagagaagggagtgcccaggagtgttcgggcaaccctgacactctttgctgagccctgcggctggtttggctatccttgagccagaacacgggctgggcaatctgagggctccagcttaaatccaggtgcctccgcttattagctgtgtgacctggatgaggaagactgagcctgtttcctcacctataaaatggtgaaaacaatacctgcctcactcctgggaggatgaaaagagacaatgcatataaagcactcagcagagtgcctgccccacagtaactgtcaagtagtgttgttattaagtggctcttaggatacttattgttcctgagacccaaggacagctctttgcttgaggggctgtctgggaggcccttagatctccctgaccggcccaatgtccaggccttacctgatgagggggacatcgtccagggtgcagcaggtcttgggacccccttgctcagcagggtcaggagggcaggactcgttgtaggacctggcaggcaggacagggagtagactgggggaagggactgcccccaggcccttggcctatagcctcaggcctcaaagaggactctctcccagacctcccctacagggacagaagatcccactccccagtgcccgcctgaagcagtaaccaaaggggcaaagggatagtgggaagtgggtaggtggcaagaagccatgcctggggaccaatttcagagaagagcagtgaggctcagggttgcagtctggctcgtggcagcctcaggcccaagaggggacagagatgaaggaagctttagagcaaggttgtctgcagagtccttcataccagttctccacagggcatacatggtggttcatcacagccatggcatacctgtgggaacagaactgtcaccctggcagccttcccgagccccactcaacccaccccatgacccttctcttcaaccttgatttctggccccattcagcctcattattgttgctggggactcaagttgaggtccctaaggcttgatgccacaccagcacctgcagcatgcccccagctacaggccctctggaaattgccctggctagaagtatatttgtcagggccaccctgctggacagcagtggtgccagcttgtcccaaggggctgtgtgcccaggcaccaagtcaggcttttgagacacccagagtgaccctgggtaccaccgtggctatgacaggacaagagactttgtgtgcgtcatcaagctcctgttgccccccgggcacccccctttactcacacagtccatatgccagtgatggagaacgctgacaggctgacaggcaggaggatccaggcggtcatgagggaggggagccagggtggtggtggtgttggggggaggacaagaggtagatggggaagtgggggcggaccagctaccttgagatgtttctgccacaaccatcagctgtcctggcctggtggagagagatcaaagtccaggagtgggtaactggccgggaagggggaggggaagggggtcaacaccttatccagcgctcccgttgggtctctgagcgtccaaagtttgggctgagcccacggcagaacgtgaacaccctctggcactgggggcctccgcggtcaacccaaatgccaccggcgtgctgagagacgcaggcggaccgtaacatctggaagggagttaccctccttctgagggaccagggctgggagaagggctggacaaccgaagaggccacgccaaggagaggctgggtgccggcccagtggagcggtggcgagtcggcggcgcgcaggcaaccacctgaccatcggcgccctgggcgaggggcgggttcacgcggaaagcccagcccggcccggcccccgctcgcctgggcgcggggaccccggctggggccggaccctgcggccggcgaccccccaggacccgggacgcgagagtccccaggtgattcctggaagcccggaggaagggaaggagcccagtacgcacctccccggagcgccccgccgccgccgcaccctgctcggccccctcgtggcgccgactctagctgcggccctcggagcagccctgaaaggtttaaagggccgagcggccccgcccctggaggccccaggcctcgccgcgccgcccgccgggacgtggagtccgcgcagccccggcctcggtgcccgcgccctgcccgagactacaactcccgagcccccgcgcccgcgtcacgggggaaacgtgggcggtgtcccaacttcggaggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacggtgagtcctctaggaagctctctcaacgtggcgccccatgcctgcctctggccagggctgcggtgggtccagagaagcagacacaaagacttggctgtttcttaagaaatccaagcgcctgggatttggcttatggttcctgtggctcagcaaactccggaggagggctgctttcattagatactttttgctttcctgcatacaagtacacaatgtactagccagaaatcagtgtccaagacgtgtttcccgactgatcaacacttatttgaaataagacggcagagaccagaggacatccattcta

SEQ ID NO: 1337 - DNA, 36272 bp, Homo sapiens
tgtagaaagacatcccgctgctatcactccacaaatcctctagagaagatgagtttggtagacctctgcttatctgatttaaattcttcttgctgtaatctcagctgttctggttggtggcaatgggcaaactcaggatgttggtcagacaatggactgaagagtttacttttctctgcttccctgcccaactgtacttgagtaatctttatagtatctctaaaagatggtcctggaatggtgctccctggtccttccctgtctcttgcagtcggccaggacacaggcgggagtatccacagctctcattttacagcttccttcccgttccctacagcaatagagggggagccctaacggggttttagcaatcagtccagccccttcagtctggaaaggaggacactgaggcagggatgggcggtgccttgctccaggccacacaacaaggcagtgacagtggctgcgtttgaacccaggtgtcctaacctccaggacccacacatggcaatctgaggaactgctcggggagcagagtgcttaatgacagggcttcagggacactatttgtcagaggggctttcaaggtaactcctgtggtggtgttgggagggggtgctcagccgatgcctagtctctctgtagccttggtggggaggccactgtgacccaggtcagcttgcctggaacagctgggtttctggaaacacttctctcttctctatggggccctgtcgtgggtggtggtggtagacggggtttgtttgtgtgtgtgtatgtgtggtttagtagtccctgcagccttcagcctggaaagctgaggaggcatggagaggcagggggttggtggatgagtgacgggagggaaatgcagtgggggaggagatgccaccgcagggctacggtcagagttggtgaagggcagattcaccgtgcctccctctgtcctccttaagacctctggtcatgccagggtcttatggagggggcttggtgctccgcactgtatttgttgctctctctggagttgctgtaccaactctcctggcatcccgacaggcaggagtatgtcccatagccacagaaatgccctttttgcaggttcttcctagttcttggagggctagaaggaactgaggggatgtgaagagcatctttcctcctagcttgttccccactgcccaggcttgctccccgacagtgaatgggaagtggggagcagtcaccttcccagggggctccagaaagctgaggacagagtagctaagctcacagaggagcacttagtcaatgggactgacccaggagggccccgggacaatggggctaggcagaaaggagcaagaaagaaggaggcaaggagggatggagacatctgaggaaagacagagaaggaagggaaaaggaaatgctctgttcacccataactgtccatgatctggacacttggggttggaattccaccccagagctggggcttgccttgtctaccatgttttcaacagtgtctaggtcccatgagtccaccgcctcaggcctggcctctggaattgaaggcctggtgaggtacctgctatgttgggtgtgggctacacttatgcatgaagattagtggggagtcctggcctggcctttccaagagaggaggaggtagggaggcgtgcagaccagggacccagacaggcctcattctcagcagggagctgcacattccagcctagagtcaagagcggactggggcagggcagacattcacctggtgtaccccagcacgcctcctgattgattggtaaatagctgttgttccagtccttgagttccccctgtgcctctctggccaccccagtcccttacttggtcccctggacctctccaccatccagaaattgaggtttatgtctggcttggcatacgccgtcagctctatgtgaactgtgcctgagccatagcaggtgttaaatgttttggccatcatcctgagctccgcaggggccttgtgccccacagctggagctgactgcgaccaggtcctggaacttggagaagctggcagcaggcacagcagctctgagcatgccctgcctcacttctcctgatgcttccagctgtgttctggaaggagatgggtctggataagcaggctggcatgcagggagatgtaggcgggaccatctctccaggagaccccagtagggaatggtttagctgtggcctctgcagggcactgcctggagtaagggagtgctgagcccctctagggaaggaggagcaaacaacagatccctgggtcagctgctgacacactcctatgcacgcggcatctagttctagcacctcctctctggcactgcctggctccccacccagccagtcagctcttagaggcagaagcccagtgtatcccaaaggtgcctggctcagtgctgggccccgattaaatgatgaagtggcctggggaggtagaaagagccccaggctgtgagttgagtgatctgggttgaggtcttgactctatgcagcgctccggctttggacaactctgggcttccttctgctcctctggccagtaagcttctttagcagtggaaacttttcctcaaatgaaattccaagtgaggggccaataaatgaagcagataaaactgcatgtactgtgtttgcccactcccacaccttcctgctacctgtcccatctctgaggaccctcaagactcctaggagcacagtctgatgttctcctgacatggatatcctctgactaattgcctgcttccctgaatatctcgaggctattgggccaggctgatcctggaagctgaggggaggcctccccactcctcatgccctgtacttctgggtctgggaaagcagggagtatggtgggactttgaatccaaagtccctgtactttccactgccctacctagatgtccctgtacctcctgtaaaatcagcatagagcctggtgcctggtagtccctacaaatattcacaaattggagcttagctcagctctcagggggccaatcagggggccaatcattaactggctttatctttgtgaaccatcctggggggcccaggtcatcgccccagcttccagcccaggcccagggggctgctgggggaaggggcccttcttgctgggaggtagggggcgccttgggtccctgcctcttttttttcctgggacttccccgaaggaactcacattgcagtcaactcagtgacaacctagttacatagttgcttcaaataaagactaaagcaggatccaagccaacagatcccccaacccctagtcatctttggcacgcattatgtaatttcttgcttttctttttttttaaccaggggtggggtaaacccatttccctatttgtttctgttttactttagccagatgatagtgggtttgcattctctaagagtttgctcacgaatgggggtgggaacaggagacagggaagggaaaaacatttatatgatacctactctgggcaaggagcttagctgatgtttgctgtttccatatatttccctacaaccctgggaggtaagaaccatgaacctcattttacagatgaggaaactgaggctcagacaagataagtgaattgtccaagtctcaaagcttggaagtgttgaaccaagatcaaacccagcctgtctggctttttccattactcgctatgggggtggtggggtggagaaaggggagtgggtgggtggctgaggcttttcacagtgagggttcatcaagctggtgtctttcctgaaaggacagaggtctggcatctcaggtaacagaggaagcggttccctacctgctgggatttgaggggttcataagaactgcttctcccttccatcacttggtgctgagccccagatttcaccactagtgctagatttctttgagttaagcactgccctctccaagaggcttttaaaacacacaggccctggaagatgtgacatttggtatcagtcatctcatctggagtgtttgagggagatgttacaggctcacagagcctcagagcttagggagtggaacctcatgctttacccaggagaagcctgaggtccagcaaggggagctgactcggccaaggtcacacagcatgcaacagactctggaaatttttttttttttttagacggagtctcgctttgtcgcccaggctggagtgcagtggtgccatcttggcttacttgcctcctgggtttaagtgattctcctgcctcagcctcccaagtagttggtactataggcatgcacaaccacgcctggctaacttttgtatttttagtagagacagggtttcaccatgttggccaggctgatcttgaactcctgacctcaggtgatctgcccatctcggcctcccaaagtgctgagattacagacgtgagccaccacacccagccagactcaggacttttttgcccagtgctgtttcgaagtcgccacatgcctgtgacaggtagacaggagggctctgggtaccaggtaatgaagtgagggattaaagctggaggaaatgtatctttctgctttatgccttggcccagctgagtggccctgtgctcgtcacaggctggtgtcctctgctctcctcccctcactcctggggcaagcaacagtggtgttccatgtgtgagctggacctaccactagtgttggcttgtttaaattctctgacagagacaaactgtcccggggggcggggaaggcagtgtggagctcaccccctgagggagcagcattgtctctgtgggctttggctgggaatgtttctgaagacgccctaatcccttgccctgcctagcctcaaagtctctatcactcagaggagtactgggagggctcagtgtgagccatcagaaccttccagggtatcttcccttgcttgttctctttgcgcagtccacttggtttgctaaactcctgctcttccatcaagacccaactcaaggccaggcacggtggctcacgcctgtaatcccagcactctgggaggcagaggtgggccgatcacttgaggtcaggagttcgagaccagcctgggcaacatggtgaaacaccatctctactaaaaacacaaaaattagccaggtgtggtggcaggcacctgcagtcccagctactccggaggctgaggcaggagaattgctcgaacctgggaggcaggggttgcagtgagccgacatggcgccactgcactccagtctgggcgacagagtgagaccctatctcaaaaaaaaaaaaaaaaaaaaaagacccaactcaagtatcatctccaggaagccttcccctactcccagcaattaaatgctcctcagagaattcccatttttggtttactctttggtttacctccagacaggaagcccccactgacactgttgtagtcccagggtgcaacacaaagcagagatcacaagctgagtttaataattgcttgtggaatacatgtcccaagccacctcctgcaggaagcccttccagatgcccattctagccagtctggctctttgcttccataccttcacaacacttgtgcctcccccagggcctctttctcatcttgctttctggggcagctgtgtgcacatttgtctgtgtgcagcaactctctaaggcagggatttttactcctatttttgatgaggggagctgtggctcagagaggttgaataacctaaggccacacagtgagtggcagagccaggaatgtgacttgggtccatttgaatccaaagtccctgtactttccactgccctacctagatgtccctgtacctcctataaaatcagcatggagcctggtgcctggtagtccctacaaatattcacaaattggagcttagctcagctctcaggcaaggcccaggtcaaaagggcagatacagctttgggaccttagttgccaccacatgccataccttcttcccagcagaaggactccctccaagacagggtaggggtggaggatgtgaacaggggcagaaatgggcatgttttggggtcagacttggaggaatagcagagattggagtgtcagaaggtgagcatgcctgggggtgttggggagatgcaattcatcagggacagcttagtgtcaggggattagactggggcccatgaaggagaggcagaggctgatgggcctaggggtggtgtgggtaggtgagcttccccagacagtgactctgccctgccctctctccagctaggtcctcttccccattccttccccctttcctgactggatcctcttgggagagttaccctccttggcttcctctgctccaatctttttatcagttggccatcattacttatcattacctcaagtcaaacctccagatccacatggggctaggacattggcactggaccaaagaggccctttcctttgctttctctttgtctttttaatgctttgttgcaaagacctaggcggggagagagagagagagagagagacagagattgacccacagtcagggtcagggaattgaggggaaccaacccaattctctctccttcaattcaccaggtttgtatcctgcccttcctgcagatcagtgtcctgctagtcacctgggggtcaggggatggagtgaaggacaagacctccttccattgcagtgaagccacttggagaaatgtgtggaaaacagcaagacccagtgactctctcctcaccttctttccaatctcaggagagattttgtcccttcatccaccggcttctagattaaccacccacacccacacaggcgagagtttccctgaatattggaggtgacaggacatcaggacaaagtacaactattgtgccttggcccaatcactactttctttgtctggggccgccgctggctcctggctgcctttcgcacttttctccacccccacccctttctccccttccccctcacctggaacaccttccccttcctccttggctccttctgaactgccttcagagccacagactgtggggagtggccactgcgctcccaaggtgaggccctccaagcggggccgagtttgcccctcaactgggagccagcatgacctctgtgtgggctgctctctgcttcactgccccttcccccaatctgctaggtgaccctgggcccctttgtgccctctctgggccttcggaggattctttggggagacagtctgctctgacgccccttcccctgcagcaagcagcctggggagggaggtgaggataagtgaagtcaagttgttcagggggctaagcccatggaagggaagatgccacagagatacatgtggtcttgtgattgttgttttgtgctttttccccttttttgaaagctcaggtgactaggtgacttgagcttttaatttggtgacaatgtgggcactggctgagtccttaagagtacattgttgtaaatgccggtgacaacacactggggcatgggatccagagttaacccctccaggtcacagccaggttatatctccacaatgaaggggggaggtgggccatactttctcgccctaatgaaggtagctcaaaaacccctaggccaggttgtaatcctagccttatataaaaggaattctgtgccctcactcccctggatccctgggcaaagccccagagggaaacacaaacaggttgttgtaacacaccttgctgggtaccaccatggaggacagttggcttatgggggtggggggtgcctggggccacggagtgactggtgatggctatccctccttggaacccctccagcctcctcttagcttcagatttgtttatttgttttttactaagacctgctctttcaggtctgttggctcttttaggggctgaagaaggccgagttgagaagggatgcaagggagggggccagaatgagcccttagggctcagagcctccatcctgccccaagatgtctacagcttgtgctcctggggtgctagaggcgcacaaggaggaaagttagtggcttcccttccatatcccgttcatcagcctagagcatggagcccaggtgaggaggcctgcctgggagggggccctgagccaggaaataaacatttactaactgtacaaagaccttgtccctgctgctggggagcctgccaagtggtggagacaggactagtgcacgaatgatggaaagggagggttggggtgggtgggagccagcccttttcctcataagggccttaggacaccataccgatggaactgggggtactggggaggtaacctagcacctccaccaaaccacagcaacatgtgctgaggatggggctgactaggtaagctccctggagcgttttggttaaattgagggaaattgctgcattcccattctcagtccatgcctccacagaggctatgccagctgtaggccagaccctggcaagatctgggtggataatcagactgactggtcccactcttcccacaggcctcagagccccaactttgttccctggggcagcctggaaatagccaggtcagaaaccagctaggaatttttccaagctgcttcctatatgcaagaatgggatggggcctttgggagcacttagggaagatgtggagagttggaggaaaagggggcttggaggtaagggaggggactgggggaaggataggggagaagctgtgagcctggagaagtagccaagggatcctgagggaatgggggagctgagacgaaacccccatttctattcagaagatgagctatgagtctgggcttgggctgatagaagccttggcccctggcctggtgggagctctgggcagctggcctacagacgttccttagtgctggcgggtaggtttgaatcatcacgcaggccctggcctccacccgcccccaccagccccctggcctcagttccctggcaacatctggggttgggggggcagcaggaacaagggcctctgtctgcccagctgcctccccctttgggttttgccagactccacagtgcatacgtgggctccaacaggtcctcttccctcccagtcactgactaaccccggaaccacacagcttcccgttctcagctccacaaacttggtgccaaattcttctcccctgggaagcatccctggacacttcccaaaggaccccagtcactccagcctgttggctgccgctcactttgatgtctgcaggccagatgagggctccagatggcacattgtcagagggacacactgtggcccctgtgcccagccctgggctctctgtacatgaagcaactccagtcccaaatatgtagctgtttgggaggtcagaaatagggggtccaggagcaaactccccccaccccctttccaaagcccattccctctttagccagagccggggtgtgcagacggcagtcactagggggcgctcggccaccacagggaagctgggtgaatggagcgagcagcgtcttcgagagtgaggacgtgtgtgtctgtgtgggtgagtgagtgtgtgcgtgtggggttgagggcgttggagcggggagaaggccaggggtcactccaggattccaatagatctgtgtgtccctctccccacccgtccctgtccggctctccgccttcccctgcccccttcaatattcctagcaaagagggaacggctctcaggccctgtccgcacgtaacctcactttcctgctccctcctcgccaatgccccgcgggcgcgtgtctctggacagagtttccgggggcggatgggtaattttcaggctgtgaaccttggtgggggtcgagcttccccttcattgcggcgggctgcgggccaggcttcactgagcgtccgcagagcccgggcccgagccgcgtgtggaagggctgaggctcgcctgtccccgccccccggggcgggccgggggcggggtcccggcggggcggagccatgcgccccccccttttttttttaaaagtcggctggtagcggggaggatcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaaggtaagcggtcgtgccctgctggcgccgcgggccgctgcgagcgcctctcccggctggggacgtgcgtgcgagcgcgcgcgtgggggctccgtgccccacgcgggtccatgggcaccaggcgtgcggcgtccccctctgtcgtcttaggtgcagggggagggggcgcgcgcgctaggtgggagggtacccggagagaggctcaccgcccacgcgggccctgcccacccaccggagtcaccgcacgtacgatctgggccgaccagccgagggcgggagccggaggaggaggccgagggggctgggcttgcgttgccgctgccggctgaagtttgctcccggccgctggtcccggacgaactggaagtctgagcagcgggggcgggagccagagaccagtgggcagggggtgctcggaccttggaccgcgggagggcagagagcgtggagggggcagggcgcaggagggagagggggcttgctgtcactgccactcggtctcttcagccctcgccgcgagtttgggaaaagttttggggtggattgctgcggggaccccccctccctgctgggccacctgcgccgcgccaaccccgcccgtccccgctcgcgtcccgctcggtgcccgccctcccccgcccggccgggtgcgcgcggcgcggagccgattacatcagcccgggcctggccggccgcgtgttcccggagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgcttattttcatttctctctgcggagaagatccatctaacccctttctggccccagagtccagggaaaggatgatcactgtcagaagtcgtggcgcgggagcccactgggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgacgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgctccctggccttggaaggggtatgaaatttccgtcccctttcctccttggggcccaggaggagtggagggtcccgggagaatattgtcagggggaaggcagggggtgtcatgggaatgggtgagggggctgaggtgcagaatccagggggtccctgcaggagccgcagtggtaagctgtccagctggaagcctggtaactgttgttttctcttgagaggggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacttggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtgacccttcctgtgtgagctggaggcacagagggctcagcctaatgggatctctcctcccttccctggtttgcattcctttgggggtggagaaaaccccatttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcctccttccccaccccaggagccctttccttggcctaggacctggcttctcagccactgaccggccccctgcttccagtgcgccacttaccccttccagcttcccagtggtctctggtctgggagaggcaggacaaaggtctttgtttgctggagaaaaggttgtctgcgataaataaggaaaaccacgaaagcctggttgttggagtgtacgtgtgtgctcccccaggcagtggaggccagccctccttggaggggcggctgcctgatgaaggatgcgggtgaggttccccgcctccacctcccatgggacttggggattcattccaaggggaagctttttgggggaattcctaccccaggtctttttaccctcagttaccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttcgtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcaggctgggccacaatttggagtagtcatgccagagtcctgcatttatttattctcaagggccccgcctctgtggcccagaattaccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccttccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcacttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgtgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacagtgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctcttggtttctccttctccattgaatccttgctctagacttcctcccgccccctttccctcttcctctggggaacatggcatttgtcttgggtctgggaaaggtacgtctaatgtgtaggatatggggtgacccaccttgttgtgctgggggcaaagtccttccattttggctgagctggtcctgggggaacccatccatcctgtcttgatatagaaggtgggaagctctgggaatgggtggagggggagaaacagcttaggagccaagggcccttgcaattggtagtgctgccttcaggaattagatgatccaggcccctgtcccttagccagggaaagaactggccatgtctccaagcttgctgcccaggagacaggagagagctgtttttgtctgtgggggtcttgttggctgcaacaggctgggagtgggagggggatgctgctggagggctgtgactccagggtgtaacttaattttacatagttttacaccctggagttccttgagcctctggaagatggacccataggtttggtcaccactgatgggacactccctgccccagcttgccataagctcttctctcacgtcctgctcctgggtaaggtggcacctatccaggtctttgacactgaagggcagtgcttccaaattcacttcctctagcctctcatttattcttgcaaaccatagatatggcttgaataaatattgagccagtcattgtgctgctatgaataagacacaattccacccctcaaggatctggtgaggatgggtgggtggggagacccaaaactataaatccatgagcagaaaaatacataaaatgtgctgggggcatctgatctagcttgggagtgggagttgtattgggggtggtggctggggggtggtgtcttatgacattatctctaggctgccacttaaagtatggtttgaagacagggagaacggggcggcggagtgaaagggttgaggacatcccaggcagaagggatagtgtgagcaaggcatgaaggtggcacttgggcaggggcagggagtgggtgggcagggtggaggctggagacacgggcaagggttagctccaagggagcctgcagcaccatgccaagagcctagggcctgtcagggatgagcagcagccgaggggttttaaacactgagcggctcagtcagatagacttttccataggtgcctggcaacagtatgggaggcagagaggccggtagaggctgttgtggtcttccaggaggaattgtgctggtggtggggaagcacctttggtgactggcagtgccggccattgcaaggtctcagcctcaggcagcttttggtctagtaagtgctcctttcccaatcactgaccacgtgccgacccctacattggttaacactgaatctgcacagcagccctgggaggtaggtgcttttttttttttttttttttttttgagatggagtcttgctctgtcacccaggctggagtacaatggtgcgatctcgggtcactgcaacctccgcctcccaggttcaagggattctccctcctcagcctcccgagtagctgggattacaggcacgcaccatcatgcccgactaatttttgtgttttcgtagagacggggtttcaccatgttggccaggctggcctcaaacccttgacctcaggtgatctgcccgccttggcctcccaaagtgctggcattacagatgtgagccaccgcgcccggcaggtaggggcttttttcatcccatctggatttttgctggagcctttaaattggccgcctggcttctcctctggccttcctttagttgaatctcacacaactgccagagtgagcctgttaaaatgtgagttaagttttggcaccttttgactcaaaaccttccagagatagttttactcggagaaaaacccaaatggccttaaaaggcctgcaccatttgggctgcctccctgactactcaatgacttcgggccccgccttggccacgtggcttcagccatgctggtttcactgttcctcagatgcagtgggcatgctcctgccacagggcctttgcactggctgtcctctcttcctggagcactctttcctacacatgacccatgttgttggatccctcactttcaagtcttgttaccttctcagtgaggcttaccctgaccactgcatttacgattgaccccccttcccactccacacttgggtacctccttttcaccatcccttctttttccgcttagtacctgtagccacctgacagactctagaacagtgctacccaacagaaatatagtgtgagccacttatggagtttaaaattttccaggcaccagagttcgaaagctataaaaaggtaaaattaattttaataatttattttagctccaacatatctagaatatcacttcaggatctaatcaatggaaacattattaatgagtttttttttttttttttttttttttttttttttttttgagatggagtcttgctctgtcacccaggctggaatgcagtggtgcaatcttagctcactgcaagctctgcctcctgggttcaagtgattctcctgcctgaaccttccgagtagctgggactatgggcgcacacaaacacgtctggctaatttttgtatttttagtagaaatgggggtttcaccatattggtcaggctggtcttgaactcctgacctaagatgatccacctgcctcggcctcccaaagtgctgggattacaggcatgagccactgcgcccagcctattaatgagaaattgtatactcttttggtactaagtctttgcgtctgtccaagggcagaaattgggtgtaaagaaaaaataaatctttgaatctggtgggtgttttatatttatcgcatgtctcaattagttgtagccacgtttcgagtgcttaatatacacatggctagtggctaccatttcagacagaatagctttaaaatgtactcccccctttgtttgtctcccccaactagaatgcaagctccatgaaggaagagatttttgtctgttttgttcaatgtatctccagctcctggaacacagtacatgctcaataaacatttgttaaatgactgacattgttgaaactgaggcctggacctgaaggtttcatcccaagactacggaggtgagtacaggatttctacagaggtgccaggagttgttggtgagggttagctggacaggtggggacttaagtggggattgtctagaagaagtgaactcaaagtcagctggtagggattacagcagaggcctctttgtcagtgccagtaccgtctcctcttagccaccctggggatggggctcattattattgcttggcagatgagaagcaggaggctcagagaaggtaaataacttgcccgaatttacacgcagccagtaaatggccaagccagaatttaaaccagcttttctgactccaaatctagtgctctttttaccacaccacagctgcctcaggctagggcaggacatcaacaaataaaaatgaatcgtctagactcaatacaaacagggaagaagaaaagtgggacagggggaggatgtagtgctggccaaacccagggctgaaatccagacttccccaagtgtggtaaggcaaggcaaggcaagcaagagatgtctccaggggctggggctcgtcagtggaagatcggaaacctaagcatgcaagagattgcaacacacggccttagatgagagaaacagccttgaaacagaccacggagaaaagaaggagaacatgaaaatgccacctcccccagttgtataagacctgcccagatacccccctggagccattcccaaggatctctccagacctaagcaagtcccagggcctaccctgccttcccagatcatctcctctctgtgggactcacaccgcctggtctagccactgtttcctctggagctacccagtgctccttctcctctgtctagcctgagactctcccttctccaaggagctgcccatcctgctcccggccctgaaaggcctttagagagcctgctggcccactctcctccctcccacaagaactgaaaggctgacgggtggatccatacaaaacttggtgattctggatcaatttcgtgtgttaggatcattgtggtggccagtgtgcaaacatggctgtcaacagttctttccatccctgtgcccacgtgctttgccccccaagaagtagagtctatttttcctctttttgaatctgggccggctttatgacttgctttgaataaaaatgcaacacaagagagatattctgggactttcaggtctaggcattgtagtgtcaatttttgtcctcttgtaaggcagctgccaggctataactgtccaaatactctactggagagagagactgtggagagacagagagagataggggaagagaaacagagagatagaggaagagagagacagagatggagagagagagagaggctcagccaactcccagctgttccaaccacctgaagctgaggcaccagacatgtgagtgaagtcactttggattccctagcgccaggtgagccactctagccaacaacacataaagtagagagaagccatccctgccccagtttagtgagttgtaagcaaatgtatgcactgtgttgtttaaagctactaagttttggggtggttattattcctcaataataactgagccatctaacaaaacagtcatttccttggcattagggtgtttgtcccttcccatccataaggtttaactggtattcatgaagtggatggagggatgttcaaggaaagaagggtgtgtttataagggaatcagagaccaggcatctgccatggtggtaagtttggtgagaagtcagggtaagggctgacccaggcaggacaaaatattgtcctaatttctagagtgaggagagtgacttggttgtactggagtcttaccaagagaaagtgggcctcacctacagcatgggggatagaggatagaggatgagaagaactgccagagagcacagcatgagggatttggaggaaaagactgtggaatccttttcttcccttcttccttccatcctccagcgtttatggaataccagccatatgtactatgccctggtgcagggatggtctctcatttactaggaggggctttagcatgagccagcctagaggtgggggatggatgggctgacccttggaaggctccatcaggttggcttcagagttgctgggagagagataattcagctacatccgcaggacattgtccattaggacatgggactaggggagggcagggaaggaatcagtaaatatttataatctgcctagaaaaggaaaatgcaaggcaaagacagggcttgactgagcatctgctgagaaggaacagaaggggtgacgtggaaggggaagagctagaacccagggagcagtgagtcagaggaaagggcccactaggcacaggtgcctatggtgcaaggctgggcttgagtctcccaggacaagagggggccgggatctgacaaagattttcaaaggctgcgtttgcctttggggagttagtctctctatgagggaagtgcaagtactgctcccagggagctcccagtctcaaggaggattgacatggccctggccctcaggatgctcccggtccttacagagtatctaatctgagggaggagacagagcttctgccatcagacatttctttggatactagtttcgggaaggcaccaccctgccaccatttggctgttgcactgttcggagtcaccggatgctggtaccccatccttccctccactctcggtgcgcattcacaatgctcacagggcttctcttgtgtttgtcatcagccatgcgtggctcaccagcctgggccctgattttctccacacatcccctgacggtccctgggtctggctccaagtggagcagatgctagcacatgtccctttcctgggcttctcctgtctcctctcctggagaggcctgagaaccctgttcatcagctcctcagacttcctgcaggaagactgttcccctactccctgtctgtagctcatccagctgtcctggggctggaagcttctgaggaggtgatgccctgtgaggcccggccatagggacctctctttggatgcctctgcagagcctaatctgggccgccctaagtcccatcaagacttctgacagatctagattggaatcctgggtctgccactggagaaattacttgcctgcacctcaactttctcatctaaaatgggcacagtaacacctacatgatggagtttgagggcctgaagtgacattgacatgtaaaagtacctcatgaagtgactggtacataggatgtcctaaaaaaaaaagtcattatcatcttgttgttattctagtctccatgccaatgctttttcctctctgagtgccccctttagtacattttggttgtttgtggggcttttttcccactttttaaaaaaacctgaaatggtctggctggattttataaccatttttgcaagcatgcatccttactctcctgctgaggagtgaggcacgccagggcaggttcagccctggagcccagcagtgagagaaagggattggactgaagggaaaagagggtgtggagagcccttcctggtagggatgatgccctgtggctttgaacccaggaccaggtacaaggtgggcttgcatgagtatttgtagaattaatgaacaaatgaacaggagcagaatgcatggccaatcttctcttaggtcccccaaacacactgggaacctccagtctgatggaggaggccggatgtccacccttatacacacagctgtgctctgggcaagaaatgctgaggctgggcagggctgcttgggccaggctgcagtggacggatgcccccagggctgtcttcagaagctccctcaaggtggaaacctgtctgttccaggatgtttaggtgaaatgatttgtggtataggtatggaagggcctctgggacccaggcaggggagaagcccttccctgggactttggagagctgggagctgccatctcctggggaggccacaagaggatgtcttctggggaaatattcagggagggtgtttgcttttggctcccaaaggcatctccacccccaccccaggtctcccctacttcactccccagggttccctcccagctgctctcctggccagcctgagatagagagaggatggcagggcttgctgggcccctgaggctgggactggtggggaaggtctggccccagcagatgccctcctgaggcgtcctcgcttctggagcgagactcctactatagatcttctttcacacgggtacatccacacgggctcgcacacacacaagtgtgacaggggtcactattgccagtcacggggcagccgcctggttgggtaagggttcctaggggctgggtgaggcccagctgggggagccagcatctcgggacgagcccccatggggctgggggttgggggctgacctggctgcggtcccatgacccagagctgccctctgggaactgctgactgttcagcaataaacacctcatggctattaatagtcttctgtgtggcagcccagaattgataacactgggtcacttctggcctggcccagcctgactgcctgggttcaaatcctggctgcaatttctgagccccgaggtccaaaacccaaaccccaaacacagccccagctccgacagcttctcagctatgtttaggacaattacctttctgcatctcacttgccatctctgaaacaggcaccatgatatctatttcacagtgtttcgtgtacatatgatcatgtcatcctccccacaccagacattggcagtagtgtccccatactagagctgagagtgctggtgctcagggaaatgcagatggttataggaggatgactggcatgcaataagggcccgataaaggttagctattgtcgtcgtgatttggcacaaggatgtaggaagagaggatttgaaatcggacagagctgagctctacttttgacatcagtagagttttctagctctgtgaccttgggcaagttgctggatctctctggggctcattgtcttgctctgtaaaatggacatggcaacacctacctcccaggtgttgatgtggattatattagacaatgaacacacagtgattgccacttaaaagggaaggagggaagaagagacctggagtgaggggaagagttcagctggatgctggtaaaacccacccccagtcccctcttaaggggctcaataaatatggtacttgtagaatgaatgaataaatgaacattagtcacctcaccctgtcagggtccccaagagcagggacaaattctctctgattagcccgtgtgctccctgatggtgagggtatgaccttgggccttctcccttggggagaaagggatctacggatccctttagatgaaccatctaaaatgccgagcctttttggggatggttcattctcttggtgtggcaacagccagtgcagaaacccacaaggaaaaatggaaacaacttttcctttccttctcgtaatgaggtgcaggcagggcacagggccctaagccctgggcacagagtctcaggcctacaattaatcccttcccaggatgtggccccaggctcggctcctggctgcatccccagcattgctctgtgccccactccccaagtcctagtgcttaccccccattctggggactggggaagggtacattttgctggcaaagattatgggagcccagggaatgccttcttgttgaggccagcggggctcatcccctttccttgtgactgtggtgaccccagccacacccttgacactgcctaagtctctggcagccatagtaaaaacccaaatggtggtgctggtggtgggtggagggcacgcagtggggaaagggggcagaagagacatgggggtgaggggaagggctcagctcgatgctggtaaaaccctcctccaggccccatgacttcggagaaactgcctctctcccaccccggcccccagatgccagtggtgtgccggccgttggcgtttgcttcacaggaagtgtccctggagtcttgcttatcttgaatgggtggctgctgggagggggcaaaggaagccatttcttccctcgcccaccattacatgtccactccaaaggctatctcttgcatcccagaccatcctctctccctctctgaaggtgggaaggaggtatccatgatctgaggactaccttctaggggatggggggtcccagagcccctcatctctgtctcaccctcaccctgggtcaataccaggtacctggacatgaagctcttcctcagtttctcctgctgtctgttagtcctgcatgggcctcaggcctctctggtcagctggccttctgggtctgaggagggaagatcctagaagtaagttgtcagatgcagcaaataaaaacacgaggtgccccattaaattttcattgtttgtgtgaaattcaaatttaactgggcatcccgtactttgtctggcaaccctgcctggatggagtggctggacctccctcttgcgagttctcagttgctttgctgctccccttcctcctccccagccttctcactgctttgctgctgaggtatccagtgtagacattgtgtgtgggccctcgttctggatttgtcctcactttctgcctgcagcagagatctgaaacaaattaggagctctctgagggcacaggcagtgtctcccccatcagactgggagcctcctttggattgagtccatgtgaccttgtagccaggccactcccctttctccttttcatcgtgctctggaggacctggcgctgaccctcaaggctgaccttttccacaggcttagcatagccttcactgctgctacctgcaga

SEQ ID NO: 1338 - DNA, 194818 bp, Homo sapiens
acataaggaagggaagaaagttaagccattttacttatttgtacaatgatttcagatgtaaccatttattgctatctgaagcctgaaacaaatatctcaatagctgggaggctacagaaaaggctttctgagtaaagacacgagagcttttccaaaagaattaattaaggtcagaaatgaagtgacagaatctgaaactaattttcagaaatctgaaatacatgaacatctttaaaggaataaaaaaagagagaaagggagaaaaagtagttccaaatcatttgtcaaagcaaatagatttatgtcatgtacttaaggtctaagtctatgtgacaaacagctgccctttgataaactgttgaactcagaagtcaatgaaaaaaatgtcactaagtagtacaagtttggagaagaatataacattatctgccctataaattttatttcgtttctagattaatgacatttttagcacagatcaaaaattatatatctcctaataagtaatgacaacaagtttatttcattttctaaaatagagccatggataacccacaggtcatgggtgaatgtggctcttgatttgattgtaccagacctccagaaaatgttctaaaattcagtgcatgttctcttctgctagtaaaagtctaaaagccaattttgtgtgcatatgggagatccaaagatgaaaacaaacgtagtcgtagaattatagattatttcagccaaaaggtccaaataaattacctaacctcaacttttctttttacagtgaggaatctgaggcccagagagattaagaagcttcacaagtgacatgacttgtgccaaatcacaaggtcatttagttgcagaactgggacaggaattcatgcccagttctcttttcaaaaccctgtggaaaaaagaagcacattgaatttagcctttgattcgtcatcagcattatcagaggtaaagcaaaagggagtattaacagatgttcagcaaaatggaggaggtaaattcagagcagatgttttgacaatgaagtaaagaaggagaactgaggacactgagagccttacataatatatgagaattaatattcttattaatatattagtgagaatatattgctcttatattcttaatcctcactgaattattttaggaattagcactgagcaaattatttaacctttctttgcctcagttttctcaggtttattacaaggttgtttacttaacaaagtaattataaatattaaatgagagaatatatattaagcacatgaaacagtggctgatatcctttctatatttttgatagtgcgttattactattactttatcatgttcacaattcacacctgttaaaacttctgtgtttctctatatcatgtatccatttaaagtaatttaagttttcagagactctaatttatgtatcttcacaaatattgtattactttttcaaagctatagcatgtggtttaaacgtttctgggagtggtatattgggatttgctgaaattaatcaagactaaatctggaatacattggcttcagtgtgcactatttgcaaagaaaaattcttacaattaacttcacttcactattaccaacgtcttttctgtataaaattgtctttatttaaaatgaagcaaataaaatcttgtaaatagtattttcaggaaagcaaatttctaaatactgctactctgtgataagaaaaatacactgaaattatagttgtagcaactaaattcccaaatcaaaaatctgtatttagaacacagtatctcagagtaatccaaaagctgaaaattaaaacaactatagaaactgagagcatgagatagctgaggagatgagcaacaactttttttttttttttttttttttttttttggagaaggagtctgttcttttgccctggctggagtgcagtggcacgatctcagctcactgcaacctctgcctcttgggttcaagcacttctcctgccttagcctctcaagtagctgagactataggcacatgccaccatgccttgcaaatttttgtatttttccagcctggtctcgaactcctgacctcaagtgatccacctgcctcagcctcccaaagtgctgagattacatgtgtgagccaccacaccagccaagcaacaattctttcaaatgggatgccagcacaaaagcacagtatcccagtaagagggatagacactatcccagacagtccatgaggagactccaacaaaacaatcatcattcacaagcacaaaggcctctgattatttaaatccttttttttccattttccttttaaaactagtaacaaataagcttttaaaatgaacaaattaatgttttttcttggtctcgttacagatgaggtgcattttttttaagagaaatgttggaaacaacctactgaagaaaggctaagtaagtaatggtacttctataagaggcaataagatacagtaattaaaaatcatattttgaatcagttccatgacatgggaaaatgatcacaacatagtgatagtggaagaatatgtatgtgtatagatgtatattttatgagtatgtacatacacacacacacatgcacgcccagtataatctcaagtaattaaaactggctaaaacaaactaaaagaaaatgtacaaatatttacttaattttacatttatatagatgtcaatttcttaataatttttgtaaccttttaaaggaattaattataaatgaatgaaaattacatttacaattctccattttattacaattttgtacttttcattacattttcacttattaaaatttctttatcctgaacttctaatattaaaaaatgaatgcgtccatatcttatccagtataagtaaggagatgtaagagtctcaccagctgaggtttcctgttgttttaaagtttgtcttatctgctgctgtgcttttcctttggctcccagttgtaccatctcaagaaccaaagttattccaaggggtgaaaatataatgttgtccttatgagataaggaaacctcttgataaagatccactgcaaattcggtatttttttgagctgagcatcttgaggcttgacttccaaaaaacagcaatagaagactccacaagaagattgtgtccattttgacttctctgtattgtttaaatcaaaatatattcattttcaaaatagagttttccacagagagctcaacagaaaactttctacctgttgtagctttctatcttaatagaacttactaccacaagtgaactctatccaattagatttctaagtatcatctattcagaaaaatagttcatgtgttaatggtatttcttacatatcttcaagaaccagtagaaaatatacttgtagttttgtagcaaaaatcaaaaaagacactacaatgttggaatgttatcaatggcaatggtatctccaaatagttatacaatagtttttttctatcttttctcatggttaagtgggataactgtaactctgacatcaggtaaaccttctgtgctgtctactctacagtaatttatagatcaagaggaagaaatggaataaaaacagacttactccagtgtggttttagacctataatattagaaaattaatgtattctaaagcaactgagtaatctggctaactttttacaattttcctcacgctttatttcttaggacaaaataacccaaagccctcttcctgcttttccaaaagaagacaaatacaatgcagaaaacctgcaaagtttgaaacaaaatggcaatcaaatataaatgatacaataaagtactatgctcactacctgggtgatgagatcatttataccccaaaccttagtgtcaggccatatacccatgtagcaaacctgcacatgtacattaatctgtaataaaacttgaaattataaaagaaaaaatataaataaaatgaaatataatatcaaagaattgacagaaatactaacaaatgtaagagtagcagcaattaaaaaccataaacaattcacaagactaataataccctattaaagtgctctccactaaaattgcaggaaattcaaccatttgattatatctcaagcagaattagttttgcaatattaccacatatttggtagaatgttgactccaaggcctcataaattttagtaacaataattttaccttataaataatacatgttagtaatccttaaaaacttatccatcagtaagttactaggaagtaacccttaattaggggtaaagatgaaagcctttagaatagtctgttgtcagccttaagtagagacttacatttctagagtgttttgcagatcattaagggtaccataaatggtaggagtccctaagaacaactatatttatatataaagattactaatagtcaaatattgttccaaattaaactatggagtcattatttatccttcaatgtattttgttaaactgtatttgtttagatatatatttgcaaaagacaaaagcctcaaaaaacaatccaaagcaattgttagaaaatgtgttggtaaactttagatatagacctatatgctattaatatcaagcaaatgtttcattagggattaatttagcatatgagcttataaatgagagtgcaacaatagttaaaaaccagtgagtaagagaagttttacatgcaaaataaatgtctgtgtatcattatcttctaatatattcaatttctcagaagacttctgaccaaaatatgtgtttgtagatacgtagtcaaaatgttattagtacctttaagttatcaactggaaatacattagatatagctttatgtatttggtttatattggaataatgaacagtattattaaaaatgtaatttttttctttgtggtagaatctcagtattagagtttccttctcattattattaataatcttaataattaaatttatattatttgagcatccacatccattttttctagaaaatttctaagcacttaataaattataacctcagacaaatattggttttaaaaactcacttacctcatcaggttttggatcatatcttatcagaaagcacaaagtaatgctgaactaaacaacctgatgaatagtcctataagaactggatcttctgatttgtggtgaaatcatttaaggagaataaaagcgatatgttaattaaataaattcaaatgatttttacaccaaagtaaattgaaatgccattccatactctactaaacattcataggcaatgttattgcatacatacttattcaaaagctatttatttctaaggtacttaccccaaactgacttctgattattcactggaatgttacaactaaaatacgcttgctggaaaactcttgtacataaacacctgagcgatcaaggccaactccatttatcttgaccattgcttgattaattcctctagaacaaaagcaggtgttcactacatttgtattaagaactaacacaatcgggttaatgatcaactgatgaaatgtgcaagaattgagaaaaaaacaattatagaattttttaaaagtattaaatttatattattattttatccattattttgcttcttttaaaagttgcacagaatttgaaaggatgcgctactggttgtaaatttgctagtaattagttctttttgtttctcacaggactcctacatcagattaccaatgcactttgtcataaatatttcagaatgcctatgagaaaaagaataaagctaaatcaagtccagaatacagagacaaatcactgctgcattgacagagttctcaacattcatcaaattatacaatagtcagaggagtttcctgtggatataaggtccatttgaatccttaagaaaaagagtggatattgaagaaatatgttctttattctgagcagaaaggccagcaaaaaagataatggatttgccaaaatatatcaggacaatactattagccataggtaattggatgataaaaattgctgttacctttatgtgcttttgaaactctacatgattttctttgcaaaaaggtcattaataaaaaattgcataatttaatgggtttcatctcatttttgtagttcaaatcaatcacctcaatggcaatcagatattaagcacattgtattatttatctatagcctttgagaagagaaaaaaaatttagttcacttttaattaaatatctgttgatccccaaatttaatactatttctgataaactcatgtaaaagaaataaagtgaatatagatagctttaaatggaattcatttttaaaaacttgtcagaggaccctgttaacatctttccatgtcctaacatggctataacttaaaaataggcctgagaatagatcattataggccataatctactaattaactaaaattttttgatttcccatataggcatctccaaatgttttctagatcttgagttttattctaatattacctactctatcataagcacactctagtgtagctttaacttaacacagagataattttccaaaaagagttgtgcaatacaagaatactatcattctacttgcttcacactgcaatacataaatattaagtctgaatgtcaagactatcattcaatcaatgcttttctacccatttactgacaccagcaaacatatatcaccagtacccttggctaccacatcattatgtctgtacactgctcagatcacaatgtgatttatccagaaatagtccattacttttcctaccaatggcagagaccgtcactctgtcctactaagaccatttaatgaaattgttctgtaaggaccttatattagagcagttcaggcagaatgttcattttcctgtctcttgaggagtaaaaagcaatagccataaatttattctccctggtttaacctcttttaatagacaatgacgacaatacaattgtccataaaatattaccacaaatttttaaaatattttcccaaaccgcttttttctacaattctattttgctcctagaaaatcggggtggggggagaattattcattaatgagagccaacgtgtcttggtagaaggttgatcgccattactgtccgactgtaaagtataagcctaggaatatatataaaaaccacagcaaagggttacagttatcatctcatcaattttcttatccttttatagttttttcaagtaaaagtgcacttaattccaaactttaaaaatgtataagcaaatgccctcatcagtaaagaacttaaaagttaattcttccatttaagcatggactcatttcaggcaattttttttggtaagattgttcctaaattttgagtgataataggaaaatgttctgacaaaagaaaatgttaaattatatttagtgtaaatataagtaatacaaacaaggtagcctattgaaaattatgacatatcctattttaatgtgaccaattccttttaccacagaaaaatggatcataagtaattgaatctgaatgttaatttcagaaacagtttataatgccttcagttctgttaagagttgacaggtgagatcctgctacctgcctagaaaattagatgctgtgagttacaaaagaagagtaagacacagaaaaaaagacattgtcttttttcttctttttgtgttttttctccaaattattagaaacagttaccttgaaagtctcatacctttaaaagttctcttctcattgaatatatttatgagacagctcttcttaattccttttacagaagaagccctgatgttaattaaggatggaattagagttacagcataataccatgcacatgtagtaggctatagagagaaggtctgtctgtatgaaccagactatctcaggctatcacatcaaacaaagttatcttcaagggtaaacagtaaagtatatctagcaaaagaattcccaaattagactggaaaaaatatgccagattatgaatttccaacttatgccagtgggctcatttagtattggcttaataaaccactacattttatatagcttcacttcagaacgctgagggtagaaaaggtgcattctatttatatgtgaatacccggaacctaaaataatctcttatacatgccttcaatacttacatgagggatggacggatcagtggggaaaagagcctttgcaaattatttggtacccgcattctacttttataacatcttaacattccattaaatttctgggcatgtggctcagatttcactccattgtactatcaccaacctatgattcataaatcatgtgctctgagtttgaaatgatggattacccagtcaaacctcctacccagtgcaagaagtctttgcaatatccccgtgagacagttacccagtgtctgcttgaacatctcaaataatctttttgttcaaaagcaactttttatattttaaaaaaatttaccttgaaatactttcaaatttacataaaagttgcagatatagttcaaagaactgctatctccacctcctcctctttccccaattgttagcatctaccgcatgtgtgtgtttcatctatgtatctatcctcccaataagcaaacagatgtaaatatagatatgtatatgtgttacctgtgtgtgcatatatatacattttatatatacatataattagtattttctgaatcattttatagcaagctaaaaacataatttctatcatacttaaacattctattattatatttttctaaaacaaggacacttcttgtacatcatcacaccacccaacagacaaacacacacgcacacacacacagagacaaatatacttttctcctacaatctttcctgcatgtaattttcattccatgaggaggaaaggcgatatgaatagaagtcataatgcctaactcagaatacacttaaatgtagttagaataggcagctgtcttctgaaagtccttccatcaccgccttctccaccaaaccaaaatatttgctccactggtgctggaaagtctagtgttagaattcattccattggctttatactaataagaagcaagtgtacagaatgatgaatggcaaataccatggtttgggagtaaaacagacctgggttccaatctcaactctgccattgataattgagcactctcctaatagattcgcatctcatattttagctctaagctaatatattcatatgattattgtgtggtttaaacacaatggacatttgcagttgctataccaagtggtcccctacctattgcaaattattttcctttactacatgtgttattgaaaaattcttcttaaactttagctggttttgaaagcactctttaaaatataaatatacagtaagtcattatagttatgtaaatgaatttaccaattctttctataggacacaataaataaagcagaataataatattgcctggaagatgattatatttgtaaataaaaatgggtcaacaaacagaggcagtaagttaaagaaccaaatatttcccacttgactttccacatagagtgggtcctttatatagccccaggccctttgattttttttcaagactattacatcttcaatgtgctatggcattcaattttaaagtacagtataacaaactattgaagtagatcatatgcagtaattttccaataagtttatagaatgaataaaagccaataagaattaacaggaagtggtgctattgacaaagtctaatcaccattatgagaatcatttaaaaactactagaaagtgtaaaaaagtggaaacagttttcttattcacatttgtagatatttactccgtcagtacttttcatatatttcaatgcaggttttacaatgaaaactgatcaaaagtgtttgtctataggaacaaccagaagggcaactggttagaactttgttctggaatcataaagtttttatataaaaatccttgagaataaataccaagatgttgctcccactttagttcaatatttattttattaagaatacagagaaattgacagatgatagataaaagcagtactaaattatcccatgaagagaaaacttcctgaagtttaaatataaaataaaataaaaggcagaattcttgatgctttttctgcattttatatctgtaccttatgtaacagtgaaggtttttctgttgtaattacttcttatttttcttcacttcacaacttttttcttggcataattgcttggcttttcgttcatgatgcagaatttccttgggaaacaggtttttctcatcaaatacagctttcaaagctacaaaatgatgaggaaaatcacaagtgaattatatttgttaagagacctatttaaatgaaatagtggggagaaaattctcaaattttgctttttctaaaaatctttgtttctaaaacacagagtgtatttggaaaaattttctctaagcttctgctattctgtttactgcaatttacatctaaaagttaaattttggtagagtttgttcttttaatgcatatatcttaatagaaatccaccattctaagggtagaggattatagaagttcctgttttccatttttgttttttaatctacttaacagctatcaagacataaagagccaagaaaaaattattctgtattgaaataaggcaattaaaatagtcaaaacacagtttgactgtctgcatgaataaacaagcgcatctataatcacgtccataggggtttgcagttttaggaaaaaaaagaaccaaattatttccatgagtggttatattgcgcatcagtgagaagtaggaggaaattgtgccatacattctagaaaataattttggcattttgcataattttattatttaaacaaatgcttattgaatgtctattatacacaatgttctgtgttgaggcataaatgaggcacaaatatgactaagtcacaacctttcttccaattggtggaaactagaagcagtacccaaataaccaaaacatcatatacaataagatatcattccaagagaatataagcaatgcaaactgtgtataaacatgtaaaagatattataacaatatataaagattttttaaaaagctttaagaattaggtacttatttgaggtaggtcttgaattccagataggactttaattgagaataagaaacatggaggtggggaagaattggcaagggttggataggaagtgtcaactggaggaaacaaggtgaataaagcatggaaaaaaaggccgggcacggtggctcacgcctataatcccagcaatttgggaggccgaggcaggtgaattgcctgaggtcaggagttcgagactagcctggccaatttagtgaaaccccgtctctaccaaaaatacaaaaaaataagccaggcatggtggcaggcgcctgtaatctcagctactcgggaggccagctactcgggaggctgaggtaggagaattgcttgaacccaggaggcagagtttgcagtgagccgagatcaagccatcgcactccagcccaagcaacagagagagactctgtctaaaaaaaaaaaaaaaaaaaaaaaaggaaaaataataactactattagaataactctgaataattcagtacaatttaaaagaagcataaaatatgtgaaagaaagtaaagtggaataaatttggagctggacctaggaacactttaaacaccaaccaaagcatatgaaattaaaaagtaaacattgaatgactttacagtatagtggcatctttatatatttggattaaacacaaaacgaaacaaaaactttccacttccagtgtaaactatactgtagagaggaagttatatagaccttggctacaaaagtcaagatctttcctcttcttctcatggaaattatatgaaagcaaccaggaaaattacagataataactttgcaaataaattctactttaagcaaaactcaaagagagatgtaatctgcagcttacaaaatataaagaagcaaaacagctgagataggacaaaagttgcccaagaaaaagtgaaaagtatagagagtatacgaaggccagcagcagcatcttagaatgtgctgggaaaaaaatagtcactgtgagttacaggctcaccatgaagtacaaatgctttatcccttatatacatggatgctaaaaagaggtgaacatggttggaagcagaagctctctgggacctggtttggatcggtgaaatagatgagtcagggctacctgtatcacacacatgagtcattttttgctaaagcagtctgtccccatgggttgtaaaacttgaaggataccctgatctcacatcccagcctcttactcaaggatttaccacatatttcaagcaaaaaaaaaaaaaatcacctcattaaagctaattaattaaaagaggaaagttttaaaatgaacacagcatgaacacaaacttatataagcaaaaactaaaaccaatcaaattgaagaaagagcagcaaaactaatcaatacatgagccaccaccaaaaaatattgccattgcacaaacattgttaccaagcattttgacaaaaattaaattttaaaaattaaaacagcagttgcctctatgaaggaagatcacagagcagaagtgaaaaaactaagggaggagatgaagacacaagaggaagtgatgaaatatgaggtagcaaaactcagaaaaagagggaaaaaatcacaagggagaacagagttcctggaacatagtaggaaacctagaatatagaaatgagaaaaaatatataataaaatgaaaattataaacagaatgaattagaaaaataataaatgttgaagacagacaaaaaatagatcaacaaacatataattagagtaggtacttgtattaattcgctttcacactgctgataaagacacacccgaaactggggataaaaaagctttaattggacttaatagtttcacatggccggggaggtctcagaatcatggcagaaggcaaaaagcacttcttacatggcagcagcaagagagaaatgaggaagaaacaaatgtggaaacccttgataaacccatcagatctcatgaaagttattcactatcacgagaatagcacgagaaagactggcccgcatgattcaattacctccccctaggtccctcccacagcacatgggaattctgggagatacaattcaaattgagatttgaatgggaatacagccaaaccatatcagtacttaagaaagaaaaccaaagtataacaaatatttaaaggcatcatttaataaaggtcctcaaataaaagtcaacctgacatatgttgaaaggacacattgtgtactaggaataattgacttagaatactcaaaaccaagtgatatcccagtaatgttattagactttagagataaagaggaaatcttctggcaaccacacaaaataatcaagtcacctaaaaaggagaaaagtatcttgcattagatattttatagaaatgaccaacaccagaaaagagtagagcaatgcctacaagataatcagggaaagaatatgtaagctaagaatattacatacattcaagttgtccttcaaatccaaaaactataaatggtgtcaatatgcaagaaatttagggattattgttcccaagagtcctctttgaggaaatttcaaaaagctaaactgaggccaggagtggtgactcacgcctgtaatcccaacactttgggaggccgaggcgggcggatcatgaggtcaggagatccagaccatcctggctaacatggtgaaaccccgtctctactaaaaaaaaaaaaaaatacaaaaaattagtcgggcctggtggtgggcgcctgtggtcccagctactcgggaggctgaggcaggagaatggcgtgaacccgggaggcagagcttgcagtgagttgagatcgtgccattgcactccagcctgggcgacagaacgagactctgtctcaaaaaaaaaaaaaaagctaaactgagaaatgacagagaaaattttgaaaaaaataacttgctggtgatcactgaatgtatttaagtgcagaagtaaaatggaaacaatgtggagttaaggctgacaaaaatagaaggtaaagtccatgtgcctgacaatgtataaatgatacaattgacaaaaattgtgagcataaaggagaaagaaaccttgtttatgataaatcagagacaaagaataacactgaaaactgacaaatcaactaatagcagtataagcaaatttaacaaaataaaagtaagcataaagaaaatcatgttatggaataaaattgtgtggtagaaggggggtaggagaaggagaaaacaagttcattctatcattactgagcatacatctaatagtgtcttagagaaatgaagaactagagcaataagatgaaaatgaataaatctgcaactggcattaagcagagataaaatgaaagatagtattttccatttgcctaataccagcagtatgagataatgtggataactgtacatcagcagctgatcctgtcccatatgactgcagattagcactttagaatcacaagcaattcagaatgcctttgagcccttctgaaatatattgtaaaagccagaatgttacttccgaaattctgttttattgagatttgtctctcaactagacgacaaattttcattgtaattgactgggtttcaaggccattaacccaatagctaactgataagtctgtaagatattaagagagacgaactcacttggatgactcatttttaattttttttctttttagttaacaaacagattataaaaagtacatatgcaggggtggatccctgtttcttgggcctgaaagttacaattttggtagctctctttagaaaaacagaatataaaattacaaatataaatttatttataaaagtggctatttaagataaaataaatttcaacaaattactagtaatttttagagttaggtccttttctcctgagatctctttttaaaaagatacctgaaatgcttacctggaaatgattgttgcttgtaaccttgcttctgctcttcacctagaacactctcaaactcctagcaatttctaatactcaaagggtctttatagatgaggcccagaaaacctaaccttcattagcttcatttgtaaatctatatgtggcaaaaatgatgtcattaacttaacatcttttaaatgcgtaatggtaatcaattcttctcactattcatagtaacatctgctaagttaatggcataatgattttttatgatactcaacagagtatgcagtagatcataatacatgtaagaaataatcatttattgaacttgcttacaattatttttaaaatgtccttaaccttgctgtgatgactttcttgatgtattaagttgcctagggtaaagtccacagttatgaagtcaaatattaatataagtgttgctttgaagggattttgcaaatgtagttcaagtccctaatcaatgaactttagataagggagattatcccggattatctggtgagccagacttaatcagataaaaggccttaacactggggcctgttgtggggtgaggggacaggggagggatagcattaagagatatacctaatgtaaatgatgagttaatgggtgcagcacaccaacatggcacatgtattcatatgtaacaaacctgcaggttgtacacatgtaccctagaacttaaagtataataaaatatatatatatgtataagtgaagaaattctaccaatgaaagtttctgcctgtgccgagcctgccatgatcttttcttcttgagttagtgctacatattttgaacttgctcactcagcccaacaaacccataagtcaacttcttgtaataaatctcaatatgaagtcctgctgattttacttccctggttcccctctgattgatacactttccatgaagtacactatcacaggatgatggcaaaaaaaaaaaaaaaaagtgatgtgttctttttataacaaacaggctgatttgtcaaatttcctgtggtttgtggctggagatggtggaataccacgggtaaaaaaaaaaaattatgaaccagaaataccatttgactcagcaatcccattactggggtacataaaggactataaatcattctactataaagacatatgcacacgtatgtttattgctgcactgttcacaatagcaaagacttggaaccaacccaaatgcccatcaatgatagactggataaagaaaatgtggcacatttacaccatggaatactaggcagccataaaaaagaatgagttcatgtcctttgcagggacatggatgaagctggaggccatcattctcagcaaactaacacaggaacagaaaaccaaacaccacatgttctcactcataagtcggagttgaacaatgagaacacatggacacagggtggagaacatcacacaccagggtctattgggtggttggggggaaggggagggatagcattaggacaaatacctaatgcatgtggggcttaaaacatagatgataggttgacaggtgcagcaaaccaccatggcacatggatacctatgtaaaaaaccttcacgttctatacatgtatcctagaactcaaagtaaataaaaataaaaataaataaataaaaataaaagttgaaaaaaaagaaaatgtatgtatacttgaatacacaacttagacatagaattcagcatctggatggcaaggaagcacaacaagatttaggacaaagctgaaacccaatgcaaggaacccaaggaatccaataaaatgatccaagagctgaaatattaaatagctattttaagaacccaaatgaacttctagaacttaaaaatttactacaaggattttataatacaattagaagttttaacagctgaatagaccaagctgaggaaaaacctcagcactcaaagactggttcttcaaatcaactcagtcagacaaaaatagaatttttataaaaggaacaaaacctctgaaaactatgagattatataaagagaccaaatctaggactcactgataatcctgagaggagagaaaataagcaacttggaaaatatatttgaggatatagtccacaaatatttccccaatgttgctagagtggttgacacacaaatccaagaaatacaaagaaccctggaaagatactataaaagagggccatccccaaggcacatagttagcagattcaccaaggtcaatgcaaaagaaaaaaaaaaggcagttagaaagaatggtcaagtcacatacagagagaccacatcaggctagcagtagacttctcagaagaatccttacaagccaaaagagattggagacctattttcaacatacttaaagaagaaaaattccatccaataatttcatatccctccacaccaagattcataagtgaaagataaataaaatctttctcagacaagcaaatgttgagggaatttatttcaatgtgatcagccgtaattacaagagtctcttaaaggcatcctaaatatagaaccaaaagagcaacacctactaccacaaaaacacacttaagtgcatagcccacagttcactataaagcaactatacaatcaagtctacataacaaccagctaagaacataatgacaggatcaaaatctcacatacaagtactaaccctgaatgtaaatgggctaaacaccttacttaaaagacataaggcggcatgctggttacaaaaaaaagacccaaccatctgctgtcttcaagagacccatctcacatgtaacaatgcctacagcctcacagtaaagaaatagacaaagttgtcccattgaaacagaaaacaaaaaagagcaggggtccctattcttaaatcagataaaacagattttaaacaaataaaaattaagaagggcatatgcatataatccaacaagaagatttaactatcctaaatagacacataccaatcattggagcatcgagattcataaaacaagttcttggcctatgaaaaaaatttagacaaccacacaataatactgacagacttcaataccccactgacaacattaaacagatcttcaaggcagaaaactaacaaagaaactctaggcttaaactctacacttgatcaattggacctaattgacaactatagaacaccccatggaacaaccaacagaatatatattcttctcatcttcacacagaacatattctaagatcaaccacatgctttctcacaaaacaataaatgtcattcatttcagaattaggaaaaactattctaaaattcacattggaccaaaaataaagagcccaaatagctgaaggaatcctaagcaaaaagaacaaagctagaggcatcacattacctgacttcaaactatactataaggccacagtaaccaaaacagcatggtactgacacaaaaacaaacacatacaccaatggaaaagaataaaaatctcaaaaataaagctgtgtacctacaaccatctgatcttcaataaggcctacaaaaacaaccaatggaaaaaggactctgtgttcaataaatggtgctgagataactggctaaccatatgcagacaattgaaactggacccttatctttcaacatatacaaaaattaactaaggttgaattaaagatttaaatataagaccccaaactggaaaaattctggaagaaaatctaggatatacccttcctgacatcagccttggcaaagaatttttggctaagcccccaaaagcaacggtaacaagaacaaaagttgataaatggaacctaattaaataaaaaagcttcatcacagcaaaacaaaccatcaacagagtaaacagacaacgtacagaacgggagaaaatattcacaaactattcatctgacaaagatttgacatccagcatctattaaaagaaaaacttaaatcagcaagcataaaacaacactatcaaaaaatgggcaaagaacatgaatggacacgtcccaaaagaagacatacaagtggccaagaaacatatgaaaattactcatcatcactaatcatcagagaaaagcaaatcaaaaccacaataaaataccttctcacaccagtcaaaatggctattattaagtcaaaaaacaacagattcttgcaaggctgtgcagaaaagggaaggcttatacaccattggtaggaaggtaaattagttcagccactgtggaaagctgtttggagatttcttaaataacttaaaacagagctaccacttgacccagaaatctcactactggaaatacaccaaaaggaaaatgcattcatgtgttatcaccatgctattcacaatagcaaagacatgtaatcaacttaggtactcatcaatgatggattggataaagaaaatgtgatacactcaaacacacacacacacacacacacacacacacacacacacacacacacaccatggaatactatgcaaccataaaaaatatgaaatcatgtcttttgcagcaatactgatgaagctgtaggataaaatcctaagcaaattaatgcaggaacagaaagccaaataccacatgttctcacttataattaagggttaaacactgagcacacatggatgtaaatatgataaaaacagtcactatggactactagaacagggatggagtgaggggcatggtttgcaaaactacctattgggtactacactcattacctgggtgcaatatacccatttaccaaacctgcacatgtgttccctgtatctaaaataaaagctgaaatttttaaaaagtaaaaaataaagtaaataaataaatacaaagcttatcttaaagcaccctcaagttcccatatgatcacaagcttaggaacctcaagcctccaacttcttgcctccctggccacataacttatttagaatcctggacagtagtttgctcagattagtgagaaacagccagtgtctagatgaatcaggtcacattcctctttaaatcctctgaaggcttccctttatacttaaaccaaattttttgcccaggcaacatggtcccacatgacatgacccctgagccccctctaatctcatctgataccagtctcctcactccattctagcaatggtgacctcttttctgtccctggaacatgtcaattttgttcccagtggttttatacttgtttcctgtgcttgggacattctgccccaacatctttgtagaactttctaccttaggatttagcttaaatgtcagagagaccttcactgatgttcttcctaatgtcaccttattatattatcttgttgtattttcttcttagctcttatcaatatcattctccaaacttatcatctttaactatttatctacttattattacctatctctcttcctagacaataaattcagcagcagtagactttgtttgcctttgtataccatatatccctagcacccagcattgtatctggctcatggaaaagggactcaaaatgtatatttgttgaatatatgagcacatgaatgaaggaactttcaggcatgcaaaggggttggctcactcctcaccctttggaatccctgcattccagagacctggggaccctataatattcataaaagggtgattctccatgtcacatatatacatatacatccatttaaccacaaccaagttcttaaaaattaacatctagtgttatcagtaaccacttacattcactattccctacctgggaaaatatgacatttatacactcatcacttcactttatagttggctgcctgacaaggtttattataatgatagccaaaagctgttttcacagtgatgaaaaggaaagatgtggtggtcaggaaagtatccaaaacattttttctataataaaatgattcaaggatcttaacatagaagaattggtttatatattgtcttctggtctttcccttgcctgctaattggcaactaactatatcagctgaacaacagtggcaaaactcacaaagataccctggcaacaaaggacttggcagctatgtaatgtactatgcaatgactacctgtctatgagtgtacagcattctgaaaactcctttctaattcacattcttcctcctattctgtgtcctattttgcgtcttctagacaaattcttatttatcaaacttatatgtgcataagaatcacctggagttctcattaaaatacaaattcccatgcaacagatctggggtgggtcctgagatgctgcatttctaaggagctccctggtgatgcccatgctgctatccactgcccacatcttgaggtcaagcttctgatttctaaatctaagctctaggtgagtattgtcaaatgtccttttatttcagccaccatccagtaacaaacaggcaacaaagcaacgggttggtgagaaagagtggtgatgattaatcaaaatactttaatagttttcatatgactctcaaataatggttgcttgggacctgttgaaccttttaaatatgttgttcacatattaatgacttctgttttatagacccaaaattttggtctgtgtgtgttgtatttgtgaattttgagataatttagtgttatgtaaataaaaatgtagagcaataggaaggatttctactttttaaaatgcccctgagttttctgttcattctggatgtttagtatccaaaaggtcctgaggtgagccatgtgtagcaatctctcatttatcatatagtcaatgcatgtatctacaaatgctttcttcctacattttaattatttgttcaagtaagaacttttatatgatatcaaagattatttttctttaccggtgctagatttaaaattatactctaaaacaaagattttaataaaagcttatgtgtatatttttgacctgtagcttaagggctaatgtgaaacattgtgtgtttcaataaaacactatgtattgtctccagcacacccttctgggttgttagattctagttgagttcactgtttttgaactatttttgcccctcttttcaattgcaagccactgacggatatgcaaactttgttttatctgctagagatttgacttcctcttctccttggaaacaccactttcgggatctacttgcaaattggactggtctgctaccttgcacaaattgtcaactctccaaacttttcaatcttatgtgttttttttcaacatttaactacaactttccaaattaacattttcagtttttctccctcccacctaaggacattaccaagaattaaaacctgacatcccagatccctatacagacttttggttgccttgcagctgtccctttctcccaggatcgttgggacttcaaaacagctgacctttgccaccacctggcaatataaattcaagtggttttgtaggagcaacatcaacaagaacccctgagagactatttctgagactctgctttgccccacccgggagctttagaatcacttttaggttgttcagcaatgagtgatattcatttttcttaaacacaagggggatgagactggcgatgctgaactttacctcagtccagtgctcctggaaagtgaagacatttaagaaatctctctacattttcatgttctagaaacagctaaccacaaaggactcctctcctctcatatattccaggaccctctctttccttcctcttgagtcctataagaatcacagatgacttcctcatctacctacctctacaaaagctcagacctcttttcttttctttgagatgttcctgtttaatgaactttctccgtattgcagtaggctgaataaaaccatctctttaattgtttcgtacattttgtctttcacagagcaacagctacaacaaaacaagtcacctgaggtatcattaatagagcattttctccacactgtttcaagttttaaagattttacagatacaatgtgaatgggttctggggaatttattggcaaaacctgactcagaggcagttctaagtagcttccaggattttgaataaggcatatcaaagaggggtttcaagctgtttaagaaccaactgggagcaacttgaaagctaaagggaaagtgtgaagaaagatgtttcaagttgaaagggaaagaaacagaatacaaaaggacataaaaaacccagcaggtatggctaaaacatcacctggggattttaaagtgtttgaaaactgtcccaagttccaaagtgagagtttaggacattgaaagtgagactagcaaaatgcctctcattgtacaactgccaaaaacctatgcacgaggtaattacggagattgcagcaaagtggaaaaaatgcagtgcaaagacgtaaggtagcctctgcaatgatagtgtgcaggagaaatatattggtaattgaagttttttttttttttaagtgttattttataataacaatttttaaattcatcagtatccttctgaaaaggagaggaacaattttaaatgaaaataataaaaataggtaatacagtaaaatgactggttttagaaataagagcaagaataagctaccagggaatttgatttgaatactatttgaacaggggaggctgaattttgaaatattaatagcataaacacctgagtcagtttttcagcattcccatctaggctctacctttactatctatgtgaacttaggtcaattatttaaattctttatgccacaaattctttatatagaaaatgtggggaatagtaagtcccacattgtagaactctttagtggaataataatacagggcattaccaataaataaaatgtatcaaagtcttactgggtatcaggcactgtgcttagggcttcacatgggttatatcatttaatgttcacagaaacattatgatgataactaagatgaagcctattttcagttgaggaaactaaggcacagaatgtttactcgaattgcttaagtttacaaagctagcaagtagtagaaccttgttttgaaaccagtcttatgcttaaaatttcatctttatacatttatcgtttccatggcttattctctttataaattgtaattcccacccccaccccaaaagacatccattatcacctcataacttatcgggtataaaactgtaattttgaaggtcccaacatgacgtagaaggaccaggagtggagaacaagcatggagaggcggataagatgagactatgtccgttatcaatgtattgcccaagctttttgatgcctgctctgtgctgacagaatcaagcctacaatatgtctcctttgctagctgtcatgatgttgagctctgtcactaaagagtaatggagagacactggaggagaaatggatttcttttccaagttccaggttctctgtgctcctctcccaagaatcctgccctgcagtttctccagcactaggctcttatagcatgacttctccagtaccaagctctcgcagtgatttttccaacaccagactcctgcaatgcaggtaaggcttctccagaacccagagctagcagtttcccctgtcagcagtatgccacctatctgataccactccatgaacggttttccataatatccttggcaagcaagaggccaactgtgtgactcttccctgtgaacagccttccctgtaccctcttattggttctgcagtgagttctgagaaacagcacctccctgtggatagtttctcctggaaccctggtggtggtttctggtaacttccacgtacagcatctccgtgggtttgccattcagtgaggcatggaaaacactgctcagccctgggatgggtgggactcttccttggtcaatatatctcaggcatgagaagtagtggctgctctttcattttcctattcctatattccttagagttctgtttacttcttactagtcaattttctataatacgcatgtatcaaatataaaatcagaacaaaaatattgaacctaatttttaaacatgtctatcaactatagtttcttttcagttatcacttattctttttcctttctatgatggctagtttctcagaaaggtgtcagctttctttagtaggtgtcccataggcacctccatctcaacatatcttagaaactaatgtcattttctaactctatcccatcttcgtctgtatttcctctctaaatgatagtctttttacctcaacatagatatccaaactagaagactgatcggcatacatgtattcatctcttattgggcacataatcctttaaattcaaactccttaatatctctcaaattagttatttcctttctaggttttccttatcttcaaaatcataatagacatcatctagtgaatggttagtgtgctagctattgtgctataattaacccacataactccaagaggcaggcatcattatcccaattttacagatgaaaaataaactgagactgaatagggtgaataatttattcagatataaacaaatagtagaaggcgaagtgatgattcaaaagcagagagctgactgcacacagcaagttcccattactataatattgctgccttcagtctagccccattataaggcatctaccgcagttttcagaacgctttctaaaatgcaaatctggtcatgacactttcttgttttaaacatttcaacaggaattttctttctggataggatttaataggtagttgcaggttatcattctcactgcaccagataggaaaaaaaaaaacagataaattacaaatgatatgtttaaagccatcagaaggccgtggaagcagtgatgaccaaaataactaaattccagagatggtagggcccttcctagatgagctaaaattgccaagtattttcttctttctggggatttattatgttttggcattgctaagaaacagacctgcattcgactgagagactctctcatgggaaagtaaatttggaagtgttttgatggctatgtgggttggtgtgatgtattggaatctagagaaatgtcacagctttggccagtctttcccataggacattctctgagccctggggtggtgtgggagactgtggattggactgaaaatgcagagtaatgttttctgcagttttgcagtacgtgggagacaataccccactaaaaggagaagcctaaagcagacatttgaaatcagaagtggactaagcctaactaaatctgtacctcagcactgacccggctcaagtactaattagattaaggtcatcagtgtctcattctctctgccgaattaaggaaaagagtgaaccattgctgacagaaaagaatattaatttcagtgtctatagatcttttaaattttctgtcatacaataaaaaattataggacttgcagagaagcaggaaaaatgagactaaaaaccaagaggaaaaatatatatattagaagcagacccagggattatccagattttggagttagtcaaccaagactttaaaaattaccattataaacatgtttcaaaaacagagggaaaagatgaacaaaatggatgagaaaaatttaactgagaactagaatctgtataaaagagattcaagtggcattctaaaactgaaagtatataaatatgtgtgtatatatataatttcagatatacatacatatataatctgaaactgggaactgattagatgggcttaaaagcagactggtcaatataaaatatacaaactgaagccaacctaaggaaataaaatgtttttccattttatttattccattatttaattccacttattaaaagagcatcaaaaacatttgtgatataattaaacagtctaacatatgtgtaattgctattccataacagaagagagcaggaatgagaataaaacataatttgaaaaaagataatggctgagaagtattcaaaattgaaaaaagatgcatttgataaatttctatgaactccaagtagcataaatacacacacaaaaaaaacagtacttagactcatcacagtaaaacatctgaaaaccaaggctaaagagaagtattttaaaagcagccagaataagatgcatcaataacattaagagcaggattttaaacaggaactatggatgcagggaaataagttaactttaaaaatttgaaaaaaaaaaaaaaaaaaaaaaagcaacaaaacaaccctgacatctagagcttcaaatccaatgaaaaatcctttcagagtcaaaatgaaataaatgcatttttcagacatgtaaaagctgggaaaattattcacaagcaggcccatattttaagaaattctgtagaaaattcttcagactgaaggaaaatggtctcagatgaaagtctagtgccataagaaggaataaagagcacaagaaagagcattgtaacttctagaacaatcactttaagaataatacaaataaatatgaacattgaagaggtaatataggatataaaattatataattcagaatgattgattaaaatatttcaatagctccctatttctgattaaataaatgccgagtccttagcatagtttactagatggtctgtggtctggcccccacctacctgtctagcctcattttcttcatgctccttctagaacccagccagtgggaactacatgtagctttcttagcacaccatattattcataccaccttagagctgcttataccactcctctaccagagtatcatcccccgctattttttttttttaacctggctcatagcaacttaacttttaacatctagctcgggtatactctggtttccctgaaaagtcatctctgaattttcatgtgttcccataggatgcagtacttatctctaccatagccctcgttgtagaatataattatttgtctacttatctatttccccacttcaatgtcaagatctctgaaggctaggtatctacatattatctctgcgtctttagcatccagcacaaatgctactatatgtaatatctatcctaggaaaagctaaatacaaaaatgaacaaacattatttcagtatctgcttgtcaaagactctatgatatcacagagtgtatatacaatctgcttcagtcctccagaactttatttgtaaatggtgcatcagtaccccaaacttaacacattccaaacacatttgactttacctctactaacgagaggtaaatgtaaaactcagttaatgtctcaatatctgaagtcattcattgtagccaacttgggttcattttgacttctgctccttcctcaaccttgatatgtccttcctcactatttccttgttttctccctcacctttgacctcctactcatcctttaagtcccagctcaaatgtgactgaattctttcctatgctccagccagaatgaatcgaacttttttcctggcattttcatggaacctcattggtggtgtcatatgtcatcaataatttgcatcattttctctcgcaagtagtcatcaataatttgcatctttttctctcacaagttggtgaagcttttaaaagaaaattattttcacttgcagaaagggcaagtaagaggaaatattttcaaaacagggaagtaaaggaagaaaaattgaagaaagaaaataaaaaaccaaaagaaagaaaacatcttttaaaaactttggggaagttacaggaaattttaataagaaatccaggggaaaaaattctctttgagaatttattagagtcttttaggtattttggttatttctgcccagccattaaccccacctctttgcccacactttttccctgcccatatgaagaattcatctgtggcttccttctgccacagattatataaaagattcttcatagaagcaggaactctcaccactgaagagaggtgtttgctgctctcattatttacctgtctcttttgcttctttcctctccagcttttgcatattctctgtctcctcttcatcttgcctcaattctgaatccattttctgtcttggtttcctcctgaatgcctaccctgtatctggactatctttacaactttgtcctatgtctggatctttttttactggtcattcctgtttcatgtctgtttgtggctcacaaagacaagataagtacttcccatattcattctttttttttttttttttcaacaggctagtgcagtggcacaatttcggcctccaccttccgagttcaagagattcccctgcctcagcctcctgtgtagctgggaaaacaggcacgtgctaccatgcctggctaattttttgtattttagtagaaacagagtttcaccatgttggccaggatggcctcaatctcctgacctcttgatccacctgcctcggtctcccaatgtgctgggattacgggcatgagccaccgcgcccagcccccatttcattcttaaaggtgaatcatcctggtgaaaagtgatgggatgacagactgaaatccttatcagacacactaagagttatttagagctgtagagaagtttaaaccttccctctggaggttgggcaattgagcttattgaagtaaattgaaaatatgaagattaacagggaataatatacaaatgtattaatgtacacatatgtatgaaaaccccacaaaatatgagactcaaagaagggcctgagggttggagcttaaataccctattcacagagaagagggaaatggcaaatggcagggtggaggggggagggtgagaggggtagccaattttagaggaagagtaaatactttctaaaggaaatgaatgagtccaaggaacagaaaatagcctgggacaaagtttctctgtgctctgggggaggtgatgacaagttttaaaaggtgaggggtagaactgcactgtgaacaaaggttgtcttattatgcaggtagtctcttaggttaaaaaagagttattttagagcaccctccagagaaataggcaatagcctgtttaggtgtggtaatgacttttaatttctcctctgataaataacatttcctggttgtttgatgagattcctagagagggggttcaatacagttgcatttctttaggaagaaccctcctcagtcagataagggaatttcagagagagccctccctgaactttgaaaggaaaagtggggtagacagcaggagaaggtaagagagagactggttccgaggcctttcaatccactttgttcaaagcactcaacatgccaaagtggcatattttggagtatcattttctgagcccccaaaagagccctaaagttatggcttcgtttttaagagaaatgagtagaaaccatagattgccctcacaagagcaagcaaagagaaattctaagaaaatgttttttaaaataaaaaaaacaaaacctgataataattagactgtaaactatggtaatgaagtatgacagctgtaccttgcctataagtagaatttcaacaacaacaaaaatgttgaccagctgttctccctttccataagagacaaagcaaagaggagactcttaaactcccctaactgtggacataaggaaacatctttctactgcaaacattattatttctcaaggatgatgttgaaccccagctcagaggattttagaagttttgaaaccacagatctcagatagcttcatttaattctgattttttctgattgttacaagttgaaaacttaaactttttattaattattttaaatgagcttcccctgcagtgtccatgtgctttctgagtgcttcactgagaatcaggttgtgttacctgttctttcacaggacccctctttgctggaagaatttttctacagaattattcctcaaacttttaagaactctgaagactataatagtctgaaaaataaagaattattttgtacatcttgtttctatatctttagggatcattcacttatagtttctaacttaagctttcttgtcttctcaccacaccagcctaccactgcagctggaagactttaagacaatacattttaagtcgtctctatttagagtgtttcacatgaaaataaaacaagattgccagacactgtgttctaaagtggtcttatgatggcttcctccagcatcagttttgaaaattaaggttatttggggagagagattctcatccacggaagattcatagatacatgttcatggcattctaacttcagaaaaggaacaaaataaaaatattcatttcatatatcccagcctgttggctctcctatctgagagcacacttcagcagctgaactataaatcttaacagtcaaaccacactttgtttcactgcaaactacaagacaaacacttgttattttcatgctcttctactctatttttaaatgactaagtttcctgaagagggataatagaggtgtatgatggctgagaacttacttttaaaaagtgacggggcctccagaatttggggacgctcttcctctggttctttcctaaagtatttctcagggtctagaaggaaagcaggtttattcacttcaggcagctcttccagggctccaatgtttaatgacctaaatgtaccttcacaacagcaggttttagaggaagacagggagaaaaagggtacaatatcattaactccttggaaagagccagcacatttccaagttaacttttataaatttaaccttcctgttactcagctggtacagctgcagtgatctgcaaaccctacaaacacagctgttcaaaataaatccatagtgctttttattcaaaggaaccaagaggaactcaaggcttcccattcatttttttttattttgtatttttctgctattttcccttgaaaatgaatattctgcagttttggaaaagctccagtttttcttttatctacaagaaaattgtatcttttgtgaaatggaatctatttttttcagtgtttagtttaacaacacatctaaaattttgaattggcaggtactttttaaataatgtcatcaagtaaaccagagctgcgttattgtatttattatgcacacaatgagatgataggaatctattttaatcatgctcttaaaggcaaagtcttgaacaaagtaaaagatatttctctttgcttcatgtagtaattggataatagaatggaaatctatttgggataaaattttatgtttctttgttagttctgtgaaggtaggaactgggtttttgtcacgatggtgactcagtacctaagaaaaggaaactaatccgtattcagcacctgctatggaacaagtcaggttctatgtcagtggatttcaaactacaacaggcatcagaatcatctggagggcttactaaaacatagactgctatgtgacccccttggcttctgactaatggaggaaagcagggatgagggtctcataatttacatttctaataagttctagttgatgcttacggtgctaggccagggaccactctttgaaaactaatgtgctatgtcaaattagagaagaaatcttcacaacatgtaaggtatcgtgccattaagacagatgaggaaactgaggcttaggatgcgttagtaatttgtgtctcagttcatataactgttaaatagcagatcatggacttaagttgaaatatgtttaatcccaaaggttatgctccaaggtataacaataacaacattactaataagattgtattggttgctataatatgccaggcagtagtcaaagtgctttacatatctatctcgtgtaatcctaacaaaaactccgtggagtagattagttgataaatgggcattgaatgttaacaaataattatgcaccatttttacagcaaaatttcatcagaaatttaaaaatcaacatatctgctctatgaaagtgtgacattcccttggacataagttgaaaagatatttgtagtaagtaacatattttcattataaaataaagcttcaggaaggattcttatctgtttctaagcaatataccttagtataataatgactcctttgttttaggttactggtctttaattgttttctggtccgtcaacaactagactaatgcattgttctgtgtggcttcaggatttctgacgagcaaaaatagtttttattcatcttcatttcttaaatacttaagggaaagaataaaaattctggtgccatctctttttttagaactgtatcaggtacttcacacatattttctgactaatatagtaaggatatttgtcccctctgaatctcatgtggaattgtaatccccagcattggagatggggcctggtagaagatgactggattatgggcacatatttttcatgaattgtttggtgccattcccttggtgctgtttttgcaatagtgagtgggttctcacaagatctgatggtttaaacgtgtgtggcaccacccccagcttgctcctactctcaccatgtgatgttgcctgcttccccttcaccttccaccaccactgtaaggtttctgaggccctcaccagaaggtgggcaaatgttggtgccatacctgaacagcctgcagaaccgtgatccaattaaaccccttttctttataaattacccaatatcagacatttctttacggcaatgcaaaaatggcctgacacagaaaattggtaacaagagtggggcattgctataaagatacctgaaaacgtgcaagtggctttggaactggctaatgggcagacgttggaagagtttggaggactcagaagacaggaagatgaggggaattttggaaattcttagagactggttaaatggtagtagccaaagtcctgatagtgatgtggacagtgaagtacaggctgacaaagtctcagatggaaatgaggaacttactgggaactggagcaaaggtcacccatattatgccttaccaaagaccttagctgcattgtgttcatgctctaggcatctgtggaagtttgaacttaacagtgataatttagggtatctagcagaagaaatttctacacagcagagcactcaagatgttccctggctgcttctaatagcctagcttagatatgggagcaagaaataaaggtggaaattatatttaaagaaaaagcagagtataaatgtttaggaaatttgcagcccagtcatgtggcaaacaaacaaatttaaaaaaagcattatcaagagagaaattcaagcaggctgtggagcaaccacttgctaaagagatctgtataactaaaagagagccaagagctaatatccaagacaacagaaaaaaggccttgaaggccttctagacagcccctcccatcacaggcccacaggcatagaaggaatacaccactgttctccatatccgtgcagctccagctccagctgtggctcaaagggccccagatacaactcaggcagccactccagagtgtgtaagccatagctttggtggcttccacgtggtgttaagcctgcaggtacacagagtgcaagagtgaaggaggcttgacaatctcacctcgatttcagaggatgcaagagaaatcctgggtgcccagcaagaaacctgcagcagggcatagccctcacagagaatatctgctaccacagtgctagtgttactggggtgtccttgctcccagagctcccaagatggtggcgggctgcttccaaaatggcggtgggccacttccaagatggtggtaagcctcttgttgtctgacctggggttcttggcctcacggattccaaggaatgggccatgcggtgagtgttatagctctattagaagccgtgggtcatggaagagaaccatggaacccagtgactagtgttcagctcaattaggacgaaccagggcacttagccgtgcaggaacaatggcaagcctttagcccgatcgggagcagcaatgagtgccttgctggatcaggagcacagcagacaccctgccagatccagagggatggaagtcagcggtgggtctgtgaaggtggccagcagcagtggtggagggcgactgaaagctcagcccgagccataacaaacatggaccagaagagtgcagttgcaagatttaatagagtgaaagcagagctcccatacaaagggaggggacccaaaggtggttgccgttgccggctcgaatgcctgggtttatatcccgatgcttgtccctcccgctgtgctctcaggcaatagatgattggctatttctttacctcctgtttttgcctaattagcattttagtgagctctctgattggtcaggtgtgagctaagttgcaagccccatgtttaaaggtggaagcggtcaccttcccagctaggcttagggattgttagtcggcctaggaaatccagctagtcctgtctctcactagtagaggggaaatgtggggttggaggtctcatgcagagtccccactggggcactgcctagtggagctctgtaaagagggccactgttctccatacttgagaatggtagattcactggcagcttgcatcctgtgcctgaagaagctacaggcactcaactctaacccatgagaacaaccacaagggctgtaccctgcagagacacaggggcaaatctgtgcaagaccttggcagcccacccctggtgccactgtgccctggatgtgcgcatggaatcaaaggagattattttggagctttaagacgtaatgactgccttgctgaatttcagacttgcctggagcctagagcccctttcttttggccagtttctccttttagaatgaaaatgtttatccaatgcctatgcccccattttatcttgaaagtaaatgacttttttattttacaggcttataggtggaagcagcttaccttgtttcagatgagaactttgaactttgtacttttaagttaatgctggaatgagttaagactttggaggactattgggaggaatggttttatttttcaatgggagaaggacatgagatttggaggtgccagggatggaatgatatagcctggatatttgtccctacccaaatctcatgttgaaatgtaatccccagtgttggagacggggcctggtgagaggtgttcaggtcatgagggtggatccctcacggcttggtgctctcctcatggtagcaagtccacagagatctggctgttgaaagtgtgtagcacctcccccactccctcttgctcctgctgtcaccctgtgatgtgcttgctattgcttcaccttccaccaagcagataccaacattatggttcctgtacagcctgcagaactgtgagccaattaaacctttttctttttaaataaattatacagtttctggcatttttttatagcaatgcaagagtggtccaatacactgactaagaccttacactttttccgctagtattctgtggagccttggacaggtgacttaatgtcctgtacctcacttttctcctttgttaaatggggttcacagaacattacattcatgtttattaaggaataggaacattcctgacacacagagtagacatttgtattcacactaatctgttaaataatattataaaaatacattaacaacagtgactacttactgaatgatttttttataacttcaccataataaggtttttgtgtttctttcatgcaggtacttctttccttatattttatatctaaatttatatcttctgatggtctgacactggaagaaaatatttcatgatgaaatacattattaaccacagggatggagaaactctttctggctatgtgtatctttgaccaaaaaaaacaaaaacaaaaacaaaaaatctattcctgtgaaccgaagtagtgatatttgtttatactaatcaagccctatcttttaacaaaatgcctgctagccaggtgataatagaaaagagtgagagccagagtgtccaagagtctaattaagcaaagccctgtccccatagcaacaaggttagagaaaaaattatttagaagaaaattttacagaaacacgtacattatccttgccttattaataaattatataatgagaagtaagcatcaatcctttgtgtcaaagcttatttattcagtgttaggcgtgtatctttatggttatggcatccaaaatgcaaagaagttcagtatttctgaggctttctcatatgaatctataagaaaattttagcgtaacttgaattcacagaaaggatttttatcaataaaacatgggaaataaaatcattacatagctgtatataatcttgtgagaaaatagaaaatgatctcaaatctatttaaaattcactgtcatagacttcaaccttaacagctacaagttatgtttccaaaaattgttattagtatcttcagagcaccaagccagaaaacacatccatcgtctcaaaatcgtggagagtcctggggatcttgactcaccctcttccttctgcctcccttccctgcatccctcagccctttatagttaaccattcttccactccctaacttttattcttatatcttctatggattttgtagctataagactctgagttgtttcccatactttcagcctcaattttcccctcaatgtaatgggactcttgctgtggatttaaaggagataagatggatgaaagttcagaaatgtgcctaataaataatagcattcaagtaatgttcatttccagctttctttttcctccactctatttttaccgtatcttccaattttaaaagattttaaaatatcaatacaagtaaaaagtctgtgtatctctcttaaacttaatatcaaatgctatttgcatggctttaagtagtaatgtattaatttctttctcatatataaacttttccttttagaggttttagatttgcagaaaagttagtagagctccagtatatccctcagccaattttccctattataacatcttacactaccatttgtcacaataaagaaatcaatattggtacagtactattaactgaattccatattttattagagttttactagttttttcttaatgtgatttttctgtaacgtcaacattatattttgttgtctaactccttagcctctggcctgtgacgatttttcttgtttattatgatcttgatagttttaagaaatacttgttggatttttttggtagaatatccctcagtttgggtttgtctgatattcttctcatggtgagactggggttatgagttgttgagaggaaagcaacagaggtgaactgctgctcttattgcatcaaaccaagggtgcatgctatcaaactgacttccatggttgatgttaacctcaattacctggccacagttgtatgtgccaagtttttagtaatgtttacaatagctactgtacagttactttttccctttttccatatgttactctttggaagcaagttttcaagcacaatgcacatttaagaggggatgggggggtagttaatcatgatttccttgaatcaggagagtattaacataaattacttggaattacagatttttttttcttttaggagagctttgtcattggataggtgggcagtttttccccaattgcactggaatgacatccctctccataagccatctcatgtgagtaagaattagtatttagccactatttaggctttcaagacaagaaataatgatatccttagagaggtattttaagatagtaaggggatctacaaaaataagaagttggtgttggatactgaaagcatggagtgtggtacagttaggccttgcagttattggattaagaatacacctttttctagaaaagaattattcatgtaaacatgtgcaaaagattgagggggcaggggccacggtaaagaggtttccctttagagtagttaacaatatatcttgatttttttttccaaaacactctaaactcttccctgttttcagaccatatgctttctgactatctcatcctgtggaatctaaatcaagtagcttttatataaagcaaaacattttgcccatttccactaaagagttttatccacagagggagaaaagtagtcagacggtaggagagaatctcttggaaatcacaacaaattaagtcaacaatctattgcttccttttcacagacagacatctgacatttgcaggagtggttactctgaaaatgcacagggaactggaaaaaggcaaatattctcaagaggagaagtgatggatgaagacaaagaagcagaataatgtaataccaggcttaaatagagttttaaaacattttgcaaaaatgccttagtaggtgatgcaggaaggcgatctactatgggatccaccagctttggcatcaatcctatgaggaggaaaggctctaactaatctcacttctcttggctctggctgtggaagggaggtataatgactgtgacaattactcaagtaccctcctaggcatcaaaaaggaagtgaaaaatgcttagagtagtggcttatacatagcaggtacttgataaaatatttgatggcttgactcagaaaccaataatttgtcaatattttcacatgatgcttgttggacaggcaacacagaacactgataaagtactaactctggaggctgaatgcctgcatttgtatccctagttcacctcttggttggttgaccttgtgcaaatctgttaacttctccgcctctgtttttcaagttgtgaaatggggatgacaatagtagctatcttctaggattacagtgagaattaaatgaggtaaacacataaagaccttagaacaggccctgaaatataatcagggctcagttggtattggctactatcactttaagcaaaagcaagacaatatttttcactcaaagcagggagttctaacacccccctacagcaagctccaatattcttcagaactatcagaatgatcagacaaaaaataaaaagatgtggcactcccccaaataacaatttgctgttctagtatttttaaagttcaaatttcaaaaattgaatagagtatcatatgctttcatttgtcatacatggacataggatagttattgccagattgttggtgaaagtagactgccaattcgtcaagtatttacatcacataaagcctaatttaaaatgggattttaatattttgtgtattttttcttatagctatttatctattttctaatttaatttctcacatgaaatctactgacagaataattaggtaatcaatagcatttaaataatattaaatatcagttccctcctaacaataacatggaatttaaaacatcataattattttccatgtttaagaaacattaatttgaggtgtgccctctgccttgtataaacttactgggaaactagtagaatttttgtttcatttctcatctgagtctttatacttgtttctaataatgaatcccttccagataagcaattttttaaatggtaaccaaaggaaaatgtgtcagataataaaaaatggagtagtttatgctctttgttgctctagaataagaatgaagatcagtaagtgagagttctacagatggattttacttaacattagagacattaagaatagttcaataatagagaagggtatctgtgagatgtgagtgtgtcatataggaactattcaaaaaggctgggatgtgtttctcttaaagatgccataggagttagtctagtagactttgaatacccctttaaaatttattattgaattatcaaaggttaataaacctgaaaaatgtttactttcacaaataatcaaaaactttagtttaaagcaataagatatcatagcgacagttttaagacagcaataacaaccatttttggttcgaaggcaggaaagcaaccatttgtattgctgctggagggagagctgatatgtccagacagcaagatgacctttagcaagatgacccaaaggcctttatgccttttgactcagcaattcctctcaaagaatgtattctaattatgaattcaataagatattctaatatgtgcacatgaaggtatttaaagaactgttttcccagttaaaatttgtaaacagtctacatatttgaaataaagaaaatggttaaaaagctacaagtcattataaatgttgttgtccatggatactcatattaactaatatgaaaatgtgcctactgcatatttttgagcgataaaacaggttataaactgtgtctactaagtcacagttatttttataaaatgtacattttttcattgttgtaagtatgcctaaagcaaggtcttaaaagtgaaatgcctaatgttaacaatggctttaccacagatattttcaccttttgcttatttgtacttccaaattttcccgtaataaaaatgtagtatttttggccaggcacagcggctcatgcctataatcccagcactttgggaggccgaggcgggcagatcacgaggtcaggagttcaagaccagcctggccaacatgatgaaaccccgtctctactaaaaatacaaaaatgagctgggcatggtggcatatgcctgtaatccctgtattaattttataataaggaaatattctgaaactgtattttctgaattattcattttatctataattttcctaggttagataattttacatgagtccaaaaaacaaatattcctataaactaggaaaaatatatgtccactgtagttttttttactattttatcccttcacttatttatttttttagaagttttttaaagctagtatgagttttgcagactctaggaaaaggataaatctatttctccatatcaattgttaacttagaattaggcctttctattaatctcttaaattctatattcatctccccaggacttaacttgaagataactctttaccatctacctacttctcacaaatagtattataaaatactttcagccctgtgaaaagccaggtatgtttgtataagccagaagataatatacaccccaattttttaacctggaaagagactcttaggtgttaaaatgagaaaatagctttaagacacttaattttttcttcatgtttcttgtttcttctattttctttagactttttctattttccttcatctttcttcctgtgcaccaacccccatctaaacatacccccacctgcatatatacaccaagtgtactttttctcctgtagtctaaattctttcacatttttatttttctttcatattttttcatatggatgagagctagcatgattctttccttgaatttaccaatctgactaggtaaaggggcacattcttcggaagaatatttcttaaaaataaaatgatttataatattttccgtactagatggaaagcacaaaggacattctacagctgacaattttattgtgtttgtataatttctgcaaaggattcctgatcatattcctgggagaactgaaggatgtacatgataatcaattctgaggatatgtttttaaccctttttttattagtttaattcctaaatgacatttttctatactatctcattattacaaagtcttaaaattatatcaatccagtctcatctgaattagattaagacagaaattttaaagatcacaagtactttttgatgcgttattttttcattttacaaaatgctgtacagtagaaataactttgcctctcacccccagaagtctaccgacgcctatataatcttataatcaacatgagaagatcagtttgctgtactcctatttaatctggtagacaacaaagctccagttttaagagaagtctgtgaactataaaacctatatattggtgagtgactgagctacctcccagggaaaccatgtttttttccaccgatctgtgaaacccatggatcagatcaccaccagggccttgggttccaagcacagaactgtgcagattcttggtgaacgcttgggttgcagccagtggcagcatgctggagactgcctaagacaaccaagtacccagagggaggggcagtcaccatcactgtggctccaatcagccgttttcccctgccggtgttggggagactgggcagtttggcctgggaggaattccccacaatgcagcacagtggctgtggcagatcgtggccaactgcttctttaggtgggacccggatccatccctcctctttgggtggggcctccctgtggtaacttcagtgactccagccaggggtttataggcagaactctgatctctctggaatggagcccctgggggaaacagtggccatggtctctggttcagtagacttagcctttccttctgctggctctgaggaatcaaggcagtccagacgagtggaattcccgccagggcagcacacccattccaccaagggacagatagagtgcttcgttaagagggtccctgattctgtgcctcctgagtaggtgagacctccaaacaggggtcaccagaaacctcatacaggagagctcccactggcatcaggtcagtgcacctccaggatggatctcccaggggaaggagcaggcagccatctttgctcttctgcagcctccactggtgatacctccaggtgcatgagggacccaggtaaatagagcctagagtggacccccagcaaactgcagaagaggagctctacagaagaggggccttactgttaaaagaaaaacaaacagaaagcaacaacatcaacaaaaaataccccacaaaatctcatccaaaggtcaggagcctcaaagattgaaggtagataaacccacaaagatgagaaaaaaatccacacaaaaacactgaaaattcaaaaagctggggtgcctcttctattccaaatgattgtaacacctctccagaaacggcacagaactgggctgaggcagagatggatgaattgacagaagtaggcttcagaaggtgggtaataaacttcactgaggtaaaagagtatgttctaacacaatgcaaagaagctaagaaccacgataaaacattacaggagctgttagccagaataactagtttagaaagtaacaaagatgacctgaaagagctgaaaaacacaagagaacttcacaatgcaatcacaagtgtcaatagctgaatagtccacacggaggacagaatctcagagcttgatgactatcttgctgaaataagacaggcagacaagataagagaaagaagaatgaaaaagaacaaatgaagcctctgagaactatgagattatataaccaaacctatgactgattggggtacctgcaagagacggagagaatggaaacaagttggaaaacatacttcaggatatcatccaggagaactttctcaacctagcaagacaggccaacattcaaattcaagaaatccagagaaccccagtaagatactacatgaaaagatcaaccccaagacacataatcctcagactttccaaggttaacatgaaggaaaaaaattaaagggcagccagagagaaaggccaagtcaattacaaagggaagcccatcagactgacagcggacctctcagcagaaactctacaaaccagaagagattggggggagggggccaatattcaacattcttaaagaaaagaatttccaatccagaattccatatcaaaccaaactaagcttaataagcaaaggagaaacaagattgttttcagacaagaaaatgctgcgggaattcatcaccactaggcctgccttgcaagagctcctgaaggaagcactgaatatgaaaaggaaaaaccgttatcagtcaatacaaaaacaccctgaagtacacagaccaatgacaccatgaagaaactacattaacaagtctgcaaaataaccagccagcatcatggagacaaaatcaaattcacacataacaatatcaaccttaaatataaatgggctaaataccccaattaaaagacacagaatggcaaatggcataaagagtaaagacccattggtgtgctgtcttcaaaagatgtgtctcacatgccagacacacataggctcaaaataaaggaatggaggaaattttaccaagcaaatggaaagcagaaaaaatgcaggggttgcaatcctagtttctgacaaaacagactttaaactaacaaagatcaaaaaagacaaaaaaaggcattacataatggtaaagtgttcaattcaacaagaagagctaactatgctaaatatatatgcacccaatacaggagaacccagaatcataaaacaagttcttagagacctgcaaagagacttagactcccacacaatcatagtgggaaactttaacacccaactgtcaatattagacagatatcgagacagaaagtgtaaaagatattcagggcttgaactcagctctagatcaagtggacctgatagagatttacagaaatctccacccaaaaacaacagaatatactttcttcttggtgccacatggcacttcctctaaaattgatcacataattggaagtaaaacactcctcagcaaatgcaaaagaactgaaatcataacagtctctcagaccacagcgcaatttaattagaactcaatattaagaaactcactaaacaccacacaactacatagaagttgaacatcctgctcttgaatgactcctgggtaagtaatgaaattaagacagaaattaagaagttccttgaaactaatgagaagaaagaggccatgtaccaaaatccctgggacacagctaatgcagtgttaacagaaaaatttacagcactaaatgcccacatcaaaaagctagaaagatctcaaatcaacatcctaacatcacaactaatgaactagagaaccaagagcaaacagacccctaagctagcagaagacaagaaataaccaaggtcagagcagaactgaaggagatgcagacacacacacacacacacacacacacacacacacacacacacccttcaaaatatcaacaaatccctaaactggctttttgaaaaaaattaagaaaatagatagattgctagctgaattaataaagaagaaaagacagaagaatcaaatagacacaataaaaaaagataaaagggatatcaccactggccccacagaaatacaaccatcaaagaatactataaacacctctgtgcaaataaactaagaaatctagaagaaatggataaattcctggacacaaacaccctctcaagactgaaccaggaagaagttgaatccctgaagaggccagtaatgagttttgaaattgaggtagtaataaatagcctacaaaccaaaaaagccaaggaccagagtgattcacagctgaattctaccagagatacaaaaaggagctggtaccatttcttctgaaactattccaaaaaattgaaaaggagtgactcttccctcactcattttatgagctcagtatcatcctgataccaaaacctggtcaagacaaaacaaaacaacgaaaaaagaacttcagccaatatccctgatgaacattgatgcaaaaatcctcaataaaatacttgcaaaccaaattctgcagcacatcaaaaagcgtatccaccacaatcaagttggcttcatccccaggattcaaggctgactcaacgtaggtaaatcaataaacgtaattcatcacataaacaaaactaagaacaaaaaccacatgattacctcaataggtacagaaaatgcctgctatacaattcaacatttcttcatgttaaaaactctgaataaaatatatattgaaggaacatatctcaaaataataagagtcacttatgccaaactcatagccaatatcatactgaatgggcaaaagctggaggcattccccttgaaaaccggcacaagacaaagatgccctttctcaccactcctattcagggtagtattggaagttctggccagggcaatcaggcaagagaaagaaataaagcgtattcaaataggaagaaaggaagtcaaactctctctgtttgcaggtgacatgatactatatctagaaaaccatattgactcagcccaaaagcttcttaagctgataacttcagcaaagactcaggatacaaaaacaatgtgcaaaaatcacaagcactcctatacacaaataacagctaagcagagggccaaatcatagatgaattcccattaacaatcgctacagagaataaaatatctaggaatacagctatcaaggaaagtgaagaaccctcttcaaggagaactacaaaccattgctcaaggaaatcagagaggacacaaacaagtggaaaaacatttcatgatcatgaacagaaagaatcaatatcatgaaaatcgccatactgcccaaagtaatttatagattcaatgctattcccatcaaactactcttgaaattttttttattatactttaagttttagggtacatgtgcacaacgtgcaggttagttacgtatacaagtgccatgttgttgtgctgcacccagtaactcatcatttaacattaggtatatctccaaatgctatccctccaccctccccccaccccacaacaggccccagtgtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatgaacgcatcattttttatggctgcatagtattccatggtgtatatatgccacattttcttaatcaagtctatcattgttggacatttgggttggttccaagtcgtcgttattgtgaatagtgccacaataaacatatgtgtgcatgtgtctttatagcagcatgatatatgatcctttgggtatatacccagtaatgggatggctgggtcaaatggtatttctagttctagatccctgaggaatcgccacactgacttccacaatggttgaacgagccaaaattgacaaatgggatctaattaaactaacgaccttctgcacagcaaaagaaactaccatcagagtgaacaggcaacctacagaatgggagaaaatttttgcaatctactaatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccataatgagataccatctcacactagttagaatggtgagcattaaaaagtcaggaaacaacaggtgctggagaggatgtgggtaaataggaacacttttacactgttggtgggactgtaaactagtactcttgacattcttgacagaattagaaaaaaactattttaaaattcatatggaaccaaaaaagagcctgtatagccaaaacaatgctaaccaaaaagaacaaagctggaggcatcaggctacccaacttcaaactgtactacacggctacagtaaccaaaacagcatagtactggtacaaaaacagacacagagacccatggaacagaatagagaactaagaaataagaccacacatctacaaccatctaatcttcaacaaacctgatgaaaacaagcaatgaagaaaggattccctatttaataaatggtgctaggagaactggctagccatatgcaggaaattgaaaccggtctccttccttacatcttatacaaaaattaactcaaaatggattaaagacttaattgtaaaacccaaagctataaaaaccctagaagaaaatctaggcaatgtgattcaggatataggtacaggcaaagatttcaagatgaaaacatcaaaagtaattgcaatgaaactaaaaattgaccaatgagatattttttttttccgtttttaacctttactttttttttcttttcttttcttttcttttctttttttattattattatactttaagttttagggtacatgtgcacaatgtgcaggttagttacatatgtatacatgtgccatgctggtgtgctgcatccattaactcgtcatctagcattagttatatctcctaatgctatccctccaccctcccccaaccccacaacagtccccagagtgtgatgttccccttcctgtgtccatgtgttctcattcttcaattcccacctatgagtgagaacatgcagtgtttggtttttgtccttgcaatagtttgctgagaatgatgatttccagtttcatccatgtccctgaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccggctcctgttgtttcctgactttttaatgattgccattctaactggtgtgagatcatatctcactgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccatattgtaggttgcctgttcactctgatggtagtttcttttgctgtgcagaagctctttagtttaattagatcccatttgtcaactttggcttttgttgccaaatgagatattaaactaaaaagcttctgcacagcaaaagaaactgtcatcagagtgaacagacaacttacagaatgggtgaaaatttttgcaacttatccatcagacaaagagctagtattcagagtccacagggaacttaaacaaatttacaagaaaaaaaaaaacaaccccattaaaaagtgggcaaagacataaactgacacttctcaaaagaagacatttatgcaaccaacaaacaaatgaaaaaaggctcaacatcactgatcattagagaaatgcaaatcaaaaccacagtgagataccatctcatgccagtcacaatagcaattattaaaaagtcaagaaacaacagatgctggtgaggctgcagagagatacgaatgcttttgcactgttgatgggaatgtaaattagttcactcatggtctaagatggtgtggtgattcctcaaagacctagaaccagaaatagtatttaaactaccatttgacccagcaatctcattactgggtatatacccaaaggaatataaatcattctgttataaagatacaagcacacatacgttcattacagcactattcacaatagccaataaatggaatcaacccaaatgcccatcaatgatagactggataaagaaaatgttacatatacaccatggaatactatacagccacaaaaggaatgagataatgtcctctgcagggacatggatggagctggaagccattatcctcagcaaactaactcaggaacagaaaacaaaacatcacatgttctcactcaaaagtgggagctgaacaatgagaacacatggacacaaggaggggaacaacacacactggaacctgtccaggggtgggggatgggggagggggagcatcatgaaaaattgctactgcatgctgggtttaatacttaggttataggtcaataggtgcagcaaacctccatggcatacatttacctatgtaacaaagctgtacatcctacacatgtaccccagaaattaaaataaattttaaaaaaccctatatatcagcactgattttcataatacaaagtttccaggaacaatagaaaataaaattaactgaaaatgaagtcaggaaagaagagttcaaacagccaatgtttgaatctaggaaaagattggtttaaaaaagtgtttaggatgggagtgatggctcacgtctgtaatcccagcactttgggagggtgaagtggaaggatcacttcaacctaggagttccagacctgcctgagcaacatgacaaaacctcatctataaagaaaaaaatgtgtgtgtgtgtgtgtgtgcaaactgggtgtggtggcatgcctgtagtccgagctacttgggaggctgaggtgggaggattgattgagccagggaagttgatgctgcagtgagctgtggtcgcaccactgcatttcagctggacaacaaagcaagacagcctcaaaaaaaaaaaaatgtttaaaggataactgagtttgtcataaggaatgggaaattagtatcttggctgaaatactcttaaacaggaatctgtaatacttgccttcactctgctatgcatgtgatggaaagaaaaaaaatgatctgtctgtgttaccctaaggtaactttatttcttcatctgtaagattgagtagggtaggtgggtggggacattttatcctatgtaaagtctttccattcccagcattctatgattgtacaggattgctcatgctagatttctaaactgaaaatatccttctgcctaaatgtaaaatgccacttgacatttctgcaagccataattcaaggaaatggaagaacaaataccaaagtaatttagcataacagaatgctaaaggggaatttttttcttctatctatgtgtcagcggaggttcaaaaagtttgaaagcaaagtaatttattgagatgtttaatacaaaagtatttctacatgccaaaatgaggtggttagactctgtgtgaagagtcattttgccaagaaggtagctccaaaactgatcttgtgacacttaagccaaccatcactttaagatataaacaaaggatgcggaaactataagggatgattgcatcagagagagtcttatgtgtgaattgagacccactccattggaggggaggaaagcttttctctttttcatttctagcctctattcacatagcccaaatagcttaaggtagtcctctagggtaacaatgagagggacacagcagacctgtgtctcactaacacctgaagaagtctacaggcaaaaagctgtacctggagttgcagggagcagtggggaaacagtggaaaagttggtattgcaaaatgtttgagtttcctacaggccaagcagaagttaaaccaggagttgtgcaagaggggaggcttggcaatgtgcaggactgtaacagaaaacactgtgatgtgtattacaaggggcatgagctggaggaggtgagccataagaaactagtcaaagagttcatgagtttggaaatgtgcaatgcagagatccctcagtggggtcatcaaagaaccctcaactatacccccagaaaaaagagaatgctttgcacatctgccaagcctcaagaacagcaatgctacctttttccttcttcccatcctcagtgaaaggaaaactgtgactactgagttaaagggaagaagaaaagacagttctctctggtgtttcacctgtttaacatagaatgttacagaagcaatgaattaaagcatggtgggagttttatagaatgactattttcttgtcagctctgagtaaaccccatttcttttctcacattgaacaaataataaatcaaaagcgccaaaatatttttattattctccaagtaataagctcagatatctatctctacaagaataaaatagccatttagcatgaaagttaagttatgagagcatggtttagcaaaagtgtagaaaacaaaagaactaaactccttaacatgagagcataaatgaaatgtaaatatggaatctagcagagtgatgtgaagagaagaacgtctgagcaacatagagagacgagaagccttaaggaagtgatgtctaacttcaaagttaagctctttgaacttttgtcacataaaccgctgtgcactttatcaaaaccaggagtaaaatctgatacacattctaagatagatagatagatagatagatagatagatagatagatagatagatagatagattgtttttgaagaaaggggcaaattttcacaattagattgatgatggagtagcagtaaaagactagatggcacttaatacatatcaagaatcaatgtagtcaagaaataagaaccaaatatggccccgataatataagtcactcattcatacgcacctaccaatcccccaaattttggagaaatcttgaggtagtcattgaacattccacagaggacacaaggaaatttggaccaatcttatctatgtcttatctagacttcagttgacatctggctaatgttcaaaattacttacttgtatgttgagtcatctttgtttttcttattaagtagagaatgttctgttgggtctaaacaagattcctccttagaaaataaagaaatttccttttgaatctcactttccactaaattagtatctcttttaggaaggaaaaggcagttttcaatatgccagtgctttgcctgaaaaaaacgaaaacatctgttttatttttatgaaatttattttcttcaaacatttacgtgtgtttaccatgtgctggattactaattaaagtcctggggtgggacacacaagaagatgaaaaagatatgactccggtccacaagaagcttacagttttacatgggaaatgaaagagtttcatgtaactttaataaaggtagaaaatgagatatgtcataagaaacaaaaattctctgaagagataataatgaactacaaaaatttttttaccattcccattttaaaattctgaatagccagatgtacatttactaaaaacaaaacaaagcttttgttaaagaattgccacacttatttattccctcaactactttatttgcgtgttacctccttaaatgttttcaaaagccaattcagttattaaatattgttttctaaaaattatgtgtgttatataatagttttcacagatttggctacacttcttaaaatgcattcatctagcaaaagttccccattaacaatctattttatgttttaaatacagagccaattttctcatcttatatcaatacacttcatgcacacagaatgttccagagaatgcagcctgtgagatatgaggggaaccgtaggcatcctgcagatatttggctggtgcgcaaattgatcagacttgtcataagtgtttgcagaataaaatgcctacagagccagtcaaataatatcaatgaatgaattgaacctaatacaagaaaataaatgggtaataaatagtaaataaaactcaccctcagtttttaaggcaataaaaaaattcagagactatactgaattaaagagaacccattttacataaaagccatagttactcttaaggaatgacatacattctttttttttttttccaccttaagttctgggatacatgtgctgaacattcaggcttgttacataggtatacatgtgccatggtggcttgctgcacctatcaacccatcatctaagttttaagctccacatgcattaggtatttatcctaatgctctacctcccctttcccccaccccgcaacagtccccggtgagtgatgttcctctccctgtgtccatgtgttctaattgttcaactctcacttatgagtgagaacatgtggtgtttggttttctgttcctgtgttagtttgctgaggatgatggtttccagcttcatccatgtccttgcaaagacaagaactcatcctgttttatggctgcgtagtattccatggtttatatgtgccacattttctttttctggtctatcattgatgggtatttgggttggttccaagtctttgctattgtaaatagtgctgcaaaaaacatacatgtgcatgtgtatttaatagtagaatgatttataatccactgagtatatattcagtaatgggattcctgaatcaaatggtatttcttgttctagatccttgaggagttgccacactgtcttccacagtggttgaactaatttgcactctcaccaacagtgtaaaagcattcctatttctccacatcctcaccagcatctgttgtttccagactttttaatgattgccattctaactgatgtgggatggtatctcattatggttttgatatgcatttctctaatgaccagtgataatgagctttttttcagtgttttttggccacataaataccttcttttgagaagtgtctgttcatatccttcactcacgtttcgatgaggttgtttggtttctttcttgtacatttgtttaagttcctcatagattctggatattagacctttgtcagatagatagattgattgattgcaaaaattttctcccattctgtaggttgcctgttcaccctgatgatattttcttttgctgtgcagaagctttttagcttaattagattgcatttgtcaacttcagcttttgctgcaattgcttttggtattttagtcatgatgtctttgcccatgcctatgtcctgtatggttttgcctaggttttcttctagggtttttatagttttaggttttacatttaagtctttaatccattttgagttaatttttgtataaggtataagaaaggggtccaatttctgtattctgcttatggctagccagttttcccagcaccatttattaaatagggaataatttccccattgtttgtttatgtaaggtttgtcaaagatcagatggttgtaggtgtgtggtgttatttatgaggcctctgttctattccattggtctctttatctgttttggtaccagtaccatgctgttttggttactgtagccttgtagtatagtttgatgtcaggtagcatgatgtctccagctttgttctttttgcttaggattgtattggcaacatgggctctttttcagttccatataaaatttaaagtagttttttccagttctgtgaagaaagccaatggtagcttgatgggaatagcattgaatctataaattactttgggcagtatggccattttcatgatatcgattcttcctgttcatgagcatggagtgtttttccatttgtttgtgtcctccctgatttccttgagcaacgatttgtagttctccttgaagaggtccttcatgtcccttgtaagttgtattcctaggtattttattttctttgtagctattgtgaatgggaattcgctcatgattgggctctctgcttgtctattattggtgtacaggaatgcttgtgatttttgcacattaattttgtatcctgagactttgctgaagttctttatcaacttaaggagtttttgggctgagacaatggggttttctaaatatacaatcacgttgtatgcaaacagagacaatttgacttcctctctgcatatttgaataccctttatttctttctcttgcctgattgctctttttttaagagaaatgagaaacttgaatctttacatgaaatctattattgtttaaatgtgggcaactaaatcaaattttaattattcactggatgaagagacacaatcaaagtcactggacatcaaatcaatcagatgaggagagttgccagtacataaattctgcctagcacaacagtagttagtgcacaaagtggggcactgaagaatttcaagcatcatttgaatttcttcttatcccacaatcacctgtcagcttcgtgggataaacatgcatttatgaataaatcctcttcactcctatttctccaactctagaaatagacataccatacaacttacttttaaaaatctaacctgaaaaccagcctaaggtcaatagctatgttataaaagtgattctaatttttgtttttttgttaaacaaacaaacaaacaacaaaaaaaaacttcccttttctcctctctctttcctttccctcttttcctttccctttcccctcctttctgtttcttcttccccacactctttgctctacatcttgggactaatggcacttatattcaagacagcttgataaaagtcaatcctttaaaaaataaaaattaaaaaaaagaagtagtgcaagcagaaggaactagaaaaccgttttccccagatttgctagccttcaatttgtaaaactgacccagctctgatgactcttctcctgtcttgaacagaagggaaaaaataaaattattctcatgagggctttttgcatcttcaaaaaagcaagacttcacagaaacaacaaataatatcaataatacaaaaataagcagttttacaagcacacatttctgaattaaaataaaatttagctacagattatgtttggtgggtgaactttatatggcacctacacctagaacggtgttatttcttggttcgaccccggatgtctaaggaacttcttaggtcacccacttgatgacgtttcgtttctttacctgttgttcaaacctccacctcatcttgccacagcctctgtcagcaatgctttggcttcttcagtggcctgaagcaggcttccaccctctttcctgtccagactgccagccatgtcccaccctgtctcactcatcacaagcctgtatgagttcccacttagccgctttttttcctgactgagaaaagtctagtgcttgtcttatttacaaaatacaagagattgctacagctccggagtgttacattgagactgtcgtctagccaatgtgggtccacctcccagatgattttctgatttaccaacaccctctgcatcctaaaggggtgcttagaattctttccacacaggttggcctcatcaaactgactttacaaatacagcaacaacaaaccttgtcttccaacactaaaagaattgcctactctcctggcataagattggcacctgaggctcctaaatagaaccaaatcagctggccaaacagatattgaggcttcacttaaacttataccaggtttgaatagtactggttgaaaccagtgaaacatattttgtccgcaaaagcacaaatggaacaggaaaagttcccaagaaagcaaaaggaaaaaataacagaaaatatgagactaaatatttcctttctttcatgactcccatttccatttcatttcataggcaggagcaagtcagatcttgagaaaggggttaaaaatgtgagctctgaagtgacccaacttgagttaaaaacaaaactctaccacgattagcttctgtgagctcaggtgatttattcaaactctctgtgcctctgtttccttatctgtaaaatgggaattgtgagagctgctccctcctgagttgagcaattgtgaagattaaatgagttaattcttgaaaaacatcttagaacagtaccccacgtacacaagaaaaactcagcaaatgttaactattattatttggcagcagtaaaccagataatgaataggatgattggtttttttttctaaaattttctgcatttgattattacgttcttagttaacagtcataatcacctgtctttttagttacatgatcattttatccacgttgaacttttactaaatgttgaaattgaagaaatttattctagaggagaattttttctcagaaatcctagaatattttgagctgcacagagcccccatctttccatgtctctggtgtcttccacttgatggaactgtcttggttaatggaaaacagggcaagagtcgcctggagctactgcttcggaaatgttgtcagttctttcatgactaatgaacattaaacagctgatgagattcaaatagaaatcagcccaagttaatactaaatgtcaagtaaatactagaataataaagaagcaatatttctacctgaccaaagatccaaacaggagcattgcagacaccagtcacacaaatactgcagtctgcagaggaggagataatcagtaactgaccacctggctcacacatctctaaggaacttattcggtcctcatgaggttggaatgatcttatcagagttggggccttggtgattttgttcttactggagttaagacagtactcctgaatgaaaagaaataccagaactctaaaaaattcaaatatgaaatgattacaatgacataacacttttaaaaaaaggccgattttcaaacttgggaacaataacctatgatccaaatgcaaaagaaaagttcatgataaaagaggctagaaaacgaaattacattaaaaaaaggtttctaacttatctgattacttgggaaataaaaaaaaggaactagtggggaaggaggaaggaaagaaaaatataaatagtaaagccaattatttgatagagatgaactttaccacatacaggtggtcacatatacaacgttcaaatattattagaaaattgagcaggtaatcagtgataaaaaagaaaaaatcccaaactaactcagggtaacaataatgttaaatgaaggaatagtcctctagtatttaaattacatttacaatctcattgcagataaggtgtagcctcaccccaggcaacctagtgagaccctgtctctacaaaaagtaaaataaataaaataaaataaaataaaataaaataaaataaaataattagctgggcatagtggaacactcctgtagtcctagctactcaggaggctgaggtgggaggatggctggaaccaggagtttgaagttgcagagagctataatcatgccactgcactccagtctaggtgacagagggagatcctgtctcaaaataaataaataaatacatacatacattaaaaataaggtgtatcctaattatttacattcaaataatgctgcagtgctttactaacaatattgcatttctaaattggatgacttacttaacagaaggttgtcaatattgagaaaaacatgattttcctcattaattatttaaaagaagtctctgcatgaaacttgtaaatgttttatttaaaacacttagactatacattttttcctttgtttaggagacagacaaggcttgattcatagttacctgcaacaaagggtcaccaaaaatcttaaaggtaatgtgataatgtttttcaatttacctctatattccagattttcaaccatccatcaagatctcctgtggtaaggtatcgattcatcttatcagtagacataataatcgatccaactccactatgagccaaaaattcagccagaagttgcttcttatatatatcccaaaatctgacataaccagatcctccacatgataccaggttagctcctcctaacatgtaagggaaaaatctaactagaaaactgaacaacaaatgccagaaataacttcttcagtggctttccctgtggaaagcatgtgatgttgaagaggtgagtagccctgagatcaattcccagcaccactttaattttctcaaatataaaatggaggtgacgctatgataacctcactggtttgtgttgagtattaaatgagataggatattgaagtgttccattacgtttagttcccttttcttcattcattattctgatgttttgggggtatttaaaagttagatagaattgtttcttcagataaaacatgaaatattaattccaacattatgataatattctcattatataaaattaatcttccctaataacccactggacatatacaatgaagtaaaagtccatatgcacagatttggatggaatatgtagtgatagcagaatagctattgacttctccgtttggcagcatgcttagaattctatttatgagctttctttaaatgttttcatcaataattcattgtaaacccttataaaacccctttttggtgaatgagcctagaactaaccttttcattttccatttttataggttttgttgaagcactttacctaagttattcttttgtggcaaggttcctattatttgataaatctgtagatgacttccagtttgcttcacaaatgtactgccaataaacaatcatatctatttaaggtagaaataataacatgtagctgcttcagtgagaacaatctgggaatactgataacattaaaattagtattgaggaaatgagagtaatttcaggataataattcatattgtgagtataagcaagttctagaaaatggaaagttttagaatctaattgtttcaaagtttattctaaacatcccagaatgtttttaaactatacctttattgattcttaatgattaaaaattttatatgaaaattatacagattttcatctgtaaattaaatatgggaaacaataaacataattcagatatgttcatttccttttcaaatacataatacatatatgtctagttcctaatgttaagaaaaatataccctgaagatacgattgttattttagatgaaaggtaaaaaaatatacattattctccaaggcagattttcattttggaaagatgcaggctgcatcaacaccatgctaatattgccactgacaacaaggaaaaaattaagcaaatggttatttcacttacataatatcatataactacagtaaatcataaaatagcatcaatgttagtatacatctctggagaagatataaccaatacttaaaaaaaaaaacaaaacgatgagaacagagaagagagcaggcagctcttgtcctgggattagcaattctttcaaattctgttactgttcttaacatccatgctcctcattattctcttccagcctattttgattaggtgctcatatagtcagtctcagactcaacttttctgctatatgtggacttaagctttgacttcggcatacatcttgctgtgcccctactgtattaaaacctctttatgacaggtctgggacaacaattctgattgttgcccgtatccaataatttgtcagaatttttcccatcttgatcttgacatatacaacactggataaattagtagtgggatgtagtctggctcctgctcttgaatccatcctcctcaattccaacttcctttgccatggtctgtgacctcacttgacacactactgactggttagctacgtgcagtcaaattctacaagatctagtagaaatagattggattttctttattgctccctttccaactatatgtaaaatgtaaatatatattttacctgtcactgcagtgttttttcttgctttaagaaagcaaagtctcataacagcatttttgccctcagtgtcaatctcaaagttgcggactcccgtggtagaatggtctgccatggggtgggagggttggcttctcccagcactgagaagtttttgaggttttgtatctgtgagggagacaaagccaagtatattaatgaagaaaaatatctgcttttcaaactaatgcctatgaaatagcaggcccacatctatcactatatccattgactccaagtctcacaagagacttccagtcaacatctatcaagccttctgctatttctcaaccccaacttgaagaattgtttgacattatttttgtttttcatgttccatacacacttgctctgttttcacttgatatgaattaagtaagaacttaatattggcatcaatgctaacatcttagggatcctaatatgcccaggacaaacgtaattccaatactgtggcattttcaacttattaatcattaaaattaatcttggaaatattataatgaacatgagttctaaagactatttatgtttaattaaatgagcctttttaacaatactatttgttagcgagttactctggagaaaacatttctaagcatacttcaattatctaatgacatcatctccaggccacactagtaaacactggggatattcgtctcagaatctaggaacagtctgcccatagttatgaaaaatctatacagacgtattttcaaaattccaaaataagaaatctattgcaatgcctttcatgtcttttagaaatttgatatttattcacttttctcattaattatctctctgtgtattgtaaagcccagtgtagaagaagaggcagaattccaacctcctcatggcaagttcagatgaatcttaaaatgattagctcttagtacataaagcaggtcagagctttgtgtttgcaaccaagtatcccctaaatctcttaagtttgttttcctactcttaagaaaatagcttctcagcttttcacccaaaaagaaaactgcatctgatgatcagtccattcctaaagttcaattcagcctctatgagtttattcagttgagacaacagaacctcactgggccatgaagaatgacattttcattaccaaaataaattagtctaaagaaaaacctttagtatctaaggaaactgaaataaaatgtgaaaggcaattgtcaagacattttacttaagtataaaatattcatgtgctctgctaaactcccataaaatacaatatactcccatctaatgttcctcatgggcttctaaagcaaggaataatttaagatttccaggtggcataatatttattacaagctctagattgagtctgaacagcctatcgagtgaacatgaatttccatttttttaccaaagggtatctaacgttcactcttaggtaatttggcaaggtttattgaaaaaaaataaactaaataaaaatgacagtcttgctccctgctgtcggtagttcagaaataccaatgtagcataaagagaagaaatggcatgccatggagagtgtgctaagccaagtaaatctcaaggttctctttagctactttggcaagacaatgatatccttaatccttcaggcttatagccaatcatctataatttaggatcaagtcgcatcaggcacatgcatgaacaaccaggcctactgtgatttgactagccatgttattttcgtttcaaactcacacttacctaattttgactttagcaacctctggtaatcagggtgaagaacatggtgagcattctctgtgctattgttccatagaacaatttctccatcataactccctacacaagacaggatggagaatataaattgccaggagattaagatagaaaatatgagcaacagcaatcagaagaagttattagcaacatatcttccacagaatatggcacatagtgggcactctatatttttagaaacatgaataataataattggtatttgttttaactctagagcttacaatccccacagtataacctgagcatgggtgtgtagaaattactgttgtttccttttattttatggtaataaagcattcagaacagatgctttgcaaataaaaaactggagcttgagtcttggttctcccacttactgtgtgaccttgggcatgttatttaactctgcttgatgctgcaattttctcatctataaaaaagagttaataattttatttatctcatagggttattgtagagaatgaaagtatttacaatagcactgagcatattgtaagtactggaaaaaatgttaattaccatcctactttttattattgggtaaaagcaagtaaatcaagtcctcctatgtttctgtttcctacatcccttcttgtgtgtgtatgtgtgtgggtgggtgtgtgtgtcttctcttcatactttccctcctatattgaatactgaatattgtctttattgaatattgtcttctccaatcctgaagtttttcctacagaaagtccttcagtactgctcttcacagagaacagagaaaagcccaaatagcccaaaagcccaaagtgaggtgaagtctgagcaaccatgtcctgtggaggaacaaagcagcaacgcccagaccattgttctcagtggctcagtgaggacagctacccactgagcagagtgtctatggtaaggagagcagaagagtttgggtgggatgtacaaatggtgacttttttgggattaggggagaggagagagaaatgcacaccaaactctgtattgtcctagaaagagcaatctctttgggaggccgaggtgggcagatcaggaggtcaggagttcgagaccagcctggccaacatggtgaaaccccgtctctactaaagatacaaaaaaaaaaacttagctgggtgtggtggcatgtgcctgtaatcccagctactagggaggctgaggcagcagaatcacttgaaccctggaggcagaggttgcagtgagccgagattacaccattgcactccagcctgggcgacagagtgagactccactccatccaaaaaaaaagaaaaagaaagcacaatctctgaagctcacaaattgaaccagggggatggagttcagctgtccatagaaatatccatcttctcctatgctttactagcagtgactgaccaaatatttccacataggattgatgggaggagaatgagtgaagagattgtctacccaccaatacaacggtatttactaatactttcacaataacaaccacaccattttacacttcagtgcccatcacatttcaggatgtgatcctccctgcaggggtggccttccagtggctataaagctaatttacctacagagttggccttactagaaagtaatttcattagtcctgaaaacaggggaactttaaatatagatagatcagtaaacctcatattgtaacacttcatagataccctggatcttttcctgtaagttttcattcctcttaattgatgacatttttggttctataaaaaaaattcagctgtcaaaatatggacttgaaaatttcatggtgcaatctgtctctataaattgcattctttggccagaaatgatacaacaatttttcattctctttaatatgccacatcaaagcatgcctatgaatcattttaagagcttggatttgtagacattttgtgaggacagacttttatcaacattatctgggctaaattatgccaaagagttactatgttcacattatgaaacatctaagtgccaccaacgtgtgattcgtacctgacagccctaaagctgctcctggaaaatggacaatacaaataaaagctaatatttatggatgagcttattgtgtgctgagcactgtgttaaatgcttgcacagataatctgaactataaaccaaaatatagatatattattatcagccagacaaaattatgatttagagtttaaataacttgctcattatcaagttgtggcaattggtagagccgtgaggggaaatcagacagccaggcacaggagctgatgatcagaactaccaatatatttccctagaaataaggataaagaagagcaagtgctgcttcttcaaaaatctattcatgctcaaaggaaaccatcaacaaagcaaagagacaacctacaaaatgggagaagatagttgcaaactttacatctgatagtataaggggttaatatccaaaatatataacaaaatcaaacaactctgcaacaaagaaaacctgatttaaaaatggacaaaagacctgaataaacatttctcaaaagaagacacacaaatggccaacagacatacgaaaaaatgttcaacatcactgattatcagggaaatacaaatcaaaacaacctaagtgagtgagacatcacttcattccagtcagaatggctcctatcaaaaaatcaaaagataaaagtattggtgaagatatggggcagaggaaacacttacatatggctggtgggaatgtaaattagtatagcctttatggaaaatgatatggaggaattgaaaatagaactaccatatgatccagaaattccactactgggtaaggaaatgaaatcagcatgtggaagagatatctgcaccacacccttatgttttttgcagcattattcacaaaagccaagatataaaatcaacttaaatgtccatcaatgaataaatgaataaagaaaatgtggtatatatacacactggaatagtattcagccataaaaagaataaaagcttgtcatttgcagcaacatgaatgaacctggtggacattatgttaggtgaaataagccaggcatataaagacaaatatcacatcatatcacttagttgtggaatctaaaaagttattctcataaaagcagagtagaacagtggataccagaggatggggaggggagacaggaggggtgagagattggtcaatgggtaaaaagctagttatatgggaggaatgagttttggtgttctattgcatagtaggatgactagagttaacaataatgtattgtatacttcaaaatagctagaaaaaagattttttaatgttctcatcactaagatatgatatatgtgtaaggctattaatatgctaattaccatgatctgatcattgcacaatttatacatgtattgaaacatcatgttgtgcctcataaatatgtacaattattaatattatgtgtcaatcataaatttaaaaagaaatatatggccgggcacagtggctcacgcctgtaatcccagcactttgggaggctgatgcaggtgaattgcttgagctcaggagtttgagatcagcctggacaacatggcaaaaacccatctctactaaaaatacaaaaaactggccaggcatggtggggcgtgcctgtggtcccagctactcaggaggctgaggtgggaggatcacttgaacctggcaggtggaggttacaatcagctgagatctggccactgcactctagcctgggcaacagagtaagaccccatctcaaaatacatatatatatatatatatacacacacatatatatatatatatatatacacacacacacacatacatatacatatatatatatataaaacaactgagaaaaagcttttctaaaggtgagtgagccaaaacaaaccaaaacaaatcaaacttcaccaatgattgtcaagtgaaagttcaatttacccgtaacaagagtttgtggaggtaaaaacgcagcacacaagatgtcatcatggtgctgtatacctcctttccattcttcaggctggatgaaaaattgattgaagttttggggtcgaaacacagtaatagccctagcaaaaaggatatagaatttagctgtggatctaaaattgatgtagacattgagtagccactatccacttgaatgatgtgatccaagacttttaaaagactatgctgcccaaaatttatccccacttgacaaccataatactgagtttcccacactaaacatttttattacctcattaaattatctggtaaattataaatttttgacaatagaaggttaattatcctttcataatcgttaacaacaaaccatgtaacaatttatcagattaattatccatcaccacgaccctaaagcaaagtttccccacatgggtattatgaaatcaccgagttttatagcaataacaattaaaagagggggcaggcctatgaacaaataatgttttgtacttcaaacaaagtcaataagggttttttttcatcaattttctcaggatatttagcactccttgtggcattttcaagacttacctgatcacagaatccattctcttggagtctacagcatcttgaagaactacaatttgtggaacatacttggaaaatgccaccccaaagaagtaggacataggacagatacattttgaacagaaagaacagtattagagaggtcagtatcttctggcactgctgataaatttgaggacaggacaggatgggcaaagaatgaaatgccttgtgcctggtggggaagggaggagtgtaaagattccattgttggggcattaataccaccctgttttcacttgatgatccgagctctggccatcagcctatactaagcctcttgttccttctagagccatctagatctcatgtgagcatttgcaaccaaagttatggggtctttcaccatcattctctcttcaccttcctgaaatcttttattcccaccactctaaaggtctcttagttgtcctaccagtgttactcctcagcctcagagtttccagtatgttctgcttctcttcctgcctcctgatctttctttccccactctttattttctattcccttctttctctcaccctttttaacatgtggtatatatacacaatggaacattccttatcttcattcctccctttctctctatccactcaaactggcttagagatttcatatatcaccatgagttccaatgtcactgctatacaaatggctcttaaattctcttcattcataatctttgctagaaatagtttccatttgccagttgacagttctgtataatgcttccatctgcaaaagatctcaacatgtcaaaaatccaaatttgacatcttccctccataccagccctctgtctgcaattcccaaatatggttaatagaccaacattccagcctctttgggtgtctttctcttccccagtcaaatcaaatacttagattatatctctgcaatatgttacatattcgtttcttactattttacttcaaacagtcaatgacagtttcctagttctgtgctaactacctcatggttgacttattgtaacagcgtactgacaaattttactgcttctagtctacccatctctggcacattcttcatctggctactagattaattattctactctggggcattttcatttattctataagaatttcttatttgccatgtggaagtcactttgttcatagtgatgcagggtacagagccgtcagcataaaatgactaaaattcaaggtaaaatgtggtaagtgctaaggcattactgatcaactgccatgaaaggccagcatagaaatcaaagaaggctgagttgaacactgatatttgaactggaccataaaatatgggtaggatttgcaagatgaaaacactctggatggagaaaacaacatgataaaagataaggctaatgccccattagaaagcctttgctagttttttcgtttagtatatgataaaattcaaatgtggagctctgttatttaagacccaataatacatagatctaatctatgttttcagaattatttccctctattcttctatccttgcttttcagttatatatgaatatccaattaagtatttgagagaggcactggaagccatagagtaaatatggtacaccttcttaagtgttaattttgctcaaaaagtttaaggaagaataattttctattaaaataaagatagatgaattaatgcaagagaacgcaaagtttgcctgaatttcaaaaaaagaattcaaagttttaaatttattttttgcttgcagtagctgttttgaattgttaggagctaagtttctgaagtacaccttcttgtccaacccaaacaatattcttagtcttctctaggtacctcttatatttctgtcggttttgttttcattcatggtatactttttcatgcctctatgaatttctttttacacacagacccacatctacctattcacacaccaactctctaaggcccatcttattcaggtagaattccttaataactaggattaaaagaaatagttcctcttctgacctcttaacatcattcacatttaacttgtaacatttaatgttatacagtttcagctccttggctaaattataaattctgaaaccatgcatcttgtcttaatctgtaaccgtacagtagcaagcatagtgacctatacatattgagtgttcaataaatatctgtcacataaatgaagaaaaaaattatctgcttaaatgtcacctactcaggcaagccttccctgaccaccctatctgaagactctctgagtctctcatctctcactctatttcattttttataacacttactactgtatgacactgtgatctatatttacttgtttatgttctatctcttctattataaagtaagttctagaagagcaaatactttgtttttttccttctacaacagcagtgtctagaataatacctaccacgataggcatttaacaaatatttgctgaatcaatgtgtgaattattctatgttttaaataatcagatcctttgaatggagcaacaggttgctgcaaattccatgagacaggtgaaaaactggtgctttctcaaaagcaccacctcctggctggaggccaacaaactcaggacattacagcaactcatgacagaacaaccctgctccaaggaaggagaaaacaacagctaatcccactgcctgtaacatcctggctaaccagtggtcctgagtctgtccatgtgacaacttcactgttagcataatgagcattcaagaaagccagcacactaaatatatctacaaggactctcacagaagctacttcactctcctgacacctccaccagagcaggtgctggtacctatggctgaaacacctaaagatgaatcacatcagaggactctttgcagacactccccagcaccagcccaaaggctggtagtcccactgggtgactagacccagaagagcagtaacaatcactccagtctggctcgtaggaagccccatccctaggggaaggggaagggacagtgcaccacagcaagggaccaccccaccccatgggacaaaagagtctgaacagcagcccttgaattccagattttttcactggaatagtctacctgaatgagaaggaatcagaaaagtaattctggtaatatgacaaatcaagattctataacacccgcaaaagaccacactggctccccagcaatgaatccaaaccaagaagaaacctctgaattgtcaaataaacaattcagaaggcagattattaagctactccaggatataccagagaaaactgaaaagcaatgaaaagaaatttttaaaaatacaggatatggatgaaaaaatggtccagataaatagatatcaaaaagaaaaaaacaatcacaacttctgaaaatgaaagacacacttaaagatatagaaaatgcactggaaagtttcaacaatagaatcaaacaagtagaagaaagaacttcagagctcaaagacaaggatttcaaatcaacccaatcagaaaaagaaaaaataatttctaaaaaaaatgaataaagactccaagaaatttgagattatattaaatggccaaacctaagaataattagtgttcctgaggaagaagataaatctaaaagtttagaaaattccttagaaggaataattgaggaaaacttccatgacctttctagagatccaaacatccaaatacaagaagctcaaagaacacctgggaaattcatcacaaaaagatcatcgcccaggcacataatcatcaggttatctaaagtcaaacaaaggaaagaatcttgagggctaagaagcaaaagcatcagctaatctataaaggaaaacctctcagattaacagtagatttctcagcagaaaccctacaagccagaagggactggggtcctatctttagcctcctcaaacaaagtaattgccagccaagaattttgtatccagcaaaactaagcttcataaatgaaggagaaagtctttttcagtctttctgagagttaacaactaccaagccagcactacaataaaggctagaaggagttctaaatcttgaaacaaaacctcaaaattcaccaaagcagaacctccttaaagcacaaatctcacagagcctatgaaacaataacacagtggaaaaacaacaacaacaacaatgtattcaggcaaaaactagcacaataaataaaacagtacctcacgtctcaatactaacattgaatgtaaaaggcctaaatgctctgcttaaaggatacagaatgccagaatggataaaaatccaccagtcaagtatctgctatctgcaagagactcacctaacatataaggactcataaacttaaggtaaaggggtggaaaaagatattccatgcaaacagacatgaaaagcaagcaggagtagctattcttatatcagacaaaacagactctgaggcaacaacagttaaaaaagacaaacaagagcttgcagttagccaagatcacaccactgcactccaccctgggcaacagagtgtgaccccatgtcaaaaaaaaaagacaaacaagaacattatatgatgatttaaaaaatcagtccaacaggaaaatatcacaatcctaaatacatatgcgcccaacatgagagctcccaaatttatgaaacaattattagtagacataagaaatgagatagatggcaacacagtaactgggggacttcagtactgcactgacacgagtaaacaggttgtcaagacagaaagtcaacaaagaaacaatcgaattaaactataccctagaacaaatggacttaacagatatttacagaacatcctacccaacaactgcagaatatacatccttttcatcagcacatggaacattctccaagatacaacataaaataggtgaaaaaacaagtttcaataaattttagaaaattgaagttatatcaagtaccctctcaaactatagtggaataaaattggaaattagctccaaaaggaaccctcaaaactatacaaatacatgaaaattaagtaatctgctcctcaatgatctttgggtcaacaatgaaatcaagatggaactttaaaaattctttgaactgaacaataatagtgacacaacttttcaaaacctctgggatacagcaaaactggtgctagggtagaaagttcatagcattaaatacctatatcaaaaagtctgaaagagcacaaatagacaatataaagtcatacatcaaggaactagagaaacaagaaaaaaacaaacccaaacccagcagaagaaaaaatataacaaggatcacagcaaaaataaatgaaatggaaacaacaacaaaaaaaatgcaaaagataaatgcaacataaagctggttctttgaaaagataaacaaaattggtagaccattagtgcaattaaccaagaatagaagagagaagatccatataagctaaattagaaatgaaatgggagatattacaactgataccacagaaatatgaaagatcattcaaggcaactatgaacacctttatgcatacaaactggacaatccagaggatttggatgcatttctggaaatacacaatgccccttgattaaatcgggaagaaatagaaactctgaacagaccaataacaagtagtgagattaagtaataaaaaaaaaatgccaacaaaaaaagtccaggactggatggattcatagctgaattctatcagacattcaaagaataattggtaccaatcttactgaaactattccaaaagatagagaaagaggatatcttccctaaatcattctatggagccagtatcaccctgataccaaaaacaggaaaggacataataaaaaaagaaaactgcagaccaatgaccctgttgaacatagatgagaaaatcctgaacaaaatactagccaactaaatccaacagcatttcaaaaagataatccaacatgatcaagtgggtttcataccagggatgcagagatggtttaacacacacaagttaataaatgtaatacatcacataaacagaattaaaaataaatatcatatgattatctcaatagatgcagaaaagacatttgacaaaatccagcatcactttatgattaaaaccctcagcaaaatcagcatagaatgaacatacttcaaagtaataaaagccatctatgacaaacccacagccaacattatgttgaatggggaaaagttgaaagcattaaccctgagaattgaaacaagacaaaaatgcccactttcaccacgtctattcaacatagtactggaagtcctaccagagcaatcagacaagagaaagaaataaaaggcatccaaatcagtaaagaggaagtcaaactgttgctgtttcccaatgatatgattgtatacctagaaaaccctgacttctctagaaaaccctaatgactccttcaaatgctcctagatcagataaatgaattcagtaaagcttcagaatacaaaatcaatatatagaaattggtaaaactgctatacaccaacaacaaccaagctgagaaccaaatcaagaactcaaccccttttaagacagctgcaaaaaaaaaaagtaaataaagtatttaggaatatacctgaccaaggaggtgaaagatctctacaaggaaaactataaaacactgctgaaagaaatcatacctgacacaaacaaatggaaacacatcccatgctcatagatgaatagaatcaatattgcaaaaatgatcttactttcaaaagcaaccacaaattcaagcaattcccatgaaaataccatcatcattcttcacagaattagaaaaaacaaacctaaaattcatattgaacctaaaaagagcccacacagccaaagtaatagtaagcaaaaagaacaaatctggaagcatcacattactttatttcaacctatactacaaggctatagttaccaaaacaggatgttacatagagcagtgggacatagaccggtgggacatagacataaaaaggcaaatagaccagagggacaaaatagagaacccagaaataaaaccaaatacttaaagccaactaatctttgacaaagcaaacaaaagcataaagtgggtaaaggacatgctattcaacaaatggtgctaggataattggcaagccacatgtagaatgaagctggatccttgcctcttaacttacacaaaaatcaatgcaagatggatcaaatacttaaatctaagacctgaaaccataaaaattctagaagaacatgggaaaaactcttgtagacattgacttaggcaaagagttcatgaccaagaacccaaaatcaaatgcaacaaaacaaaaataaataaatagatgggacctaattaaactaagcagcttctgcacagcaaaagacattatcagcagagtaaacagacaatccatagagtgggagaaaatcttcgcaaaccatgcattcaacaaagaattaatttccagaatctacaagaactcaaacaaatcagcaagaaaaaaaaattacaaataatcccaccaaatatagtcaaaggacataaatagaaaatttttaaaagaacatatacaaatggccaacaaacatatgaaaaaatgctcaacatcactcattatcagggaaatgcaaatcaaaacagcaatgagataccaccttactcctgcaagaatggtcataatcaaaaagcaaaatataatacatgttggcatggacgtggtgaaaaggcagcccttttaaactgctggtggtaatgtaaactagaacaatactatggaaaacagtatggaaacttcttaaagaactaaaactagatataccatttgatccagcaatcccactatggggtatctccccagacaaaaagaagtcattatatgaaaaagacagatgcacacgcatgtttatagcagcacaattcataactgcaaaaatatggaaccagcccaaatgcccgtcaatcaataagtggataaagaaaatgtaccatatatatattatatattatatattatatatatatatatgcaccctggaataccactgaaataatgacattcatagcaaccaggatggagttagagaccattattctaagtgaagtaactcaggaatggaaaaatcaaacattgtatgttctcacttataagtggaagctaagctatgaggatacaaaggcatgagaatgatataatggactttgggtacttgcggggaagggtggaaggggagtgagggataaaagactgcacattgggaacagtgaacactgcttgtgtgatgggtacaccaaaatctcagaaatcaccactaaataacttttccttgcaaccaaacaccacctgtacccccaaaactattgaaataaaaaataaaaagcaaataaataaataattgtaatattaatatattattttaataatattaaaaaggcttcacaagataaggtaagacaaataaggtaatttgaagttccgaaattgcagtttaatctcatagtaactttatgtgtatgtatttttgattttctcttttcctactggtaagtttggttgaaagattaccctttgaggagggagacagtgaggtggcagtgggagagagaaggtcaatcttacatattttgcattatctctcagccaaaattcaacatctaatgtctttttgccaagatactcatattaaattgacatactaggtatagtcagagaattaacaccaaaagcacaaaatctttcttataacatgacataaaaaatagtctttctgatatttgaccttgtgtgtcaaaatgttgaaaaactagttagctaccactttcccctcaaaacctaacctgaaactttcatttgaaatgacagttgtccttaaaataatttgagaatctacactgcagctcttactttctctatttcaaagataactgtttttaagtttatacttttgccaagtaaaattaaagttcagaatgagccaattttaaggccattttaggagtctgagagacttgttttcctggcactgaaggagtttactagttccattacacactccacatttgccaccctgagagtatcacaactactgctactgaatgattgtgtcatcttgtgaaaatgaatcacgtctctaatttagaatttagatatgacaaccaattatgtgagaacaaaattagtttacctgtcaagtgcaaaaaaaaaaaaaaagaaaaatatttaaaaccaccttttttctaggatgaatgagctaggcaaataactttttaacccaaacttatcatgtaaaaattgtcatggagagaacacaagaattcaattaactacttgttccctcagaagttaattgttgttagtcctattgtcatgtcttgttaatgcctgttcttcaattcattgctttttaggcttaaaaagggtatctcaaaggcagagaattagtttgatataattcagcttatttttagtctttttcctattttcccaaaatttgtagagtcaaattttgaatactagaataaatataaattgtatgtaagaattatttgtgaatttcaaaaatacctgccccctctttccctccaatatggctattctaaaataaattgcaacattggaatattccattctgattcttatcctaataatggaaaccaattgagtcatacagagttatagtttcttagtaaggcaattattaagaatgtaatatcttgtgatatataagttttatttttgagtaacttcaaatctttagtctcatttcacttaaaaatactttcaaaaatcaaattatatcaatagctatttattgagttcctactttctacagtgctctatgaaggatgctaatataaataaaattgtcagaatcatttaaaattatatgaaagattctgtttttttatgaatagaaaaaaatcttttatgtgataaatggcagctacatacaacccacatctaacgtcatgtttaatattgaaagatagaatacttctcattaagatcatgaccaagacaaagatgttcactctcaccagccctatttaacattgtgcaaaaatctttacaatttcaaagaagcaaggaaaggaaacaacagatactgaaattgaaaaggaagaaatgaaactgtccctattctaggagacaagattttctttttttttttttttacatttaaaatatttatttgcttaccaaaaaacccaagatataaaaggctaattataaaaaatgacaccagtgaacagtttttacccaagctaaccaaaaacagaataatattaacagtgcaaagaaatgaaaagaaacttcagtttacattttgaattaagatgtcaatgaaataaaacagcaaattcatcagccttgctgttcacttacatggctttaacatttgaagaaaatacaaaaagccttttcaactttgataatcacttttgactctttggagttgactgagaaaggaaactacatcaaaacttccatatgttaatacagattaaatgcataatttgaaaatgtgataattttttagagaacacacaagccaagttgttaccattccatctgaatactttgataaaacaacttacagacttacttgtagggtccattttcatttccaagcatggcataaaatgttttaaatgggacagttcttttggtacattttacacaaaatttctttcatagatttttaggcctaaaattaaagaattatacaggatgacactaagggggcaatttactgaaataactgacattctccactgacagctcaagactggattcagattcctcggcacttgtacagtttgatttctgtgagcaattagataatggcacatagattatcatagtcatgttagttaaaaacatctctgcctacatttatggtttgacttaaaatgaagaaatatgaagatattttcttttgtcacaaggggtaatcactatatgagtggattgctgcaactctcctgcaatgggcagagatatttcatcaataccaccatctcaacagtttgtcgctaactcttaagtagtctattttattataatgtattaatatcaatcatatctacacactataaaaatgttaattgagctcaggtatgataccagcatcttatctttacaggctcacagggaaaagatgtaactcaagttgcaatgatatttattttattttattttaattattattatactttaagttccatggtacatgtgcacaacgtgcaggtttgttacatatgtatacatgtgccatgttggtgtgctgcacccattaactcatcatttacattaggtatatctcctaatgctatccctcccctctccctccaccccacaacaggccccagtgtgtgatgttccccaccctgtgtccaagtgttctcattgttcaattcccacctatgagtgagaacatgcagtgtttggttttccgtccttgcaatagtttgctcagaatgatggtttccagcttcatccatgtacctacaaaggacatgaactcatccttttttatggctgcataatattgcatggtgtatatgtgccacattttcttaatccagtctatcattgatggacatttgggttggttccaagtctttgctattgtgaatagtgccacaataaacatacgtgcgcatgtgtctttatagcagcatgatttataatccactgggtatatgcccagtaatgggatggctgggtcaaatggtatttctagttctagatccttgaggaatcgccacactctcttccacaatggttgaactagtttacagtcccaccaacagtgtaaaagtgttcctatttctccacatcctctccagcacctgttgtttcctgactttttaacgatagccattctaactggtgtgagatggtatctcattgtggttttgatttgcatttatccgatggacagcaatgatgagcattttttcatgtgtctgttggctgcataaatgtcttcttttgagaagtgtctattcatatccttcacccgctttttcctggggttatttgattttttcttgtaaatttgtttaagttcttcgtagattctggatattagccctttgtcagatgggtagattgtaaaaattttctcccattctgtaggttgcctgttcactctgatggtagtttcttttgctatgcagaagctctttagtttaattagatcccatttgtcaattttggcttttgttgccattgcttttggtgttttagtcatgaagtccttgctcatgcctatgtcctgaatggtattgcccaggttttcttccaggatgtttacggttttaggtctaacatttaagtctttaatccatcttgaattaatttttgtataaggtgtaaggaagggatccagtttcagctttctacatatggctagccagttttcccagcaccatttattaaataggaaatcctttccccatttcatgtttttgtcaggtttgacaaagatcagatggttgtagatgtgtggtattatttctgagggctctattctgtcccattggtctatatctctgttttggtaccagtaccatgctgctttggttactgtagccttgtagtatagtttgaagtcaggtagtgtgatgcctccagctttgttcttttggcttaggattgtcttggcaatgcaggctcttttttggttccatatgaactttaaagtagttttttccaattctgtgaagaaagtcattggtagcttgctggggagggcattgaatctgtaaattaccttgggcagtatggccattttcacaatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaatggtgaatgggagttcactcaaaagattctctttttcttatgtgtgcatgtctagacttttaaggagataaaaccttcataaacaaatttctcacaaaagaaagcaataaatatatacggtgatggatatgttaattagtttgatttaatcatttcaagatgtatacaaatatcaagacatcaccttgtatactgtaaatatatacaatttttatttgtcagttattcctggataaagctagagggaaaaacacagagatttctcctttatagaaaagagaaaattaaaatcaggggaactaggaggtttttttttttttttgagagagagagagagagagagctttaaatatattataaaatcatagattttggaggcaggataaaatcttaaattcttaatttatttaattttactagaactatacatattatatgcctactttgaacaaatgcaaagttaactgattatctagtcatttaattttagcaacataaatatggccacagattcaaccaggtatttgtgaattgactctatgccaattcacaacttagtttctaagtatattttgcttaaaataatgagaaacacatttctatacttctaaatttgggacttctttttactgacagaaaaattctctagatatgaatgactgtattcccaaatagctaacatgtgctctctagttcattttgcttagacccaaacattcatatttaccatattctgccttttatgtattgacctgcctgccatccataaacaagtggatgcccttgaaacaggaatcatgattctttacattcagtatactgtagtttctaactcagggctttcaacctaggtgcaattaaaaaatatatatgggaaggaaaggggaaaaaaagagagtaagctatatatctgagttgttgttaagttgctaccacatgtttttttgtgtgtttcttcatatgtactgattcattagcttcaattaaaatgacaaaatattcaattaatcatttagtttaaaatatataattgctgtctcatggtgtgatgactccatttgcaattagtcctacccaggagtggtagaaagagtattgactttggcacagaattctaactcagcggcctactaactttgtcaccttggctgagctacccaacttcttcaagcttcggtagcctcccttgtaaaataaggttgctaatacttagatttctgattcattgtgaagagagaatataatagattttcatatctatgctgcttgcctctcactaagaatgtgactgtgagtaattaatctctctaatccttagtttccctgtctattcaactaacatttattaagtcactcaacaaatatcaccaagtatctagtaagctccaggaatgcacacatacacaaatatccctattaaagaaaatgtaagaaactagagagcacaaagacaaaatggggacattttgtctctatactgagagttaagagaaatgtcctggcagagaagatatctgaacaagtcttcaaataggaataaatgttagccaaatgaaaaaattttgagagggatttctagataagaggagagaataaagccataagggtgtgaaacagtacggcttgtatgtgaacaccctaagcaagctgctatttgatagagtttagaatatacagaaaatgggagaaaatgaaactagaaaataaaagaatatgtccaggtcagagggagcttagacactctgaaaggttttaagcaagcacataacatagacactctgaaaggttttaagcaaggacataacatagaattcattggagaaagaaatccctgtagctaaagtgagcagaatctatttaagaagtgagaggtgggcattaggaggacaaagcacaagttagaaggctgtggcattcatccaagtggaaattatgctctgaattatactaatactgttgtacaatttataggagcaggtttaagaaatgtttagggcataaaacagatatgacttagtgacttcttgttgtgtgtgaagagggagaaccagagtggatgactgggtctctggcaattaattgaagttccaaacaaaagagaaaaagcacgttttggaaaggagataaataattatttcagttgagaacatgttgaatttgagattgcagtcagacacgtacagcaagcaaatggataactgagcttagagagataagacctgaagacagatatttgagttatctataaaatattgcctaccttccgagatgatgctaaggattaaattagataacgtgtataaagtggctaatgctacacagcactgtaaataaaataaatcagatggcatatttaagtactttactcaaaaatgtaattaccatcccatcctgcacataattatcgaaccaatctctgtatttggataaaatctgaagtaaaagttacaacttaacctaatggactctaaaacaaggtattgaagaaagcttagtaagacgactgtcaatcttccagttatttcttctctaatcactaaactattaaggagttggcttaacggtccatcctcctgtaactataactgaacagtttcctgccctcttgcctcttttgttaaatgcctcctggtaaaaagaatcctgtcttagatcctgtaaaatctatcttaacataaagcctctgatttagaatatataatttttaaatccaccaatataaagtgaaataatataacagaatgtattaattcaattttcaatttcagctaaggtatccaagtcctgacaaccttgaggataacggaaaacatgaaggaagatggaaaaagtgataatttttcctactctcataccagtttttccaaagcttcttccccaaattatagaaagtaccacccaccaacatagatagaataatagatgttcctttaaaccacttttaggtgactctacatctaatctttctaattttcccttgtaagcaatcaaaaaaatcttacagttgatgttaattcctaactatggatatctaaaaataaattaaggaaatggcattgccaagttttgacttgaattgattattttaaaaaattcctttttgttatgtttaaaacttaaattggatcagctggacaccacacatggtagagagctaaacttattcattgccattttctaagtatagcgatcattagatcatagactgtggagtggttgtgggttgataatggatcatgaatcctttcagagatgtgaagtcttgtccttcacagatgaggatgattgaattagttcttaatatcaagtagaataatctggctatacttactttcttattgtcaaattactcctaaaaatagggcagtgtgtggcactgtttgctggtctgcatttgcacatttgcattagaaaaaactcttccctgtgattgataaaaatccccaaatatatactgctggttttctaggtataaaatctgatttaatccgagcttcaaagcattaaggtcataattctatagtgaataacgttggacgactacctattagagcaatattttgtaaactgatgaattaatggacaatatattttcaaaacatatcacactttaattttcctactgcttctacagtgccacagaactgtttatgatccttagttctgtcaggaaaaaaaaaggaaggaaaagtaattttccttctaatgaaatggaagaaatgctcctcgagaagagtaagtgcctttcgaaagacattttctgcactgatagaaaggaggagctatcacaggactcagttggctatttccctcttgtgttgcaattgaaaataagtcatgagaaaagaagtaatgagtttcctttacagttgaaggaatgtaatttacaagttaagaattgattgactataaaatttgggaaacttttggaacctaggaagtggtaatacatccccatctgaaatggttaaagaaagaaaaatttccaaagccagaagaaaacctaacaattctcaaagccactcaagctatgcggtcttctaatattttattcactaagcattcagtcaattccaactagggtatcactcacctaggtcaccagcaagttttaatgacacagagtcaaccaagatttttatgttcttttttcttttagattttgattaaaataaaaacattctcctttttaccttcctatagttttccatgaggcataatcatacctctcccagcctgtaaccagtattttcttcttaagaatgaggatttgtgaaatatccacagctccatcttgcccaacatttagtgtatggtgacaatatccattgaagtcccatatctttaagagaaaaattaaaaccactttgagacaggaaggtaaactttttatattctgaaccaggattaattcatttaggatatgtaatcattaaagaaaatcaactcatcattgaattttgccactatattactcttgtaatattgtgaaatatctagttggtcttcatccccatttctcggcacaataacttttaaaatcctcagactctttctctaatgataagatagtatttagtatgctaatgacatgactccaggctggggagccctaaatagcttcagggtggaggctgttctcaagaaacgccaaggcataattagaaggtggaaatttcagccccaccctgaaacccctagggagcagagagaagtttaaagttgagttcatctccagtggtcagtgatggagtcaatcaaccctgtgtaatggagcctccataaaaacccaaaagtatgggagttgaagagattctagacagctgaacatacgtggaggttgctggtgggtgaaaagcccacaatggaagggctgagtccacatgccttgcattatgcatctcttccatctgttcatctgtatcctttgtaatatcatttataattaatgaatacatgtaagtcaagtgtttccctgagttccgtaagccactctagcaaattaatcagatccaaggagagggtcacaagaatgctgatttacagcccgtcagtcagaagcacaagttacaacatatgcttgtgactggcatctaaaggaagaagcagacttgtgggactgagccctcaacctagaggatctgactctatctccaagtagacagtgtcagaatagaattgaattggaggacacccaactggtgtcctctgtaaaatctaccacagaattggtgtgtgggaaaaatccctacacacattttggtggccagaggtgtgtattgcattcagtgtgatggtaggagaaactgatttttttcctatataaagtcacccatcacttaataacaggatacattctgagaaatgcatcactgggtgattttatcattgtgccactatcatacagtgtacttatacaaacctaaatgatacagtctactacacacctagactatatggtatagcctattgctcctaggctacaaaactgtacagcatgttactgtactgaatactgtcaacaactgtaacacaatggtaagtatttgcgtatctaaacatagaaaaggtacagtagaaatatagcattataatcttaagggaccaccatcgtatatgcagtctgttgttaactgaaatgttgctagacagtttatgactctacttgtaactctatcaatctattctaataatagttcttcaaatactgtaagttaatatgtatactaaatggagagacaataaaaaatcatgaagaaaacgattttggaatctgttgacatcctgaagttttcactatgtctaaatttctgcttccttatctgtgatacaggaactttactcctcagggatgcttggaggattaaacagctgatacagaacctgaaacagtcatcatttactagatttctcatcctctaccgataaaacctcctgttgatggtgggtgccagacccagtcctcaagagggcacaagcagttctggttaacctacttagacagtggagtgaaaacttaagcccaataggcatactttaagagagagcatcattagattagtagcagttaaaactaagccctactatgaaaccttgttggcacatcatgcatagaggtcacattggtgctatcaaaattaaaatgcaggccaggcaccgtggctcatgcctgtaattacagctttttgggaggctgaggcaggcagatcacttgaggtcaggagtttgagaccagcctggccaacatggtgaaaccctgtctccactaaaattacaaaaattaggcagggccggattcagtggctcatggctgtaatcccaacactttgggaggctgaggcgggcggatcacaaggtcaggagtttgagaccagcctggccaatatggtgaaaccccatctctactaaaaatataaaaattagccaggcatggtggcatgcacctgtagtcccagctactcgggaggctgaagcaggagaatagcttgaacccagaaggtggaggttgcagtgagctgagatcatgccactgcactctagcctgagtgacagagtgagactccatctcaaacaaacaaacaaacaaaaaaattagccgagcatggtggtgcacacctgtaaccacagctactcggaaggctaagagcggagaatcacttgaacctgagaggcagcggttgcagtgagacaggatcatcccactgcactccagcctgggcaacagagcaagactctgtctcaaaaaataattattattattaaaaggcatataccctttaaaaatttagcttctagaaagtcatctcacagatgattaaaaattggcttaaaatttggcttaaaaattcagcttctagaaaatcatccacagatatattcatatatgtaaaatgacatattttcaagcatattcttgcagcattgttaaaaagcaaaagatttgaatcaatgcaattgctcattagtaagtaagaaattgaacaatcagaataaggactatctatgcagtagcatataatgtagccataaagaagaatgagtcatctccattttcctagactctgccaaaactcaactgcctatggaagcttgagcaagttgccttaactccttgggcttcagtttcccctactaaaaatacaaaaaattagccgggcgtggtggcaggcgcctgtagtcccagctactcgggaggctgaggcaggagaatggtgtgaacctgggaggcagagcttgcagtgagctgagatcgtgccactgcactgcagcctgggcaacagagcgagactccgtctcaaaaaaaaaaaaaaaatcaggataagagtaccaaccttatagatatacatatatgtgtgtgtgaaatgctcagaatagtgcctggttcatagtgagcatggaataaatgttagctaacattattattattgtatccatttatatgagtcaatatccaagacagaaaaatgcaaatgcagaacagcatgtatagtaggctgccatcaagaaacaaatggccaggcacagtggcacgtgtttgtaatcccagctactcaggaggaggctgaggcagtaggatcatttgaacctaggagtttgaaaccaacccaggaacacagtgagaccctgtctctaaaaacaaacaaacaagaatgattgaacgaaaataaacaaacaaatggtgtttgtggctagaaaggtgcacaagaaaacagtaacagtggtagcctcagagaaggagctggaaacagggatgatatattttcactatatatccattttatatttcaaaaattttattttatgcacacattaattattcaaaacattaattaatttaaaaatagaccgttcaaagccataatgaatgagttaataattttaagtctttgattatgtaggtactgaatttggattctaaatttataaattagattggaaaatgtcattcattcttgtttcttcatagaatatggtcagagaaactcaaccctgatttatgtatcctacacagaagttgccagacttcagaattctgttgtgctcttgtgataaatataaatgcaccttcagaagcagttattatactactaaattcacattaacttctaagatgtcaacgcttcagttgagacttgaggtgcacacatactcttcatccatgtcgctatgttttcctctaaacatggctcttaccaagtccaccttaaataatttccacaagtaggtattgcaaagatctgaatgtccccaggtccgactaagtcccttagctgggaatattttagcagaatctacaaggtaagccttaccctagattctatacccagttactttccaagatagaggtaaatagaacctaatccgttcactccaatgttcagtgcattctcacaccccaggactggtaagcgagatactggcttttactatttgcctgaaccactgtctaatactccaggtccagttatttcccttttatttcacctcaattattgggattatggttgtcctggtaccttcacacatcttatcagctctcctgtaaactagattactttacttaaacccaaatctccagtccataccttattccattaaccttctcataggccaacttctactgatttccagagattcccttttcaacccacaatagcaccttcctcacactaatgactgccagcctgtaatctccctgaatacctaaacttctaggatgttctacctacatatccaggtagctttccatcactctcccctacagcttaactgagtgtatcatacactacaccatggaaggtagtctaatacccagttatagcaggtttgagaaacattcaaagtttattcagggaattaccttctattgcctcaaaatggcacaagccatttccaatcaaagactcattactcttggggctgaggggggcagagaagattcactggtgggcatgacttcagatatcaagtatctagtttttcatgaaaagttgaccattttgaaaaggaaattagcaccttcctcccagaagaaatatatgataattatagaataagaaacttagaaatataaaatcatgtaagtttagaatggataagattatgattattctttctactgtctgaatttcacataacaaaaattaagattacaaaataggtttacttttaaatatttatttcttgaaaaatttgcatctatgccattttttaaagtttagttaagtgttcctgatttctcatttaatcaacttttaaaaagaaaactagagacattagccaaagcacatgaaattatcgaggcatcgtattccccaaagtagtccctattgactacactgaaaagggggctttctgaaatgagtaagccaagttatattttcattctaaataatttattcagaaaaattatttattcatttttccacagaggtttattttcctagcagctttattagatggttggagttatttcactcttaccatgtctcatttctcttcttgcaataccaaaaaggcaaaaaatgagaatatctatagccatgtcttctggcatagtattttagtctcctcatatctggatagaaaagcatcattgtgttcgcacctttacagtcccatctgtgctgccagtcaaaagccgagtctcatttgcatcaagggccatagtgctgatttctgcgttgccgtggcaaccagtaaactgtttgattttctgcccagtgtctatcatccagaaggaaacagtagaccctgtatcagagctgattacctaagagaaaataacattttaaagaaattaaatatagtctcagaatcaaccatttatatttcaataaacatatccagcctgtgcatttctagtccaaagatcccccaacagtcagagacatttttgtaatggactttctttctattaagctgataacatttcaattttgactagacctgaggtaatgaagtcgtgatcctctttatcagagaagatagtaatctgctttccttactcaccattcagctttagtgtctagaggccattccgaaatcaaattctgaaaataaacttacgaatctttcccatttagatgagaaagctgattttactagtcatggtgctctgacactatttactatatgaaaagaaacattttataatatagcagctttcatttagcattcagaaaagaagctctaccagccattatggaaaatgttaatttcaacaaattactagagctgtgcttttaatgccattagtcctttgctttcttttttcccaaactactgtgtatatttttatagctaaacacaattattgatagattactaaaaaaaaaaaaaaagagcacaggttaaatataaatctacatgcacactttgaaaggaaggcaacaagacaaatgctagaagggaaaggattatacacagcagttcaaaaatgagaaattttatagtggcaagtggactgctaatttcagctcaagatatttaagagattcataggttaaaaccacctagctaatatgactttggaaaccaaaataatgaaagaaaaataattacataaatgcatagctaggaagttctctaaagcaatatgtagattttaaggaagcttaaagcatttctttttctgtttaggtattgattaccattgtataaatgtaaatgtattaacaatatgttaaatttaaatgctgcttttcataatcaaatgggttgaagtttatcaaatgtatattcaatactggccatcatgcatacattcattcattcattctacagccacttgcataacatccaggctccataacggcaatggaacttcactggcaaaatcctgctctcaaggagtctattgtctatggtctacacctgtacattaaaaccacctggggaactttaaaaagcatcactgcataccagatcagaaactctgattcaattggccaaggaaatggatctttaaagagcatcacaggtgatttaaatttacagcctgacctatgacctgctggtctagatgaagaaacagacaagaaacagataaatgctaaaaaatgtttcaagtttagaggaatcacctttgggtactgtggaagtacagagtggaaaacctgaaatccacttgctggagtgggggattgggttagggagtggaggagcaaggggcaagtcaggattcacaaaggaggtgataactggtctggaattgaagatggagacatgtatttattatgaggtgtaccccaagccctttcacttgttatctcatttgatctttatgaaaactctgtgaaataatgttaccaacattattttaccaacgacaaaattgagtttgtaatcagctaataatgtccccaaacttacaggtttgaatccttgacatagacagccacatcataaggtcttcctctattcctgcacagcattccagacaactaacagttcacttagaaaagtacttggagaatattccaagaatgagaaacaatacaaagtttaatgagcctgagcgcagagtatttgaagggacaaatatggtgggatatcaaatgagtaggcaagctgaagatggaattttagaaatctctggtaagcagctccaaagaatattgagtaattataaagtcagttttactgggagagggcccacagctttcatcaattatcattgggggccaatgattaatccaaaaggctaaaaacattattattgttcttaataaggaaaagagtaatacagtgttttttgtcagttggcttgtaaagatacttcttgcagcaatgtggagaacaaactggggttttgggaggaccatttggaggcttcagactagtccaggtaagagattctcaactaacaaaatagttctgggggtacaaaggaggggagcaactgaaagacagggccatgatttagcaacatgtgtatctcaacaaagaactgataatgagcatgtgatccttttagccctttttttcctgaaattacaacttcaatgagacaatttcttaaatgaagtaaacctgtatttatgctacacattttctctcagtgaaatcaaaattaccttaaatattgaattaccattgtgaaactactgtgtaatttctaagaccaaatgatctggatctttgaaataatgtaacaacacattaattagcattccatgtcattaactgtgtttctatttgattgtgtttgtgcactatacatggttgttaggagcactggatctggagtcaggatgcctaagtttgaatgtcagctgcctcactaactattgttctacctcggacattaagggcaagcacattacttacttttatgcttcaacttcctcatctgtaaaccagaaatattcatagtaactacttcaaaccattgttacgatgtttaaacaaactaatatttttaaagcatttatcacagtgcatggcatagccataaatcataaaagttaggtagtgttactattccatctaagcttcatttgcctgacctcttacttaggcttgtatcactgtgcatatccaaatcaatttaagaaaaatagtatcttgctttcctccaactatgacagtgaatgtagacaattaaattttagaaacctgattttagggccgggcgcggtggctcacgcctgtaattgcagcactttggaaggccgaggcgggcagatcacgaagtcaggagatagcgaccacggtgaaaccccgtctctactaaaaatacaaaaaattagccaggcgtggtggcgggtgcctgtagtcccagctactcaggaggctgaggcaggagaagggcgtgaacccgggaggcggagcttgcagtgagccaagatagcgccaccgcactccagcctgggctacagagcgagattctgaatcaaaaaaaaaaaaaaaaaaaaaaaagaaagaaacctgattttagatgcacattgaaattttgaattatacttgtgaatttctcacagaagtgcttaggaagttggattacattcattacagataaaatcatgaaagtgtaattttccaagcttgtgtgaaaattttgatagtagtcttttaagaaaaggttaaagattgtgcaggattttattatttctattaaaaaacatttttggattgattgatttgtttgtttttattattttaaattgacgcataataactacataattatggggtaccgtgtgatatttcaatacacatacacgatgtataatgatcaaacagggtaattagcatatccatcaccttaaacatgtattatttctttatgttgaaacattcaaaatccactcttctagctatctgaaaatacacaagaagttgttgttaactgtagtcaccatatagtgctatagaacactagaacttattcttctgatctagctgtactaaaaagcattttctgagcagctattatatgttagccatttcagtaccaaaagatgatactttttatttccctaacagaaataaaagagccatgttcaaagaaaagacttgattacctgttcagggtgggcatcacccacattacaaagcatctaatcattcaccactgttatctaacgtagatactcaatgaggaattagtaatgttcactttttgccattttgtactctttcccctgcccacctgactgagccccaacatactattcatcagtttttgtcacctttctctgcttatttaacaatttctcgtgaaatctaagtcagtcatgacaacagcatatagctagtctgatttcattttatggcagtcggcctcacggtgcagtttgcaggaaaacaatgtgttgaaactgactatgtctcaaacatccaaccagtattagccagaatctactctcactatgacaatattggaatacaagaataacaatataggggaaagggcgttcaaagtttagtgaaagaggagtgcatttaacattacttggcagatgaagaaaatggattcactacacgacaatggaactatttttggcaagttgttttcatcagcaataaagcccaggaataagtcttggcgtcacatgtctatgccaccttttaatgataccaaatctctttaagtttgcagtttatttctgattatctcttatcaggctagacttcagctgatgaggacggggccctgacagtctgcagagtgaaaatggtgctaacaaccacactccaggacacatgggcctcctcagtagatcgttgttctgatgagaacagtctctctctcatgtgcttcagttaataactgtttaggaatatgtgtctcctttttgtttctctcatctgaagctgtcagagctaatcagacaattctaagacatgtgaggctgtattcatgtcacctaattgtcttattgctattccaataacagtaggcactttagttgtcttttatgtgcatttcaagtcctgggtctaagaaaaaaaaaacaggaatcaaaaattacagcagcaaatgccacgagctaacagagggttgagatacttgattccattgctgtttataatttttttttgttagtgttgtttatggtcctataatataaaataggttacttcctttatttccattttgtagaaaatctctagaagttacatttcagtgaatagggaggtgaagagaatgatgatatctcagagtacaagtacaaattattcaaatattttagggcagccattctttagttataaaccttgcttagtggattttttctcttcttcaattaattggtaatttgctctttcaaattcattatttgaatgtactgaatacctgtaatatgcaaggccctagatctagacactggtgatccagcagtgaataagttctgctcttgcattttgtccagggagagaggcaacaagatcagaaaaaaaaaaaagcatatctatctacacacacacacacacacacacacacacacacttatatgtaaaatgcatgtgtatatatgtaatatagtgtgtgtgtgtatatatatatatgatgtttggtggtaacaaaggttatggaggaaaatatagctaagaaggaagcagagggcttttgtcataggtgcaaaattggggaatctgggaaggtctccctgaggaatcatttgtagagacataactgagatgaagaagtaagccaaccagatacttgggtgaaaagagctgcaaacaaaggaaacagcagtgcaaaggccctgaggcacagtgtccttggcacattcaaggaatagcaaggaagccagcaaggcttaagcagtgtgagggaagggaggagccattgcctgcggtcagtgcacagagattcaaaacaatccaaaactaccaaactcccataagaactagggaacaaatttcaaaagtagaaaaaaaaaactttcctctttttcactaatattaattagcatttacccttgctttatttcatgtatctttatatataagatcatttgttcttaacaaaaattctacaagggatgtattataattagtattttatagataagaaagctgaaacttagaggaattgaatcacccactctgtgtaaagtactgagaactctgcctgactctgaaactctaccaattctcttattctaaaaatctacttctaaaaacagttgagactgtgatgatgaaagaggctgaggaaatggtcctctcctacgctggtttagtgtagctttatggagagcatttggcaatattcgtcaagattacagatgtaaatattctctgccccaataattctaactataggaatttatcctatagatattttctcatcagtgcagagttctaaggacaaggtgaaaaactgctacattatttgtaacaaaaactgctggaaccaacctaaatgctcaaagtttggaatatgcatgcaatgaaatactatgcatctgtgaaaatggacaaggttactctttaggtaatgagataaaactatctttaggatgtattgttacgtataaaagcaatgtacaaagcagttcgtacatataaaatgctctcatttttgtaaaaaaagcctataaaataatatatattcttaaatattgagttattaaatattacatatctatttcaaagaataagtttacgctgcaacaacatgggggttagagatgcctacctgccacacagttaaaaattcatgtataatgtcgatcccaaaaaaacttaagtactcatattctaccgttgaccagaagccttactgataacataaacagttgattaacacacattttgtatgtaagagttactacatactgtattcttacaacaaagtaagctagagaaaagaaaatgttattaagaaaattataagaaagagaaaatatacttactatttattgagtggaagtcaattatcataagggtcttcattcgtgtcgtcttcacattgagaaggctgaggaggaggaaaagaaagggttggacttactgtctcggggtgacagagaccaaagaggtggaggaggtggaaagggaggcaggaggtcaggagaggtgggcacacttggtgtaacttcacagaaatatattgtaatttctgtcggactttttgctctttcttttctctaaaaatgtttccaaacagtaccaatccctcttccaatatttgctttagtttcagtgcccatagtgtagaaaggtctatgccataaaataagtcaaaagcagtcttgaataatcagaacgcttctgccagattgtctaatgtccattattgtctaacgtccctttgttttctggcactgcttcttctatgtcttctttctcagtcacctgtttgaaagcactcatcttcatcaagtcatcttctgttcattcctctgatttagtgtttatcacatcttgaatttccccaaaattcatatcttgaaacccttcacctcttccccattcccaccttttttgccatgttcacagtctctttcatgatttccttgattggctctgttgtagatcctgtgaagtcatgtgcaacacgtggacacagttttcttcagcaggaatttattgtttcaggtttgagggctctcatgactttttctataacaatgatggcatcttcaatggtgtgagccttccaggctttcatgacgttctctctactctgattcttttccatagcattgacggtccttttcataaagtaccagtaccatgtgtaatgagccttaaaggccctcatgaccccccttgtctagaggctaatttaaagatgtcgtgtttgggggcaagtagatcactttgatgcctttagtcttgaaatcataagattctgtggggccaggggcattgtctaatatcaaaagaactttaaaaagcagtctcttactggtaaggtgcttcctgacttcaaggacaaagtattgaaggaaccagttcagaaaaaaacattctcattgtccaggccttcatgttgtacagccaaaagaatagcagctgatgtttgtcttttccatttcaggctcagaggttagcagctttatagacaagtgctgtcctgatcataaacctggctgcatttgcacaaaataacagagttggtctatcccttcctgccttaaatcctgatgcttgcttctcttctttattaataaacatcctttgtggcgtttttcttttcagaacaaaggcattttcatctgcttaaaaaatttgttcaggcagcaatcctttcttctcaattatttccttaattgtgtctgggaactcatttgcagcttcttgattggcagaatctgctcctcctgttattttggtattttttgtaccaaattattttctaaagttatcaaactatcctttgctggcattaaattccccagctttagatatttcacctttcttttgctttaaattattgtataataactgctcattctctaatcatattagtctataggtatgcctttcttatagcaacctgcacccacataagacctgtattttcaatacgaggtaaaaaggtatttcacaaaaaaagtatatggttttttcacctgctggtgtaactacggcagtggtttcattaatttctttttctttttttatggtggtcctaatgctggattcatttatattgaaatggcaagcaaccacagctgcagacctcaacctatggtacatatcaagcaaatcaactttttcttgcaatgccatgagttttctctgcttcttggtagtactcacagcatccctagtggcacttcttatgagttccatgatattattcaaagtttatggtactgcaataaacaagataagaaatatgcaagcagctcaagagatcacattttactgagatgggtaatttaatgtagagagcaactgctcatttggagataagtatcacatggcattttaaacaaatgcaacacttgagctcaccacaacagcaacagggggtggctatgaaatcattgcagcagtgcagtatgtactacagttaatttttttttttttttgagacaagagtcttgctctgtcgcccaggttggagtgcggtggtgctatcttagctcactgtaacctctggctcccaggttcaagcaattctctgcctccgcctcctgagtagctgggattacaggcacccaccaccacacctggctaattttttcgtatttttagtagagatggggttttaccatgttggccaggctggtcttgaactcctgacctcgtgatccgccctccttggcctcccaaagtgctgggattacaggcatgagccactgcacccagcctgtattacagttaattttacacagttatgatttaatactgtatctttttgtttacatttctcttgactgcaagtctgtgtttgaatacgtaagttttgatacattttaactttttgtaatagatttgtgtatattttattgtactaactaataaaataggctagtacatacgtatcttttatgcattcattctatgtataatattttcttgatttttttatatttctgggcaatgtatctgtatttttttaaattgttgcaaatatccaaaaaaagttccaatatattcatttttaaaaatccatgtggagctgggcacagtgcctatgcctgtaatcccagctactcaggaagctgaggcaggacagtcacctgaggccaggagttcaaggctgcagcgagccatgatcatgccactacactccagcctggacacagcaaaaaaaaaaaaaaaaatcagatacagtgccccctcgcagttcaaaccagtgatgttgaaggatcaactgtctatataaagaaaaatatatattcacttgtttaagagtagaatagcccttaaacattgtggaagtcgtaaaactcgttgtctacaggacaggaaactgagtaggcagtggcatgaagataagagaaaatatatgccacctatctttttgttgttttgaatttttcaacatgtaaacacgttatttcttccaaactaatcacattaaataaatgtgtatctgttcgtacatgtatgtgtgcatgtacatgtatgttttagtataacctctaaaactagtaacttcttatgtttccatcaagtgactacagcacacagcctcagaactgacatataaccaattacagctttaagctagccaaaaaaaaaaaaatcacaactgtattaacagaatggatgtcacttggtgcccagcaaagaggcaggaaaggagaaaattttcattgtgtaaatctggttctgttcaaaaaagaaactcatggattttgcactaaatgtaagccctgaaaaggtagactgtcttgtacgatggagataaatttccctcaagcctgtcctcttttctccaattttacaattaccaagggaaccaccaattgaattgtttggattcccaaataccctcaatttccaaaaaattatgtgcagaaaagaggacaaaagatatgctatcaagagaaaattatacctcatccctcattttttaaataatggaaggccacatgtttattataaattttggatatgcatatgtatacatagagctgtttggactgcaataatctaaattaagataaggtaactataaattgtaaataaggttaagggtggaaaagtttactataaaattttgaatatgatggcatagataataactttgtacagatgctatacatgtatacataatggaattttttaacaggaaagttttttagtgtttacctttggtatatttttatattgtgtcacagcaaagaaacaaaaagctgcaattaaatgatgataaggccggatgcagtggctcacgcctgcaatcccagcactttgggaagccaaggcaggtggatcacgaggtcaggagttcgagaccagcctgaccaacatggtgaaaccatgtctctactaaaaacgtgaaaagtagccgggcatggtggcgcacacctgtaatcccagctactcaggaggttgaggtaggaacccaggaggcggaggttgcggtgagccgagatagcaccacttcactctagcttgggcgacagagagagactccatctcaaaaaaaaaaaaaaaaagatggtaaatatttgcttgtcagtgaatgttgaagcaaccaaaggtaagggcaccactctatggctgtgacctggaccagcccccatttttaataaataatttggcagtttgtagatagtataataatcaagcctcaagaaacagcatcactccagataaagtgaagagggtctagtattcaaatttgcaaagccagcatgcttctggattatgaaaaaccccacagagaatctcaggagatctcttggaataagccaggtgagcactgtctgacctatctcttcatgtaaccaagtatgtgattaatatattagaggttagaagcaggataaaaaagtaagattctagggggcaatttatttatcaaattatctgatattgcatatcctttagcctagaaacttactcctaagaatttaccttgaagagatatagtcataaatataaatgtatttatctacaaaaaagtcataatagtgaagtctacatcaagggaaatggatcagtaaattacgatacatatatagaatgggctactatgctgccttttaaaaatgataaagtagttctacatttagcctcaaggaaatatattctaacatattattgaatagaaaagtatgttacagagccttgtttacgtaaaatagtctatgcagagaaagatgtttagaatatgttgatatcagcaatagttttgtatttgagctttactgcattgctttaatttcttacaataatcatgtaacattttgcatgcaattaccaaaaaaagttattttgataagaaaaattgtaaataccatttactctattaaaatttgatgacacctaaatgtctaccttgattataaatgtgtccaaggttcccaacaaactgaaacattatctattttacaaaaatacatcaacctacatcattaggatgagaatcatagtgataacacaagtatattatctattctagtttctatgtctagaaatacatgttttaaagtttcctaaattcatgagtgttcttttgttttcttgtaaaaagcttcatttaagaactaagtgcaaagatggttcattagatctgcctccaggatattggattgctttaattctttcaaaattgtacattccaggggactccttcatccagtcccaacttgctctgctgctggctgtgagggcaaactttgccaggtgaaataaagtatatgatttcctttaaaaggctttgcatggcttaacatcactttcccagactaggattcaagggtatcaaaagacaggaagataaataaaagtcacggaaatgttccaagctgcttttatataggaattatattgggtccccactgaagtccaaatacaaggaaataataaagtgtaggcaacatgttgaaataacaacacaagggaaggttttcattaaattcaagcaaagggaaaatgttcaagaaagacaccaagccaaataaccaaagatcaagagaccatgggctgaaaaagcattgctttctgttacacttgggatgaaaaatggcaataatttattatgtctagtagtcgagcattcattttgtgctcagaacagtgttaggagctgtgggaaaatacaaaaatggaacaaaaggatcttcccctcacaccaaaaacataggaagagagagaaataagtttagttaagtgttttactgggaaaacaactaaaaaatgcgaccaatgctcaggaagaggagaagtaagtgtgggttgagatggctctggagacttcagggagctgaggaccaaagctgagtcttgccactaaatgtttacaagacgaaactgcaatggcgaagaagagaaggaggaggataaacaactttcccacctcaagggacattcctgaggagaagcagaggtagggaaaaactgcagttcagggtaccctcccctttctaattcttcctaacatttgtcatcacatgccacattgttaaaataaagattaaggaatcttaagaagttaataagaaaaggagatgtcataaagcagcaacattcgccctctttggtatgggggactttaaagacccttacagggctggcagcatgggagacaagaggacacttccaagatttcagtcctaacaaggcaatgccagggaggcacgtgctattcccattactattcctacacccccacagacacacacattttaagaagctggcaaactaaagctcagacaggctaagcagtctgtccagtatttgaattcacatgtttccaacccagcagttctgaaaacttttggtcttgggattcctttgcattcttaaaaagtattgaagaatccaaatagctttatgtggaatacacacacacacacacacacacacacacacacacacacaacacaaatagatagatctgtatttttatacttatttaccatattagatatttatagggagacattaaaacacaagaatataagagcacacattcccttagccataagaacaatgctgttatcacacaacacacatcatgcagcctctagaaaactccactgtacacttttgagagagtgaaagtttagaaagcaaacaataaattaatattatgatgaaaataattttgacctcccagattccctgagagaatctgagtctcccagaggtccaagatcacactgtgaaaaacattgttttaatctcaattctatgctttatgtttccaagaccagacagtgatacattcaacaaatggccgtcaatatgctcctaagatccctttactgctttaactcccacgatgtctgcaaagtattcccaaacttgccacaccaaaataaaccctctctccaaaaatgcaccgtgagtgctcaagcttctttgcaggtgctcacgttgtatcttctgtctggaactacttcctcctccttttagagatgttagctttcagggctctgctgaaatgtgaccaacactggcctcaggcagaattgatcactctccataaaaagcacttcggtttttacctctacttcattttactatgttctactgtttcttgttagtaatatgtctcccttcccttctttcattccacaatcctgtgatgagcacctgtccaacaatcatcagcactatggttaggacccagattttcccttaaagagttgaatcttcctgagctactgggggcaagaaactatagtttattatctctaattcttcattcttggtacgacacttgttcaaaactgtgttatttgctttgtctaattactctaaaatgataagttatcactgactgatgggaatgtgagtgatattttctttgtacttttctgcaatacatttttataattataaatgtaacacatacaatgttcatgtttctgtaactcagcagctaataggaaatgctgatgtatgtgatacacagctctatgtgctttacatacatatcaatgcttatcattatttatgttattcacagcaagtagaggtgtaaatactcaactcaattgtataatgatacatcctacatcatataccatatgtacattgtcctttggttgcctataagtggcatgcatgtgagttaccttggctttgtctttatgccccaaataaatccagatcttctttgtgtctaatttcctgaatttctcagggaatattgctcatcttatggccaggcaacataggattttaacatctacacacaaatttagcattttaactttgcagatctcaattaggagaatgttctcttggaagcaaatacatctctcagtggccaccagggagtcaaattaactggttgccttcataaagatcagtaaaacatttagcaggaaatgttttcccgcagatggaattcaaaatgagttgttttctaaatgattttatctcctagaataaccagaaaacagtgttttaaatagtgacacgacacactacccattactaacaaagggctttccaccccttgcgcaaaatctccactagtcatttctatgtgaatgcagaagcttctgcagaagggaaaagaaagaatggattgagttactgtttaattggctgtaagctggagacttgcttctgcttggctcctgctgtgctgttaccatcaggcctgacgggatcactgcagcaggctaacctctgatgttgcttgctcccttcatgatacccacaggctgccccacactgagctcactggcttcactgcctgggccgccctgtcctccaagaagggctgtggtctgcgcagtaactctgctccaggggagccctgcttcttcattgagatgcaggtagtggtcccctaagccaaggctgcggagcgtcattaaactggtggggagacaaacaacacttgtgctgcataccaagtggcatcatgtttaactgaatcattttattatgaatacattctgggctgccactgtgaaccactggtgtaaaatatgctggcaaaatggatctctgctaattatgtttcatgcatatttcagaactttccacagggataccggaagatggtgttcatagaattttacaagcaggttcacttgcatttggctcaagactagcagataacaaagataagttcaattatattacaggttgttttgttttagctggaatgctgtaattccttataactctatcactgctcctgtggtcactggctgaaaatgaaatcattctccaagtccacctgaatgtatattattgcagaaaagcacatggctattaaatcatttcttcccatatttgcctttactatatttgtctttcattttaccttaaactgaattaagtaaatgagcctctggacttggagatatgttaggagagtgaaagaaaagaaagcatcattacctgcttcaagatagaattgtaaagaacacaagtgactgctttctcatggcttttcaccctcttgctggcttcacttttcattgccaacaatgctagctggttattaaacgagatgaaaagtcgtccatgggcttcatcaaagtggaagagacatctgaagtcctgacttttggggaaagaacaagctatcctctggatggacagctggtgttgaatatcccagagtctcaaaacctggatgaaaagtgataaaatcatttcaatatgtcaaagataattgtaatcttttagccaattttttttctagctcaccctcaataccaggcagacagttgtttcctccacagtgctataattggttctcaattctgccatagcacctattattttgtatttcagtcacctgtttaaatatctcctaaattgtaagctcctctaggaaaggggttgggttctatttcagtccctggtataaggcttggcatttagtaagtgtttgttgtaggcagaatagtagtcccccaaagatgtccatgtcctaattcccagaacctgtgaatatgttatcttaggtggcaaaagagattctgcagatatgactaaattagggactttgagatggtgagattgtcctggattatttgggtgagtccaatcataagggtctttaaatgtgaaagagggaggcagaaaaatgatcagagtggtgcaatatgaggactcttcctagtcttgctggctttgaagagggccatgatccaaggaagcttgaaaagacaaaggaatggtttctcccccagagccaccagaaaggatgagactcatgtcaaattccaacctacagaacacaaaataaatttgtgctgtttcaagctactaagtttgtgctcatgtattacactagcaatagaaaactaatacagttctctctccgtctgtctatatatacatgtgtgtatacatatatatgtatatatgtgtgtgtagatacatgtatctatatatgtgtggatagatatatatgtatacatatgtatgtatgtgtatatatgtatatatgtatttttggtaaaataaaagaagtggcattaaatgaggtcaagttcatataaccacagatattaaattcttattcaaacaccttcaagacacataaatgacatgcatttaccaatggatagtagagggcaaacactaaatccttgctcaagaaataggttgctttagattcaatagacattaaaaaattgtttttccttttcttctattttctcatggctcccttcatttcaaagagggtgagtcacactaagtgtcccaggaagaaaacagaaagatgagcttcacaggtgtgagtgttggtgctatcagtagtggtacagaattaacaggctactgagggagtgaaaaacctctccaaaagggggtatcaggcaagtcatcaagaccttgtttacttttaaaaaacatgtagaatgtatctgttgtacaaaatcaaaaatcaccacagggcttttatcttaaccctatctctgtaacctagggtcagatttcctgggttctaatctcagttctgttccttactaacagggggacctccaataagttttttttttaatctgagtttttaatgtagtgtctacctcacctaatgctatgagaattaaatgagagtctatgtcaagcacttaacatgatgaccagcctgtaatgcgttcaatgaatgttccttattattatgtctattttattttttcattgtgtaaatattagaacctaaaagcagaaaacaatatttcaaataaactagtctatccaacatgaaaattatttctaaattatctataaaagatagtttctgtttagatgagtccttattgccccataaggcaggcaaccttatagtttttaacctattttaaatcatacactgctttgggaaaaaaatctattgaaaatgatggttctatcccaactcatcaaatgcccacagccatatatatgtacaattttacatataatttatttgggtacatagacacacctcacaaacatactaacaggtcctaggaatctacaagataggaatccctacagtaattattaaatatattcagccaaagaaatcttcttctaccttttcattctatcctaccttcttctcacacctgcataagcttcctcttaccccttttctccaggttaaatgatcccaattctttcaaccatttcaatatcagttttcagatctcactaccacctaccatggtggcctcttgattctctcaatgtctttgtttccactttctctctaggggagggtagtcatccagcccttgtttacttttaaaaaccatggtaagatgcgtccattgtataaagtcaaatagcaccagagggcttttatctcaagccatatattctacccctagtcccaatccttagagatggccttcttttactcttttactctttcttgtttatgatttttttccacaacactaaataatataattgtgcacacatgtgtgtgtatatatgtgtgtggtgtatatatttttatacaactatatctagtgactcagaaagaagaagaaaaattactaatactccttttctccctttctcctcccatttctcccaagttagcatgttaatttttttagtcctattgttattattttaaatatgtttatacattaattattgacccactaatttaacactatctgtaagcacctaaaaatctttaaagatctgctttaagcaagtcatccagaatggagccaatatttccagtgtgttctaatcattacaggtgctatgatttctttaaagcagcctatttttgcattagctgattaagcctctccatcatgcttttcacttgccttgatgtcttaattgagcaaaattctatatattattcccaggaacaaataaccaagccagatgtctactatcctgtttccaaaaatatattttttaattaagactaaaattttccctatttttgatctagagtttcaagtgacaatatcattttgaatcctaatttcccatgctgttcttgtgatagtatgtgagtttttacaagatctgatggttttgtaagcatctggcttttcccctactcgcacttctctctcctaccgtcatgtgaagaaggcccttgattccccttcaccttctgccataattgtatattcctgaggcctccttagctgtgtggaactgtgagtcagttcctcaccatgcctttataaattacccagtctcaggtaattctttatagcagtgtgaaaatgggctaatacagacataggtagtgttcaataaatattttttgaattaaagattgtggctcactctgtctatacccagatcattgatgaaaagatcaaacaggatatgcccaagaatacaacactcccacaaaaaagtctgcctcacttccacatatttatttacccaattgcagttctcacataatcctcaatgaaattttatgggactttttaaaatatcttacagaaataattatgcttctagcatagggtaatgtctccatttactctaactaccagcccttataacaagcttgaactaacctagtcagtctctacttggtaaaccacatcaccaaaccctctgaccctaagaatgtatattcatagagaaaattgggttttcttgccaaagatttttattaaagaactcattctggtttttaatcatcactaaaaaaattttaaaaaaattgtttaaaacattctggcagctctccaggaaatgtttatcttaaaaaacatgaattctgttataaatataaatagaattgataagcttttattttgaatgttacagttataaaattagacacatctagatcattctcaaatactcatattactaatgataatcacgtcttcatcattcaaaatcctgtcttgtttagtatggaccccttctaagaaatagaaactaacttcatgtcataataataatatagggtatagttgaatacacattgacaataactccacagtactgatgaactataatttctccagaatcatttttcattgtgttaagtaatttatattggatttgatatttcactgacatttagtcacataaattatatgataaattaaaaacaggtgagccataacctgtctagtctacaacaggttacttcttgttgttagcaattaaaactagaaatttttttcagaatgtgcacatttgttaattttttaaattaatgtttactgttcttcttcttctaggcaaccctaaactctctcaactaacgatcccactaagtccaccttccatctttaattctctaattttgctttctgctgagaattaagcaacagcattgaagtacagccataaaagcataaaatgggtgacggtatatgacctcccttatgttcttaattttccctgccagtggttcttaaacttgactttagaaacacctatgatgctcgagaaatctcctatgctttggccctttcccagaccgattaaatcagaatctctgaggatggggctcagacattagttttttattcccaggcatttcctttgcattatacctaacttctctgttttgttttaaggtcaatgataatctccttgaaaaagaaatctttccctcagcttaattagtaatatcgcatagcttagctttaaaccaggtaattgtattccccttcttttttattcagtctatatccttctaatcataaaagccctcacattaattcagttttattaatcaagtcctttgacaaaaatgtcacttaaatatctagttattatctgagaatcctgcgttctcaccttcttttatattcaagttgacttctggaatagaattaaaccacagttcagaaaggaatatgtttaatttcaattttcatttcagatatcctagaagggttttctttatttttagtagagaaaacagattcacaaacttttaagcttaaaaattacaatggaataatttttttaatttgtattatccacaaagttttatttaaattgatctgtatctatttgcatcattatatctgagaacttgtgatatctgtctaaactcaggcttactaagtcaagtccatgaacgggcatgtttgggagctctgtatttcatcttcacttgtagattaacaagaataagcacctaagtttatgattttatattaaggcaaataaattttgccataattagtaatatcatatagcttttcaaataatgataatgacattttcttgcataatctttatcttcttttaaccgttaaccttataggaatgcaatattacaagtgaatactgtattacttatacacaatagacctagaaatcaatggattgagactccagacacccaatcctagttttcatcctaggcagttcaggtatgtgatttttatctttccattttctcatctttctgctgaaggggcccctaccaactctggaattctgtcaaatttgtctacaatgtagtcaaattactcaatccattatctaaatattctaaaataacaatatttcaaacgaattaaaaaggtacattgtgaggattgaatcaaagaaatgtaggacatcaccatgttttcagcctagctttgctgaagaatcccctactcccagccagaggtggacagaatcactattattcacacaggcatcatagaactataataaatcaacaagtaaataatgaaataaagcttttcttctgtgctacaaatgttacatttataagtagataacttcacagatataggtaggggtataaatagatgtgtgaatggatagaaaatctattttcagtgcacttttaaatccaaatcagtattatttacatactagcaacatgtttaattcaaagtagtcagaaaataaaacaatttgtaatttcctcataaaggcataaaagtgaaggagaagtagaaaacagactcacatgactccatttaaaggagacctgcttggctttatcaaacatttactaactcctgttatcctgttagagatagatataaaataacaataagaaaaaagggagagtgtgggcatgcttccgtgtgtgtgtgtgtgtgtgtgtgtgtgtgtgtgtgtgtattgctaggggatttttgagtacagtagtgcagcagcccagctcaccgggagcaatccacacaaatggatagcatacttgcagataataggataacaggaatggagggcattgcttttcctgaacacacttttatgtactaacaatctatttatttagaagttaagcctctcagtaatccacaaaagcataatcagtaaatgcttaaagacaattttgtttgacatgatgtatgctagcagaactattctactgaataccttggctaacatttttatcttaaagtcatataacatttcttccttcagaaaagatttttgctatttttttccccaggactaaaatcaaacttaaaatactagtttgaaattaaaatcttctcttctgccgtttatctttaaattgctactataactattataatagttatactatttttttttagttctcttcaacagaaatgagagaagacacacagctctaagactcgaatttccactatgtgtctgtttattctttcattgaccttaaaagaggcaaaacattgtctaacaactctgaattgttgggcagaaatctcattgatttcccagttctaatttgcaataggctgggcacagtagctcacaccagcactttgggaggccgaggcaggcagaccacttggggtcaggagttgacctgcctggccaacatggtgaaatcacatctctactaaaactacaaaaaagtagttggacattatagtgcaggcctgtaattccagctacatgggaggctgaggcaggagaattgcttgagcctgagaagcagaggttgaagtgagtcaagatcactgcactccagcctgggcaatagagcaagactttgtctcaaaacaaacacacacacacacacacatacacacacacacacacacacagatagagagagaaagagagagagagagaaaaacaaatttgcaataaatttaactaatgccaacatttcatttaaggtgctttcttttttcaggacagaagttcatttggagaatttttaaatctcagcttgattcttgcaattatcattattcacataacattaaaaccttaacagaatttttgcctttaaaaatgtcgtttaactttcaaagatcacagctcctcttttaatttacaatgtaaattaaaactctttaaattttaaaattctttttttactcaatatttatactaacaactttaaaaaaaatcaaaagcagctacagcatgagaattccgattaaattatcattaaaaactaggtttttgtaaggggtcttcctgcttcaaagaaatacagttctgaataaaacataatttttggctagctgtggtggccacatctgtaatctcagcactttgggaggccgaggtgggaaaatcatttgatgccaggagcttgagaccagcctggacaacatacaaagaccctgtctctataaaaaaaatccagaaaaataaagcataatttctgttgccttgctgggccttcagggagtaagaagtatttccatgggtccaaaaaaacaagggaaaaagaaacaaacttaaaatggggacactgaacagtagacataaaggaaagaacaacaaccagaagcctaagccttggcccaatagcaaggtacagccattgaggtgagactgttaaactggacaactgagatgcagaatgcagtagcctcaagacagtagttttgcacatttcattataccctacagaaacaaacacaaatcttctctggaagaaagcatcttcaatttagttcctcagaataactatatattagtaacagtaaaaaatgagggagtgagaaagataatcaagcataaaaggaaacaagtcactatgaggaagaatcaccagaatagcaaatatcaagtttagaacacaatgaactccagatattctcattacaagcaagaatgtaaaataattaggtataacattaaagagctacaagtcagaatcccctaaatgaacaagcaacaagagactatccaaaattacaagagagttcaagaaaaccttttagaaaaaaagttagttgaaattaaaacccagtgtatgagtaatagagaaagtggcctcctctccattagaaacaacctcaagaaagtcaagaatatgataagaatgcctcctaaaatatggagaaaaaaaatctgaacttagaatgggatgtaaattaaagcatgcaatttttatggaagatagtgaagagtgaataaacagagaaatactgagagctctttctcaatatcttaaagatgtcaaacattaccaaacttaatgaaatttcaatccaaatactgatagggcttttcatgggaatgggacatttgtactgatcctaaaatttacttggaaggataatatgttggaggatagttcaaatggaaaaagaaaaacaataagtaggaattaccctacctggcatcaaagtacacaaaaaagagaatggttaaaccatcgtatattagcataggaaaagacaagtaaattaatggaaagaataaagcatatacaaacaaattcatgtatatttagtaattcagatgatgataacaatggcatttcaaatcagtagtagagacagattatccaaaaaataaccttaggcaaccatttgtagaaaaaatctacacaaaaatgaaccataaagttaaatgcaaaaataatcaacaatagaaaaagtattagcagaaaataaagaatatttttataataacttacaaataggagatgtggaaaatattttgtgtctaaatttgtgtctaggttagagccataaagaaaatcattccttagactcatttttttaagtcttgactatctttttcttgatcgtaatagcttaacattttttattatcttttctttgttatatgcattgcaaatattttgcctctttagagcacacatttttaaattttgtttttttcattcaaaagttttaaatatttataatattgagtctaagaaatgctttccttagataaatggcatgatcagatattgcacaaaaatcaagaactataaatggccaataaatatttgcaaaagaaattcaccctagtttttgttcatcaggttcacacacaaaaatgaacacattttcactgctgacaagaatatgagaaaacagacactttcatatacccctgatgagcatgcctattggtacaacacttcttcactgtaataggcaatatttatgtaaagcctttgagatctaatagcataacttctagaaacttattacaaaaacattaacctaagaggtcttaaaagggtgcgtgtgtgtgtgtgtgtgtgtgtgtgtgtgtgtgtgtgtgtgtcatggctaacaaagataaacaacttagaaacaatatctcctttaatcaacaggtgattaagtagttaaattatggccatccatactaagaattgctgtatagccaaaaaatacagatatatgtatatctatgtgtctatctataaagatcttcaagagatactgtttaggaaaaagcaaattgtagaaaaaatatgtgtcatatgataccatttacataaaaactaataataaatactaccctgtatttgttcacactcaaaggataatatatataataacattaaataaagttgtattttgttataatgacatattattataatacattattatgtataacatagtaagtatatagcaaaacaatataagaagatacacgtctagggttgatgatagttattccttgggaaagaaatggatttgaaggggaaatgatcataaggaatatttactttttgcactacatgcttcctcatcatttgcaatttttataggagggcattaatccatttaccggcgtactttaaatgaaaatcctttgtttctggatggatagatggaagtcgggatggggaacagtgtggaaaaaaagaaaagaagataaatggtaagacaaaattctgattgtattgttcttaccaaccataggtctacaatatagaagccaggttctgagaaaaatcagaacctcaaacaaaggattaagccacaaactgatttgcttctgctgaccaaatcaggattagtggcctcggggagaatagttaggagtaatgaaaaagctgaattaggcccacaggctgaatgtcagtctccatcagagagtttgacataggcttcaaaaatcttttttactccccatggtggttcctctccaaatgactaagttacttgccctcaacagggccttaccaccagtgactgccatctcaagagaatcagtttaggagttcaaagcaaaatacgattgaactctttaatcaccactggaaaatagcaatagagaagatttccaaaaacgaaatgaagtttcagatcatttttggagaaaattttgtagatttaaattgctttgtctatagatcttctaattcagcaattcattgaccaaaacatgtttcaatcaaaagctcttgaaaacataatgtgttttcattttttctaacttaaccccagtcctataaaatatccaaaagactttgacagcaataaagcagaggcttaccctggtggcagaatgcattgttgtttgttgtaaagacgtaaagactgagatcacgatgcatttattaaagtgaaatagatttagactaacatgaaagacaacatgacaagcttcattataatgtaatgcaaacaaaacaaaaatagaaagataaattgtttttggaagaggccaggtagtcttagcattgatgatagctgtacataatcacctgtgactctaaagacattttttcacttgcttttacgttataaaacctctcggggaagtcttaatgacaaaatatctgatacttgtttcatatttatatttgataaagattctcttatttaactacaatttattggggacctggtatatatatggtataattccagaaagacattgcccctaaccttatgaatcctatcatttagttgatagttatactgtttcatatattatatttaacatgtatttaatacattaatattttctaggtcttgggaaacacaaaaataaattcaacaaataatctttaccttcaagcagtcagaatctaatgaaaaatacaatatacatatacaatgctccggtatccaaatcagattgtgttaaattcaataatggaaatgaaacaaagtgctaaaagatctcaaaaagtaggccagctaaatctaactagggcatcataaaaggtttcactcaagttttttgatactttagactcaaagtaatatgtcttcacttcaagctgtcaacatataactattgaataagcactacaaggtgccaagcactgtgataaataccaagaatacaagctgaaaagacactgaccttttttttcactttttcttttttgagacagggtccctctctgtcacccaggctggagtgcaatggcatgatcacgcctcactgcagcctcagcctaccaggcttagatgattgccctacctcagcctttcgggtagctgggactacaggtgtgcgccaccatgcccactaatttttgtattttttgtagagatgggtttttccatgttgcctaggctgatcttgaactcctgggcttaagtgatccacccacctcagcttcccaaagtgttggtattacaagcgtgaggcaccacacgagccctctttttcattttttctaattaatttttttattttggtgggtacagagtaggtgtatatatttattgattacatgagatattctgatacagatatacattgcgtaataatcacatcagggtaaatggagtagctatcacctcaagcatttatcctgtgtgttacaagcaatccaattatattatgttagatattgtaaatgtacaattaaactattttttactatagtcactctgttgtgctagcaaatactaggtcctcttaattctttctattttttatacccattaaccatacccacttcctctccaacctcccccaccactacccttcccagcctctaataaccattcttcttctatctccatcagttcaattgttttaatttttagctcccacaaataagtgagaacacctaaagtttgtctttctctaactggcttatttcactcagcataatgacctccagttccaaccatgttattgcaagtgacaggatcttactcttttttatgactgagtagtactctactgtttgtaaataccacattttcttaatccatttatcttttgatggacacttgggttgcttcctaatcttggctattgttaacagtgctgcaacaaacatggaagtgcagatatctatacgatatactgatttcttttctttggggtatatacctagtagtgggaatgctggatcatacggcagctcaatttttagctctattacagtggttttaccaatttacattcctaccaacaatgcatgagaatacccttttatccacatcctcaccagcatttgttattgcttgtcttttggatataagccatttttaactggggtaacattgtaaatttgatatctcattgtaattttgatttgcatttctctgataataaataatatcgagcaccttttcatatgcctgtttgccatttgtctttttttgagaaatgtctgttcaggtatttagcccatttttaatcagattgttagattttttttcctagaattgtttgagctccttgtatattctggttattaatcccttgtcagatggatagtttgtaaatattttctcccgttctgtgggttgtttcttcactttattgattgtatactttgctgcgcagaagcattttaacttaatgtgatcccactcatccattttttcttcagttgcctgtgcttgtggggtattgctcaagaaatttttgcctagtccaatattctggacagtttctccaatgtttttatttagcagattcatagtttgaggtattagatttaaatctataatcaatttggatttaatttttgtatatgacaagatttaggtgtctaatattatcttctgcatatagatattcaatttacccagcaccatttattgaagaaactgtcttttcctcaatatatgttcttggcaccactgtctaaaatgaattcactgtagatgtatggatttatttctggattctccattctattccactggtctatgtgtttgtttttatgccagtgtcatgacgttttggttactgtagctccatagtataatttgaagtcagttagtgtgattccttcacttttattctgtttgcttaggatagccttggctattctgggtcttctgtgattccacataaattttaggattgtttttcctatttctatgaagaatgtcattggtattttgatagggattgcattaaatctgtatattgcttttggtaatatggacattttaacaatatttattcttccagaccatgaacatggaatatctttccatttttgtagcttcttcaatgtcttgcattaatgttttatacttttcatcatacaaatccttcactcttttggttaagtttattcctagatatttaattttatttgtagctattctaaacgggattattttcttgattttcagattgttgttggcatatagaaatgcaactgattatgttgattttgtatcctgctactttactgaatttgcttaccattctaatgttctttggtggagtggtttttccaaatacaagatgttattatctgcaaataaggataatgtgctttcttcatttccaatttggatgccctttttatatttctcttgtctgattattctagctaggacttacagtactatattgaataacatagtgggcattcttcagatcttagatgggaggctttcaactttctcccatttcaatacgatattagctgttggtcttttatatatggcttttattatattgagttatgtttcttctatatcaaaactttttgagttttttaaatcatgaagagatgtggaattttatcaaatgctttttcagaatcaattggaacgattatttagtttttgtccttcattccattgacatcatgtatcaaattgattgatttgcatatgtggaaccattcttgcaaccttgggataaatcccacttggtcataatgaatgattttttaaatgtgttgttgaatttgaattggtagtattttgttgaggatttttgcatcaatgtttatgagggctatctgcctgtggttttcttttctgatgtgtctgtgtctggtttcggtatcagggtaataatggttttgtagaatgagtttggaagtattccttcctcctttactttgtggagtagtttgagtaggattggtaccagttcttcttttaatgtttggtaaaattcagcagcaaagcccttgggtcctgggctttttgttgttgagaggcttttaactatggcttcagtctcattacttgttattagtctgttcaggttttgaaaatttttatggttcaatcttggtagttcgtatatgtctaggaatttatccatttcttccagatttgtcaagttattaacatatagtggctcatagtagccattaataatcatttgaatttcagtggtgtcagtaataatatatcctttttcatctgtacttttatattttatttgggttttctctcttttttttctggctagaaagttagtctggctaagttagtctggctaaagttttgtcaattttgtttatcttttccaaaaccaacttttcatttcattgatctttgtattctttcttcatttcaacttcatttatctctgctctgatctttattttttcttctacagatttggggtttggtttgttttttgaattctttaagaggcaccattaggttgtttatttgaagttttttctcttttttgatgacagctgtaaacttctcttttagtactcctcttactgtatcccataggttttggtatgccatgtttccattgtcatttgtttcaagtaatttttcaatttccttctcagtttctttattgacacactggtcattcaggagaatattgtttaatttccatgtatttgtacaattttcaaaattactcttgttattgatgtctagttttagtaccttgtgattagagaagatgcttgatattatttaaattttttgaatgttttaagacttgtttcatgacctaacatatggtctatctctgagaatgattcatgtagtcagaaaaagattttgtattcttcagcagttggatgaaatgttctataaatatctattaggtccatttcttctatagtgcaaagtctgatgtttctttgttgattttctgtctggaagatcttctcaatgctgaaaaacaggtgttgatgtctccagctattgttgtattgtggtctatctctctatttaagtctaataaaatttgctttatatatctgggtgctcccgttttgggtacacatatatttacaattgttatattctcttgctgaactaattcatttatcattatataatgatttctttgtcccttataggtttggcctgaaatctattttgtctgatatgaatatagggactcctgttcttccattctggcatggaatatcatttttccttcctttattttcagtcagtgtgtgtctttataggttaagtgtctttcttgtaggcaatagataattgggtcttgtttttttttatccaatcactctgctatgtcgtttgattggagagtttagtccattaacattcaatgctattattgacaagtaaagacttacttctgccattttgttatttgttttctggttgtcttctggtcttctcttccttctttctttccttcctgtcttccttatagtaaaggtgattgtcactggtcatatgatttagtttcttgctttgtattttttgttcattccttgtatgttttttagtttgaggttaccatgaggcttgaaaatactatcttataatccgttattttaaactgatagcaacttaacactattcgtataaacaaaccaacaagcaaaaagaaaactaataaagaccctataccttaacttcatgctccttaactttttaactttctgttgtttctatttatatcttattgtactgtctatgtcttgaaaagttattgtagttatttttgattagttcatcatttaatctttctacttcagataacaatagcttacacagcacagttacagggttatattctgtggtttttttgtgtacttactattaccactgagttttgtaccgttagatgatttctttttctttttcttttttttttttttttgagatggagtctcactctgtcgccaagctggagtgcaatagcaccatctcagctcactgaaacctctacctcctgggttcaagagattctcctgcctcagcttcctgagtagctgggactacaggtgcacaccaccacgcccagctaatttttgtatttttagtagagatggggtttcaccatgttgggcaggacggtctccatcttttgccctcacgatcctcccacgtcagtctcccaaagtgctgggattacaggcatgagcgactgctcctagccagatgatttcttattgctaattaacattcctttctttcagattgaagaactccctctagcacttcttgtaggaaggtctggtattgatgaaatccttcagcttttgtttgtctggtaaggtctttatttctccatgtttgaaggatatttttgcaagatatagttattttccttcagaactttaaatatgctattctctcctggcctgtaagatttccctgaaaattttgctgccagacatattgaagctctattttatgttatttgtttcttttctcttactgcccttaggattctttctttatccttgacctttgggagtttgattattaaatgtctcaagttagtattctttgggtgaaatcagcttggtgttctatagccttcttgtatttggacattgatatgtttcgctaggtttaggaagttctctgttattatccctttgaataaactttctaccttgtttctctctcaacttcctctttaagtccaataactcttagatttgccttgttgagactgttttctagatcttgaaggtgtgcttcattcattttcattcttttttcttttgcctcctctgactgcatttctaaatatcctgtcttcaagctcactaattccttcttctgcttgattgattctgctattaaaacactgacacattcttcagtttgtcaattccatttttcaactttagaatttctgcttgatttttttaacaatgttaatgtctttgttaaatttatctgatagaattctgaattccttctctgtgttatcttgaatatctttgagttttctcaacacagctattttgaattctccatctgaatggtcacatatctctgtttctccaggatgtgttattgtgccttatttagttcatttagtgaggtcatgttttcctggatggtgttggtgttagtagctgttctttggtgtctgggcattgaagagttaggtgtttattgtagtcttcactgtcttggcttattggtagctatctgatatggttggctctgtgttcccacccaaatctcatctcaaattgtaatccccatgtgctgagggaaggacctagttgtaggtgactggatcatgggggaggttcccccatgctgttctcatgatagtgagggaattgtcacaagatctgatggtttaaaagtgtgcggtggttcccctctctcgttctgcctctcctgctaccatgtaagatgtgccttgcttccccttcaccttcttccatgattttagtttcctgaagtctccccagccatgagcaactatgagccaatgaaacctctttcctttataagttacccagtctcaggtacttccttatagccatgtgagaacaaactaatacagaaaattggcactgggaaagtggagtgctgctataaagatacctggaaatgtggaagcaacattggaactgggtaacgggcaaaagttggaaaagtttgaagggctcataagaagacaggagaatgtggaaacatttgggacttcttagagacttgtcaaattgttttgaccaaaatgttcatagtgatatgggcaatgaagttcatgctgaggtggtctcagatggagatgaggaccttactgggaaccggagcaaaggtcaaacttcctattctttaccaaagacactggtggcattttgcccctgccctagatacctgtagaaatttgaacttgagagagatgatttagggtatctggcagaagacatttcaaagcagtaaagcattcaagatgtgacctggctttttctgaaagcatacagtcatattcattccaaagagatagtctgaagttggaaattatgtttaaagggaagcagaacataaaagtttggaaaatttgcaacctaatcatgtggtagaaaagcaaaacccggcctttgacaaaattcaacaacccttcatgctaaaaactctcaataaagtaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacttaggaatctaacttacaagggatgtgaaggacctcttcaaggagaactacaaaccactgctcaacaaaataaaagaggatacaaacaaatggaagaatattccacgctcatgggtaggaagaatcaatatcgtgaaaatggccatactgcccaagataatttacagattcaatgccatccccatcaagctaccaatgactttcctcacagaattggaaaaaactactttaaagttcatatggaaccaaaaaagagcccgcattgccaagtcagtcctaagccaaaagaacaaatctggaggcatcacactacctgacttcaaactatactacaaggctacagtaaccaaaacaacatggtactggtaccaaaacagagatatagatcaatggaacagaacaaagccctcagaaataacattgcatatctacaactatctgatctttgacaaacctgagaaaaacaagcaatggggaaaggattccctatttaataaatggtgctggggaaattggctagccatatgtagaaagctgaaactggatcccttccttacaccttatacaaaaatcaattcaagatggattaaagacttaaacgtcagacctaaaaccataaaaaccctagaagaaaacctaggcattaccattcaggacataggcatgggcaaggacttcatgtctaaaacaccaaaagcaatggcaacaaaagccaagattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacagtgagataccatctcacaccagttagaatggcaatcattaaaatgtcaggaaacaacaggtgctggagaggatgtggagaaataggaacgcttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgtggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcactgggagatatacctaatgctagatgatgagctagtgggtgcagcgcaccagcatggcacatatatacatatgtaactaacctgcacattgggcacatgtaccctaaaacttaaagtataataataaataaataaataaataaataaataaataaagatgtttgccatactttacaattttcataaaataaactcaaaatggaaaaaaaaaaaaaagaaaagaaaaacccattttttagggaaaaattcaagttggctgcagaaatttacataagtaacaaggagccaaatgttaatagccaagacaatggggaaaatgtctccagggcattttggagatcttcgtcacaggcccaaaggcctaggtgggaaaaatggtttcatgggcctggcccagggtcctgctgcctctgtgcagcctcagggaatggtaccctgcatcccagctgctccagctccagccttagctaaaaggggccaaggtacagctagggctgttacttcaaagggtgcaagctccaagcattggcagcttccacatggtgttgagcctgtgggtgcacagaagacaagagttgagttttaggagcctctgcctagatttcagaggatgtacaaaaatgcctggatgtccaggcagaagtgggctgcagggagccctcatgtaaagcctccactaaggcagttcagaggggaaatgtggggttagagctcccacagatagtccccctggggcactgactagtggagctgtgagaagagggccaccattctctagactccagaagggtggatccaccaacagcttgcgtcgtgcacctgaaaaagccacacacactcaacaccagcttgtaaaagcagccacaaggatggtaccctgcagagccacaggagcaaatctccctactcaaggccagggagcccaccccttgctttagcatgccctgtatgtgagacatggagtaaaaggaaattttggaactttaagtttcagtgagtgtcttgctgggttttggacttgcatgaggcttgtagcccctttgttgtggccaatttctcccttttggaatggtaacatttactcaatgcctgtatccccactgtatcttggaaataactaaattgctttagcatttgcaggctcataggcagaagggacttgccttgtctcagataagactttggaattaggctttttgggttaatattggaatgagttaagactttgggggaccatgatgggggcatgattgtgttttgaaatgtgagaaggttgggctggggacagtggctaatgcctgtaatcccagcactttgggaggctgaggtgggcagatcacgaggacaggagatcgagaccatcttggctaacatggtgaaccctgtctttactgaaaactcaaagaattagctgggcatggtggcaggtgcctgtagtctcagctactctggagactgaggtaggagaattgctcgaacctaggaggcagaggttgcagtgagccgagatcacaccactgcactccagcgtgggtgacagagcaagactccatctcaaaaaaaaaaagaagaaaagaaaaaagaaatgtgagaaggacataagatttgggaggggccagggtgtaatgacatgatctggctctgtgtccccacccaaatctcatctcaaattgtaatccccatgtgtcgaggtagggaggtgattcgatcattggggcagtttcctcatgctgttctcatgatagtaagtgagttctcatgagatcttattgtttaaaagtgtatggtggttcccccaccccactctctttctcctgctgccatgaaagatgtgccttgcttccccttcaccttccaccatgattgtaagcttcctgagggctccccagccatgtggaaacatgaatcaattaaacttcttttctttataaattatccagtctcatagttctttgtagcagtgtgaaaatggactaatacattttttgagaggctttccagatatttgaaaggaattgagtgttgtgatataggtgtatcttcattagggggcaccccaaacccagtgatgctgtagttcttgcagactcataaaggtcccagtttggaatcttggataaaatccagaagtgtccagattactagacaggctcttattctctcaccttactttctaccaaacaaatagagtctctctgtctctattctgaaccacttggggctgatggtggagtgacacaggcacttatgtggccatcaccactgagactgtgctgggtcagatatgaagccagcacagcactgggtcttgccaaaagcctgctgtaaccattacctggctaccacctatgttttcccacggctctggggctctatggtcagcatgtggttaagcagacaaccttgtgtccttcccttcagggcagttagttccctcaggtcccaggcaggtccagagatgctgtccaggaaccagggctatagtcaaaaaccttagaaatctactcggtgttctattttactatgactgaactggcactcaaaccacaaaattcagttcttcccactcttccctcccattttcacaggcagaggagcctcacctcatgaccaccaccaccactgtcccatggggagaactgctacactactgccattgttcacttaaggattaaggctcttcagtcagcttgtggtgaagtcggccaagcctgagactcacccttcagggcagtgggctctcctatggctcagggcatgtcaagaaatgctgtccaagggccaacacctagaatcatggacccgcttggtgctctatctcactatggttgatctggtacctaaggtgctagacaaaaatcacctttacttaacttctgcttttctcaaatagaagtgtctcactgtagccaccagagatagtaatattccatgtctcacctgaagtcaacacatctcagtctcacccaagttccatggtgtactatctggctatctctgctgtttatttagagctcaaggaagtcacctttactttacttctgcttttctcaaatagaagtgtctcactgtagccaccacagatagtaatattccatgtctcacctgaagtcaacacatctcggtctcacccaagttccatggtgtactatctggctatccctgctggttatttagagctcaaggactctttagtcaacaagtgatgggtccttccaggactcggtcctttccttaaggtagcgggttcccttctggcccaggatatgtctagaaatgttatctgggagctagggcctggaaggggggcacctcacaattctgaccagggacctatcttattgtggctgtgctggtatccaagatgcaagacaaaagtcctctttactcattactttcctctcctcaagcggaaggaaggggtctctttcgaagttgtgaattgtgctgcctggggttgggggagtcgtggtacaagcactcctttagctgccctggctggtgtctcagtaagtcatgtccccccacacttcccccaagtctactggcttttagcccatctcaggcactacgactcacctaggagttgcagtccttgtggtccatgccacacagacactgtggtgggaaaagggaaggggtggcattggtaattggagactgtatttcctaccctctttggtgatcctttcagttaaaaccaggtactgtgagtgctcacctgatttttttggttcttatgaaggtgtttttgtgtatgtgtagatagttgttaaatttggtgttcctattgggggagaccattggtggggctttctatcccatgatcttgctccatccctattttacattttcaatactgatgcatcttaagaaagcaaactaacaatatcagtacagtatgatacctgctgtaatgagagacacacaaatgcaacaggagcacacagaaagaaacacctacgtctgcataagagacttcaaaaagtctaaaatgtggaggataaataggcatctgccaattaatagaagacagggaattgaaggcagaaggaagagcatgttgcaaagccatgaaactgcatggtgagaaaagataataatttgatatgattggagcattaaatgaatttgaaggagaaaagcgggaagtgaagtggggctagtagatggggggagctttgtataaaattttaagaatttgagagttcatatttaaatagagggcagagatgaaagactgaagaatttttctgcaagctacttgcaaattagcagaatggagggcagagtagagtcagatcagtctgaaaatagagagatatattagaaaacctttgcagtattttgaggaaaagaagataagattttgaattacagcagtagcaactgagatggagaggtgaaactgataaacattttgatggtaaaatcaacagaaattggcagctgattgttgaagttcaagaaaaagtttacatgctaggtaatacagtaaaataagtaagtttggtagaatttatggtggttaattttggtagaatttatggggtgtggctaaggagttgaagatgaatttctatgtaatttatatttgcatatattttagcatacaacaaaaatttatattcactcaaagactatcttcaatacactttatatgcaccctcctcttcataaccaactatcttgaaatctatcatgttaactggatctttaagttgggcattagtaagattgaagctttaccaaggaacaaaagtcaagactcttagagatgaagaaatttgcctaagtggatataagtaataaatagtgttgtcaggattcaacctggactctacggctctagtgccatatttttttttccaccatatttaaaatatcccatcaatatcataaaacagaaatgaactgatacatttaattaaaaggttcttaatgtgcttgatgttcttcagattaacttcaatttctaattaactgagtctcttcaatatcaaagcaataatatttaattgcctatgcctggactttatcttatcaaagcaacatttcattttctgttttttctattgaatttgtgagaacattggaagctgtcaaggtgtgacatattgagagcccaataaagattaaatccctgagtacatgatttgaaaaaatttaatgaaatactttgcccacttgtctaggactactgttaagtaaccatcaaccaacaccttttccaaatatagacttccaaaaacataagtagctagccagtatattttaaaaactgacacgatctctcagagaaattcagatcccagagttgatttgggtaggaatcggggaagcaaaactaaattaattaaaagcacaatgttacttactttatccttggagaagctgaaaagttgttttctttccacaaagaattggacggctattacactggctgagtggccccaaaggacacccactggtttagagacaacatagggattccaaaggcaaactttattgttaatgccagcagttgctaatcagaattagaaagaaaaaaaatgtttttaatagcatgaatagcccacagcattttctttgtgaaatgagtttaccatataactctagcttgatgaatgtcaactgtaggttgactaatgcacctgttttgccattgtctaactagaccaggctaatagagcatgagttctgtcaatagaaatagttgaaatggagggattagggaagaaaaaatttgtcaaggggaaaaggctatgtatgaggtgaaagaaaacatatagtcccatttaaaaaccaaccaacagcctaaccaggaggggacagaatccttcttcctaaccctgatatttcccctctccagccagcttagcctacaaatgtaggcagtgttaaagttatcccaggagtaagaaagaaagaaaacaatgttgaaagttcataaattaattaaaaactataaaaagacaaattatcaagtaatcaagtacagtcatgcatttcataacatttcagccaacaatatacagcatatacgaatatggtcccatgagactataatatggtatttttactgtaccttttatatgtttagatacataaataccattgtgttacagttgcctatagtatttagtaagtctcatgctatagaagtttgtagcctaggagcaataggctacagcatatagcttaggtgtgtagtaggctacaccatctctttgtgtaagtacactctatgatgctcacacaatggaaaatcacctaatgatgcctttctatccccatcattaagcaatgcacgactgtatgtgcaagcaaaaaagcagcacaaatatacttttgacctgctttattatggaataagatatttttgaacatcaatcagttatatttagggagctcttccagagcaggaaatgttgtatctattcaaaacaacacaatactctttgttgcttcctagcttagggccagttgtggagctgaacttaatcatccttattttttccagcactataggaggtacaaagtaattattattatacagagattgaaatgattaaccaatcaataaattaaatagtttctatttgagtccttgccaaaatgagtcaccaactcctctatccttctctaataaatctacagtactccttgaagatttgatgttggcatattcacgaattcatattcaaggtatctgttactgtgattgtcaggtattattttgggaattttatggacacagctccttagctaatattaataatcttcatatgaatgacaactattgaatgtgagttaatatgacccattccgtagaccatgtgtatgctctgtaactaccctattaatttttcaataatatatctatacctcatttttataatgtttgaacaaatatcatatatcaaattatcagctttcagaatgtctaaatttttaatttaaatagttaatgcctgagaaaggttatatttcctcagttaaaataaactttttttacatcaaaagaactctcctctagtaaacaaacctcgcataatctgaacattttcaaaaatcattagagattgtattctgaaaggtaattgaaaaacagtctacattttgcggttctcttgtgtatggatgtgtgtgtgtgtgtgcatgcactggtagtggtagctgtagtagtagcaacgaaaaaatgcatttgtttgggtggagcatttggtggtgttaggaagatggcagaatggcagatgctgcacaaactgtcttccttctctatatcattttacacccttcaccaattgtaattaaaaaaaaaactcattaaagcattgggcactttctcatatttttacctcaatgtagttcatacacactgcacatcataatgcatcattatcagacattctcaggcagtaaaatgtgagcttctcgagatggtctctatagcaatacagcaacaaggtagcaaaggctccatgcatacaaatatacatcccagactatttatgaggccctcatagttatcatgatttattttacctaccaattaaattgagccgagagtgataatcaaaagcatgaatgccctgggcaatgttgaaggatgtcatattaagacgcttttttgatttctctctccaagccatcaccacactatttgtattgctggttgtactggaaatgatagcgtctaaagatgcattgtaagtaactgataaaaaattaaaaagagaaaaacaatctttagttgattcttcacaagatattagtaaaatggagctgttttaatatggaaagttaaaaattaaactcaaactatgatgatacaaactgatacttaaaaaacacctcacaaaccccttctcccacctcccacaaaagaattccattgagaagttacaggaaattctacattctgacttttcccccaatctagggaaagataagcagagattttgaaaggtaattaggtcaggagagtagaaccttcaagaatggtatgaatgcccttataaaggaggtccaaggaagcttgtttgctgcttccactatgtgagggcacaggtggaaggcaccatctaggaagcagaaagtaggtccccaccagacagcaaatctgatggtgccttaatctttgactcccagcctccagaactgtgagaataaatttctgcttcacaaaaagagcatccctcattaaggagttaaaaacagtatctagttttactattttggtataataacttaatttgctttgtgtgtgtgtgtgtgtgtgtgtgtgtgtgtgtgtacatatacatatggcgtatatatacacacatatatttgtaatatgtgtatatatatacacacacacacacacacacacacatacacaggtatttatacatttccaaacaattattaaaggcaagaaagttctgagaagcaggaaaatagctcaatgcattccttttcctctgatctattcaattgggctgtttctaaaggtaactaggatttattaattcaagagctcatattgatatgtaaatagcttgatttagaaaattccatagctatctccctaggaaataaatggcataacacaaccaatttctaactaaattaatgatgttgagactattcagtgtgtcatttacagatatcgtctctcaaaacatggcattcaatcctcaaagatttattgggcatctactatgtgttctgtgctatgataaagataataagaaaaaaaacagatgcagtctggacttcaattatatggccccaaacttgggagaaaaaacgtgtaaatcaaacaattagagacaattttagtacatcataaagtgataaattgaatgttacaaaatgtataatagaatttcaaagaaaaaagaaatcagtgtgactttcagggtttaagagacatttgttgaacgttgacaaaaagcatttcaatagatgagaggccatgacaaatcacctgtgtgggaaacaaaaggtaaattgagagctgagaaagagctaatctacttctatatctcataggtaaagaaatagggattcatccacacagtttcagtgatttgccaaagtcagcaagtaattgtcaaactcaggtctgaagttctgagattaactcttaagtttggtgtcatgacatgcaatattataaatcgaagcttgggacactagtatttggtagagccagagtacaaattcagaatacagggcctgatctcttgactattgaaacttggcttctcaagttttaacattcacacaaatcgctatgtgaaaatgcagattctcattcaatgtaaacctgagattctgcatttctcacattcctaggtgttgctcctgatgctctctgagaaccacacaaagtagcaaagcactagaatgcaagtattgccattattttatactctagagagtatgttaatccatagttcttaaaatttgggaggtcaaacacccctttgggaatctgatgagaactatagaccctctccatcagaaaggtatgcatgcacacaaaattgtgtataaaatatcacgattttgagaaccttctcactatactcataaagtccaaccataatagatctgaggaacttaagtgataaacctccagccacaggtaattttggagtgagaaattattcttcacctgcttcctcaagtggttcttaaaatttctattgctaatgatgtacatcctttgtgttagtcaatactcattttaggcttctgttttaagcttctacttctttaatgtaaatgagtgtaactgtcccttgatactggcatattgctaatagcagaacacaatttctaagaggaaaataaggagagaacaggatacaaaggagatgttcagaaaggggaccagagtagagctggttcacagagctggctcacagaataattcactgggaagtgtgtcatgaaacacaaaagtgctgccaaaggccaaaatggtctgtttctccactctgcctagaatttacctggattgtgttataagggcagagagggcagtgagtgacccctttcctcctcattataagggtcatggccaatacccctataaccaaagacaggttaacaagagaaaagcacaaaaaattcatctgatcatagatttacatgacacaggaaccttcagaatgaagatccaaagatatacaagacactgtccatttttacacttgggttctatgacgcagggacagccatgtaaaaatatgattggaaaaaaggaatatgagctaatgaaaatagactgagtggaaaacccagcaagtcttgtctgctcagattcttcttgacttctctatacggcattcctttctcctgggtatggggtaggaccactctagaatgagggatgtcattccattcctttatggtcaggaggttacactaatagtaggggaatgttagaataatatttttagactttacggctacctttggggaaaaggagttctagcttctatgacctggctcaggaaagaataagcaggagagacagatgggcaggagaaggtcagagagaaactttgctcctgaggctgcttccgaggttttcattttggggtatcactttctgagccccaacagtacgtttcttgcttatcccccatatggaatttctctttgacctatgactactttaaatagtttttaggattatttattgaatccttcctatgtacaagcaccactctgggtgctctcaccctataataatctttagtgggtaaattattccaagtttcctaatgagaagatagcaacctgaaagccaacttgctcaagggcatgaagctaattggaggtggagatgagactgaacccagtcctgtgtggctgtcaactctcctttcctgtgctattgcctccgtcttttttactaagcctcactacaatgtgtatcacaggtccagatctggggttcttcctattaccaactacctttctgtccccataccctcaatcccaaaccaagcccctaatttatcttgagtcttccctttcctgatcacttcacttttctattgcctctgatccccacgggaacagtatttctatgtcttccttgctttctctcatccttttctctcttttcttcttaataaaaggaaggaagaaagggtaaaagggagggagggaggaaaaaagggacggagggaggaaaaaaggaaagaagggaggacgggaggaagtgaaagaaaggcaaggatctgggaagtaattcgttcctataaaggagaatcctttaagttttattagagagcaattaatttcaggaacataaagtcccatgattacctgctgcaatagtactactactgtactagaagttccaatagtataaaatctgatggcaatgattctcattcaggaagcagcctcactgaaaatattctctttgtttacaaaaaagggttattataacctgactctcagtaaggcaatattataagatgtaaactatacaacataatactataattatatcttcaagtgcatggaaatcccataatataattacaatacaatcaaaataaaatattcctacccagaaaattacttcgtcatgtgtttccccattatacccaactatcatctttagtttccaggttataaagaaagacatagaaagacgtgtatgctgctctggcatccgaagtattgctttaagatttaaatctgcaggttacaaaacgacatttatgggcctgcagtgctacatattggaggctcaacaattcacgcttaatgtctaaaccaagatataacttgtttctgattaaactgtagaatgccagagttcctgagagtgcctgggtaaaaggtgagagaaaagccatttccttaaaatcaaattatctgataaataaaaatgtttttctcatttcttgaattgaggtaaggaaatgataggttatgatggaaaagttttaaaactatcaagctaaggaataggatgagctggtaaaataaatgatttcttgttaatattctcagtaagttttggaattggtagaggaaaatacttttaaattacttttatataacattatagagaaaaaaaacaacttgattatatttatccattaagatgctaactttcaactctttcattctcttgccacacagtcataaaaaaagacattaagggaccctgccatcgatctttgtcctcatgtgtgctgtcaaaatgaccctgtgtaacagcaattagttaatgtgggaaagtgatttgaaaatgaaaagtgatacctaaaaactaagtaagtaatgctattaagtgcacttagagtaagataaaataaggcactctataacatttgccaactgatagacatcgtggcagggtaggaaagaagtctccaccaattctcccctctacccctgcaaggacaccaagttaacaatctacacagaaaaaaacacttttacaaaaaacaaaaattagatgagccctcattgtacctggttttcacttcacatcgctgaaagaggcactgaagagatagaaaaataaaaaaaaacagtactgaatcaccaacgcccacccttctccacccctaccagcaactgcgtggtgctgagagcttctctgggaactgggggagagagagcagagcaattatgtagtattgaactctgtgctgtcctggcaaagcagaaaggaaacctggaccaaactcaactggtgcccgcccacagagggaaccttagcagaggggaatcgcccagcccagaggtctgaacttgagctccagtaaacctcaccactgagggctacagcactgtttgtctccaaataaacttgaaatgccataaagctctaggccataaagactgcaactcataggtgagtccttgtgtggaactaggcccagagacaatggactgagggggcacacgacatactgagacaccagctggtgcagccaagggagggctggcatcaccctcctctaaccccagactgcacagctcacggctccaaaagaggtgccttcctttcacttgaggagaggagagggaagagtggggaaggctttgccttgcctctaggataccagctcagccacagcaggagacagcattggtcagagttgtgaggctcctgtcacaggccctcaatcctggatgacacttctacacaacctgggccggaagggaacccactaccctgaaggaaaagagccattcctggcagcattcatcacctgctaactgaagagcccttgtgccctgatgcaatatccaggtattatatcaagggtcttggatgagcctctgagacttgctggcttcaggtgagactcggcacattactagctgtggaggctatggggaaaaactcctcctgcttgagaaaagcagagggaaaagtaaaggggactttgtcttgcaccttaggtgccagcatggccacaggggtgtagagtacccaaggcaggctcttagggtccccaattccaagacttgactcttggatggaatttctgacctgcccttgtccagagaggagtccactgccctgaagggtaagtctcaggtcaggcagcactgacgacaagctgacttaagaaacagtgggccattagggaacatcaacagtagtcaggaagtactctttttggcctggggtagcagtggctacagggtgaggcttctctgcctttggaaaaaggagtaaagagtgggaagaactgcatcttgttgtttgagtgccagctcagctgcaataagagaacaccaggtagacttctaaagtttttgactctagtccctgacttgcagatggcattttgggacccacccaggggctgggggaccttgctgccctaaaggcaaagacacaggcctggctggatttgccactggctgattgcagagccccagggccttgagtgaacataggcagtagccaggtagtgattaaagcaggtcttgagcgagacccagtgctgtgctggcttcaggtctcacccagcacagtcatagtagtagtggccactgaggtgcttgtgtcactccacccccagctttaggtggctcagaacagacagagagactttgcatgtttgggggacagtaagggagagaacaagagtctctgtctggtaatccggagaattttcccagatctggtctgagatctgaaatgctaagaatactttaatcagaaagaaaaggacaatgggcaatgaatagtcacctgaaggtacaaaactcactggtaatgataagtgcacagaaaaccacagaatatcataacactgtaactgtgctgtgtaaactactcttatctgaaatagaaagactaaatgatgaaccaatcaatactaataactacgaattttcaaggcataatcagtacaataagatataaatagaaacaacaaaaagataaaaagcagagggacgaagttaaaatgtagagtttttattagtttgctttgtgtttgtttatgcaaatagcgttgctctcagcttaaaataatgggttataagatagtatttgcaagtctcatggtaacctcaaaccaaaaaacatatgaatatacaaaaaataaaaagcaagaaactaaatcatatcatcagagacaatcactttcattagaggaacataaggaggaaagagagaaggaagagaaaaccaaataacaaatcacaaaatggcaggagtaagtctttactcaccattaataatattgaatttaaatggattaaactctttaatcaaagacatagactggctgaatgggcaaaaaaacaagacgcattgaactgttatcttcaagaaacacacttcacctataaaggcacatatagactgaaacacagaagataaaagggatgaaaaagatatcccacgccaatgaaaaccaaaaaagagtaggagtcactatacttttatcacacaaaatagatttcgagacaaaaactataaaaagatacaaagaacatcaccatgtaatgataaaggggtcaattcagcaagaggatataaaaaactttaaataaaaatgcagctaccatgggagcactttgatacataaggtaaatattattagaactgaagagagagataggccttgatacaataatacctggcgacctcaacacttcactttcagcactggacagaacttctggaaagaaaatcaacaaacgtcagacttaatctacactatggaccaagtggatccaatagatatttacacaatattccatccaaaagctgcagaatacacattcttttcctcagcacatgaatcattctcaaggatataccatatgttaggtatcaaaaaatatcttaagacattcaaaatattgaaataatatcaagtgttttctctgaccacaatgaataaaactagaaactactaacaagagtaattctggaaactatacaaatacatagaaattaaacaatagtctcttgaatgaccagtgagtcagtgaagaaattaagaaggaaattgaaaaattactggaaacaaatgataatagaaaaactacacacatatgggatacagtaaaagcagtactaagagggaagtttatagctgaaagtgccttcatcaaaaaaaaaaggaactacttcaaatgaacaatccaatggtgcatcttaaagaactagaaaagcaagaataaaacaaacccaaaattagtagaagaaaagaaataataaagatcagagctgaaataaataaaattgaaaaaaatacagaagattaatgaaacaaaaagtttatttttggacaagttaaaaggacaaagctttagccagattaagaaaaaaagagagtatatccaaataaataaaatcagaaatgaaaaaggagacattactactgatactgcagaaattcagaagattgttaatggctactatgagcaactatatgccaataagttggcaaatcaagaagaaatgaaaaaattcctagatgcatacaacccaccaagactgaattgggaagaaatcttgtgttaagcaaaatcagccaggcacaaaaagacaaacattgcatgttctcacttatttgtaggatctaagtatcaaaacaattgaactcatgaacatagagagtggaatgatagttaccaaaggctgggaatggtagtgggggcctagcagggaggtgaggattgttacaaaaaaatttacttaaaaagagtaagactattgtttaatagcacaacaggatgactatagtcaataataatgtaattgtatattttaaaataacttatagagtgtaattggattgtttgtaactcaaagtgtaaatgcttgaggtgatggataccccagtccccaggttgtacttatttcacattttatgctgatatcaaaacatctcatgtaccacataaatatatacacctactctgtatccacacacacaagaaaatttaaattaaaaaataaagtataactgtatctattctatctttaaaataagaattcagcactgctaagcatatttaaaaataataatgcaattaattcaattacttttcaaaatgccaggtaggcacatgtccatgatacaaatgaatcttattcttctaccatgctacagaacaagctgcaggaaatagagccctttcctcaaaccaaggccactgctcacagcggatttcaactgctttaaacatagtgacagaactggcaggaaaggcagcgtggtctagctaactcgacagtgtctggaagactgatttagatgcagggaagtcgagccacacacaagcaagatattaaatctggcttctctgccaacttagtccctatcaattataaagactccctgaggagtctgtattctaaattttctggcacttgttccactaattagtgcagcaattagcagctggttgtggtggctcacacctgtaatcccagcagtttgggaggctgaggcagacggatcacctgagttcaggagttcgagaccagcctggctaacatggcgaaaccccgtctctacaagaaatacaaaaattagcagggcgtggtagctcatgcctgtaatcccaggtactcgggaggctgaggcaggagaatcgcttgaacccaggagacagaagttgcagtgagccgagatcatgccactgcagcctgggtgacagagcaagactctgtctcaaaaaaaaaaaaaaagcaattagtgattttgttaacaattcaaactgttttgtatcttcttctagccctggtcaaagggcagaaaacattttcaacgcaataaaatatcaatgatttttgttgctgacaatttcatgctcattctttctttcttgtcccccctcctgcgtcccgcgatggagtctcgctctctcgcccaggttggagtgctatgggcaatggcgcaatctcggctcactgcaacccccacctcccaggttcaagcaattctcatgcctcagcctcccaagtagctgggattacaagcgcccaccaccacacctggctaattttattgttagtagagacatggtttcaccacgttggccaggctggtctccaactcctgacctcaggtgatccgcccacctcggcttcccaaaatgctgtgattacagacatgagccacctggcctcattctttcaatatctgcattcccagactacagtttccaaggtttctagtgatactgtctatatgaggaggaaattattaaaaaggaaaattctctgaaattcaagacgtttatgtcttagcactattacacaaaacctctataattactttacaagcatttcagaatgtaattatttttccattaaaatatgacacagaaccactcagagaagatgaaaacatttactccttcaaagttttaaataagaaatctgaaccttatcttaaagcactatgttaatactcttctgtctgaaactgagtttttcctttgacatttcatttttacagatattttatccttagcttcaataaaaattattatcatatttgctcatgtgtttctttctttcctcaattgtatattccctcctcacactgagacgaaaatcaccaaaaatatttcatgaagagttctaagaatattgaatcacgttactggggtaaagagaataccaaattaaacagtcattggttgcttgctcctgatagagcaagtcttgcagacaaaggaacagaatccaaaacaactacaaatcccatatattacatttgaatccatcctgcctttcctccttctgccttcctcttcatttcagtcttcctgtcttttctcgtattgaaatcactgagcttcaaacaacaacagaaagtcatatttaagcttctaatctgtattgctaaatctaagaaaaggcattctttcattggttatgactgaagtatattcacctttcagaggtacttgaggagtatagtggtgatcacggctcactgcagcctcaatctcctgggctcaggtgatcctcccacccttagcctcctgggtagctagggctacaggcccatgccaccacactcagctaattcttgtgttttttatagagacagggtttcaccatgttgctcaggctggtctcaaactcctaggctcaaacaatctatccaccttggcctcctaaaatgctaggattacaggcgtggaccaccactcccggctctccatttaaaaaaaaaaaaaaaaaaagaaagaaagaaattctacaactattaaccataatttcttttgatatttctcttttcttttgaaatatttttgaataaaattcacccaataatttatctaagactttccaagtcaaattgcaaaatggcttttttttgctcttcaatcaaaacataaaatcccatagaagaaactaataggaattattaattagagacacaagtgaaattctttaaaaaagaaaaaaggaagaagaaaattaatgtaatgctttcgcaggacttcagatagttcattttggcatacactaatattaaaatacagctcagtttctcagcaccaatagataagcagccagttcttttctgcccttaacccatctcaacaagacactcactccagcatcctttgataaataaattatccattgttccctacaataattatcacagagctcatagtgcacaataccatgtgcagaaggatacttcgttaagtgttactgactgctgcttagttttgagtgcttcaaagtgaacatgataataaacaaaccttgaagtgattatttaaaaatcttcttagtcggatgttagaagttaagtttcttgggatggatctagataacagaattaaactgaaatatgccagtgcttactatggtgcctactacatagtaattacctagcaaatgttttttgggtgaatatcacatagaagctcctatccttgcagctggtaaagggttgttaaggtgactgaaagatctcaacaaaagaaagaggctaaatgatcaacaaatatttattgtatattcactatttaaaaggcattgtgctggatttctgcttccagccatgatggcataacaaggactgattttaatctcccaccataaacaactagaaaactggacaaatattagcaacaatatttcagattttgacaataggcaaagtagaactgtgaaccctgagagaagagaaacaaataaagtgggccctacaatcactctgactttcttggaagaaatttccaaactatcagcacacagagcaggaaaccacacagagcctagcaacctccagagttggagaaacaaagattagcgttagaggaccatgaggcagctagaaaatgtgggacagaattctggaaaggcaaataattagagtcctattaaaaaaaagagagagagagagaaagaagaaagaaaactttgaaaaaataacaatagaaaaatttccaagtttaatgaaaactacagatccacaaatccaagaattttaatgaattttaaccagtataaagacatacacacatatacacacaccccaagaaaaactaaggtacatcataatcaaatggcttaaaatcagcgataaagagaaaatcttataaaacattgtattatgtgttatactggatactaaggtgaatgaggaatatagtgcttgccccaagaaggacgttttaatttccatttatatgtaaatgtaattttcatgtgaggcattcaaatttccttctaggcttggaaaggtaagaggcaggacccagattctaatgtgggtacagaaattggtaggtttggttcgcagggtgggcagcattgcaaagcaagattttaaagaagaatccaggagaaatgccaaaattgagaaccttgcaaataatgcaatgaagagtccatctgaattagacagaggaagaggcaaaataaagagtttgatgtaaggtgaagtggcaaaaaataaaggacgtttcaggaaaaacgttggcaagaaagactcttctgtggtaggccagacacagtggctcacacctataatcccaggactgtgggaggcccagatgagtgaattacttgaggtcaggagtttgagaccagtctggtcaacatggtgaaaccctgtctctactaaaaatacaaaaattagccgggcatggtggcacatgcctgtaatcccagctattcgggaggctgaggcacaagaatcgctgaacctgggaggtagatgttgcagtgagccaagatcgcaccactgcactccagcctgggcgacagtctgagtgagagtccatctcaaacaaacaaagaaacaaacctttaaaaaccttttttttaaagaaagacttgtctttagttgcagaatctggggtatctcagaatgaacaatcctcctccggaggagaagatgaactgggaagagtctatgcattgggccaggtggggatctgtaatcttcaaataaaaaattccccagctggaaatggaaagttttataagacgtcctaagatggcttaccattccacatttttagacctcaaatcctgaagatggttgcttcagagagctgcctgtttctgtcctttctttatcatttccattttctaatgatcaaaaaccttctaactagccagtctgattgcagtttctttctcctctaacccatgctgaacaaactaccaagtaaacttttcctaaatactgtctgcattgggtctgtccaagtttcctcaaaagccttcgacgtttcacggccaatatcttccaatgttatgtccccatttgacctatttgtttctatttccctaatattcagtgtctgatctattcatgtctacctctccttctgtcatcattgtgcctgcttgtctattttgctcatgttgcccacgttctctttctctctccctcatccatccttcaagtaccaccactgatccttaaagctttttcttatggcttttcaggcttaagaactactctaggagtcaaaatcttgtttataagatttagtagttaattttcagtaccactgaacaatgttctaataaggtgacttgtgttagtttctatttcattcagatattaagttttctgagggttgagtctataattaatctttcttctatagtctcaaatgcctaagacagttttaagacacataaaagatcaataaataattgttgattgattgacactcaagtccataattcaaataaagtgtttaaagtaaatgtgtgtgtgtgtattcctgttgttgttccaaaaattatctgcttgattataatgaattttttattcaaagaactgagaaatatataatacgaataagatagcaaagatttttaactatatatgtacatctatatatatctaatttgtattacatatgtagttccttatatatacataaaacttctctgtagccaattcctactttgcagtgatttaaggccagactgtgaaactgtgaaatcggattccttaggtcataaacatgaatctccactgctaatactaaactaaattcccatgttcttttgtcagtagaggagggaatcaaagatcagaatgatatgatagacacatggtaagtagcaaatcaacattgacctagagaacaatccttgtcctataacttaagagacaaatgctcactgataggttacttcattggtatggttgattttttgggacccttaaataaaattgaggcagagtctgcagtgagagcttccccattctcttcctgaacatgaagaatatatagatataatgcatcatcggaaaagacaatcacaatttaaaagccttacttgttatctctccaaccctttctaagacagctttctataggcttctctgtatttactcatattatttaaaggttatggactcaaataatacattaactttcagagaacctactgtgagtaaatttcaagaactatcactttattattataatctagtctttggcatatgtatctaaaaaacaaatgaatatgaatacaaataaaagaatacaatgtttttcagaagaagttgaaatacctccattctgtatatttttaatactctgattcttattttcatgttatgaaaacttaacacataattttgtgcctgtcacacttagcagatgaccaaaaactgtcatcttttgtttttcctacaattaatatcatgcagaatttaaaaatgtatagaaggtactaaagccatggtatgatttatatcaaagaaaaaaatgaagagcacatagttcctcacataggaaattcttactgtgggcatacattaaagaattagtttcaaccttctgaaacccaaagagggtaaaattaccaaaaagccaacagttgggtccatgttgactgtctcttcttcaaactgtattaggaatagcccaataacattaatctcatctaatttcattaaagtcaatgagattgttaattttcattcttttcagtgggcattctttagtgtagcaatttagaagtgagaaaattagcatactcagtatctaaacaaagaaatattagtgcagatattgcacatctgaatctcgaaccatcagataaaattaagatattttatgaaactaattcattggtgactaggttttaagaaagttcttgttttctgtagatactgattttataacatagtcttattacacaaagaactgccactcaagtactctagattagagaaattcagtcattacatcaaaaaaaaaaagagaagaaaattaagacaattcaattctaaaggcagtcaaactaatatgcttcccatgagaacataaggaaaacaaaggaatggttctgagggaacttgttaaattcttttattaaacagccctgaatgtaactagatgagattagctaggctcagagttgagttgaagctaaatgaattctatgacaatgttttcctttctcttaagatttcttgagcacattggtcacctgaattaattgtatgaggcataaattcagaaggaaaaaaaaaagaaagaaagaatccctgccagtattcaagggatagcagagtccaggccacaacctccagagaaccaattattggtttctagacttaaaggttttgtgtgaagcattttcatcaaagaatataaatgtacaagtcagaggtgaccatttactttcattactgttcaaattcaataccttgcctgacccaatctccttgatgaagtttatgctctaatatatggcaacatttgtgacatccagagagcagctctgcccagttaatggtcatagtggcttctccatcttcacatgcactagcaggccgttcaaacagggaaatcaaggctgcggtgaaagcaattgcttgaaccttgacagagacattgaaagaacaacaatcgtggacgggatatttgttgcaagaagattctaggttattttagtttaataaggaatagctattaacttaataagaatttcttcaatattatttaaaggatgcagggtgttatactaaaaaacagaacaattattagtttggtgatacaattaccaaagggcagtcttttacttgtttttaagacacatttgtcattaaaatagtaagaatgaaaagctttcacaattacaaaaggaaattgttccaattagcctacttcagaggtcacagacatattctagtttcattcagtaagtaataatttttcatagttcgggtgaaatttgataggaagacagaaataattgtatccaatatctaggtttcagagctgccctctctaatccttttgttatatgatacaggcaatgagcactcggtaggaaattggtactgagaaacccaatactctatgtaggaaaatcagaacaataaatttgaaagcatttcatgggataaatgtaatcatttaatattaaacatttattcatattaggatctaataaattaagcatcctatggtgaaaaaggttagcaagatctttttttctacatgagaaaagtgagctatacacagaccaaaaaaacaaacaaacccccacacacaattaagatttgtttttgtacgcaagaagacaaattgtgacctaatccatctcttccatgtccaatgtgcatgtaatccataatgtaattaaatttggaggtcacactcattgcattttaatttctactttaaactacagtttgatgattaaatccatagtattcaatcttaatctaccctcacttacctttccagttatatccccaaaagaaagaattgattcattggcatcaagaggatcataccaataatccatgcaaattggtgttcctttcaggccttggagtttgtattggcaagcaaattcttctttggacagcagatcatagaaacaaacctctttacttgtaaaagccactgctatctaaagtagcagagtagaaaatcagaaagtaattctgatggatttagcaaaattaatatgcaaagcagacacgccactctaattgccaaatcagactttgttctctgaggatccttaacagtattacagaagttaagaacagcggcacaaatgtaccttatcctaactgtggaatctagccaagaagaaacttttcccattagaggcatttgaacatgctttatttcctatccctattccacacagtcaccaacatccccatccatgggagactagaccactaatcacacaggagagactaaggcacagagatatagcatgatacaatcataccagaaactttacaaaccatgttttatgatgcaagtagagactttcatggaaatcatttgatacagactctataagtagctttatctgaagtcagagaaaaccctaaaggctattttacaaaggggaaaatatttaacaacataaaaataagtcaatagaaaatgtccctgtagagattcacacattggatttactagaaaaagacttcaattcaactattatatatatgtgcaaacaactaaagaaaacaagatctaaagaagcaaaggaaagtatgtggctgggtgtgatggctcatgtctgtaatcccaccactttgagaggccaacgcaggaggattacttgaggccaggagttcaagaacagcctgggcaacatagtgagactcccatctttaaaaagaaaaaaagaaagaaagaaacaaatgagaatgatgtctgattaaatagagaattttaagaaacatgcataaattattaaaatcaccattctgccaatctttgccctttaattggttagtccattgatataattactgaaaaggtaagatttacatctgccatttttctaacaatacagccccgtaatacagaagcaaaaactaaaattattgaagacagagtaggcatttcaataataacagtgggatatttcaatactctactttcaatgatggatacaacaactgagctgaagatcggtaagaaaatgaagacttgacaaacactataagccaactagatctaatgtatgtctaaagaacactccagtccaacgtcagcaggatgcacttcttctcaagtgcacaggcacattctccagggtagaccatatattaggtgataaagcaaatctcaaaaaatttaaaagatttgaaattatataaattatattctccaaacacaatggaatgaaattagaaatttcattcaacaaaagaaaaatttgggaaattcacagctacatggaaataaaacaacacacttctaagtaaccaatgggtcaaagaagaaacagacagaaaatatcaacagaactatgacaaatgaaagattaaattaatagtcaaaaaaagtgtcacaaagaaaatcctcaactagatggcttcactgataaattccaccaaacgtttcaaggaaaatcataccaatacttctcaaactcttccaaaaaattacggcaaaggtaacacctcccaaatcattttatcaggccaggattactccaatactgaaaccagacaaagacatcacaagaaaagaaaactgcagatctatacatcttacgaatacaaatgtaaaatgtatactgaactaaatactagcaaagagaatttagcaacatacaaaaaagtttacacatcatagcaaagtaatatttatcccaggaatgcaaggtttgtttaacatacaaaaatcaatcaatgtaatacttcatattaatggaataaaagacaaaagctatatggtaatcttagtagatgcaaacaatgcatttgacaaaatccaacacattttcatgataaaaacactcaacaaaccaggaatagaagagaatttcttcaacctcataaacagcatgtacaacaacaacaacaaaaatcctacagctgacatcatacatatcggtgaaaaaataaatacattccccataaagatcagaaacaagacaaggatgttcactctcaccacttctatttaatatggtatggaatttctaaccagataaattaagcaagaaaatgaaattttaaaatatcaatattaaaaaggaggaagttaaactagctctctatatctatttgaagataacgtgatattatatataggaaattttagaaatactcaaaaacactacagaactaacacatgacttcagaaagatgcagaatatattatcgtttttgaaaaatctattgtatttctatacaatgaacagtctgaaaatgaaattaccaaaggcggtgttaagagaatgtaaaaactgagatgcagtttttacaaagtatccatctgataaatctatctacccagaatacatataaaaactctcgaaactcaataagataacaatcctaataaaaaatgggaaaagatttggatagacattttacaaaagaagatgtacaggtagcaaaccagcacatgaaactatgcttaacattattagctactaggtaaatatgaattaaagccacaataagatataaatgcaggccttttaaaatggctaaaattaagagaaaaaattactgatcataccaaatgtttgtgaggctatatgcacaaaatggaaggctgcagagcaataaaaaaaactagtagtatacctcaaaacgtggataattctcaaaatagttatgccatggtaaaaaaaaaaagaaaagaaaaaaaggagtacacacagtatggtaccaattatacaaaactctagaaaatccaaattaatctatagtgaccaaaagcagatcagtgcttgcttaacataaaaagggattgtgggagttacaaaacactgctaggaaatttttgagggtgattaatatgttcattgtcttctttgtacttttgatttttcacaggtcatgtatgtgttaaaatctatcagcttgggacactttcatatgtgcagtatattttgtataattatatttcaataaacctattttaaaaagaaaaaagcaacattctttaagattctatattgagtaagcacaaaagaaaggctaagattttagttcagtgctgaaaagaagaaacagtgcaaaacaaatattatatgaaaataacagaatactgcacatagatataaaaaaatcatctggactagaactatcttttaattcatacaagttaaatattagctccagatacttggcaaaaaggaactggatccaatgtcagcagccactgtgaaggcagcaaagactgaagcataggcctgaagttgggctgcctcagtttacaaatcttggcaaccctgattacatcctgggtgactgagggcaaattacacaacttctctttgctcagtctttcatttgtaaagtgggaataatatctactccatggtgattttgagaggatgaatagattagggcataggaagctactgaggatgagaatgatctatggttccaaacaatagagcatacattttcccactaaaaataacttgcctttttggagaaatgctgattttaggtctggcataggaaatatacaagatgattctggaacattttgtcataccacgaaacaaagaagctttcaagcactgtcaggagtataaaaagactcagaagccgacttgcattgttcccactctctaaagagggtacaatttttggtatgggataacaactcagtagattaaaacaaataaaaaattttaaacccattatttttcaattatactgataataataataatagtactcattgtttatctttagagaatattagaaaaccagctcattattttgaaaactggcaaacaaaagtgaaaaattaggcatgtattctgcccttaatttgtaccacttgataactgaaaaattaatgggtttatttctttcttatagaggtattctagcttaaaggaaaaggaaattgtgaaattagaatatcatcttctgacccctaaaaaattcatggatctaggaataatcagcaacaactgctaacatctcaggaagaggaagaaccaggtatttaatacctactgactgaagaaaacataaccacctattctaaacaaactaaccactctgaaacgatgcaaggctttacacttgaccaccaattcactagaaaaatcagggaatggctggacatattaaacaacaccatgtagacacaatctgtaaaatccagagtgtggaaaattctaaaggacaaaccttggtttctttaacaaaaacatcaacagcaacagccaaaatttgcaaaaaaaaaaaaaaaattaggaacaaagaaaagcatgtatatcaaaagagacatattaaccattcacgatgtttggaccttattcagatcttcgttgaaacaaactattaataagacaatcaggaaaatatgtacatgactggatatttcatgatattaagaaaatattgctatggatattaagtgtggtagaggtattttggctatgctaaaatagagacatcttttagaaatacagaaatatttacagataaaataatatgatgtttttgatcttaagggggaggtatagatgaaacaagattagccgtgaattgaaaatgattgaatactaggtacatcaggtttctaatactattctctctgcttgtgggtgcatttgaaaattttcatagtaaaatctaccatctgcttcatataaattattaccaatatggatacttcaagctccaaccttccccatcaaaattattttacttacagtatgttatctttctgagaggtattggtatatgaagatgtttagactgagtgggccctatctattagaatgaagacactgactagcacagtgatcaaaattagataagcagttccccttaaatccattgaatcttgccatgcactataatagcctctcagctccacatacagatccacagtcctgctgtaaactatacaggagtaaagtccttataagctaataatgaagcatggcctcattgaagacagagccaggaatctgagtcatcagccacagtgtcattacaaggcacccaagaaaacagctggcactacctgttctccctccaggtcaggagaaagccaccaagagtaatgcagctttctgttactgctagccaggagccctgccccataagttttccctcttttacaagcagtacatttttttataaagagtctgtaccttgtttacattttccagagaaaccagacttgtcacccacaggtgtttgagcttggtggcatctgaagtgatggggaatgtttcttgcagctttaaatgctctccccagattgccaataaaccttctttactaattgtcagataatgacttgaattttttaagaaaattactttttgaatggtgtccttgtgttttactgggaggaattcaaggtccttccactggggcaccacagttgcctttgctcgttcatcttgctcataaagctctagcagtataaatgaagtcagcttgtcccaattaatgaagccatcttgggccacatccactttgtcaaagagctccccatattcttccttcgtgccccaaccaacaatctctgtcatcttctgcgtgaagtcttctctggacatacaaatgattttccttggctgtggggactagaaacaggaatccaaaaacaataatgagacaacagtgaaatcatcatatgcatgagagaactgtgctacccacaaaggtgaatttaatcagcaattctgccaacatgaaaagaaaaatattttttgcttcataacagtaatatactcaagtgaacttaaactggggagcaagtaactgacaggactagaaactgacattctcaatcacaaaaagtcaatcacaaaagtccttgtatcgggaagagtaaggcaggagaatatgtgatgatagaagcatggaatgatgtgaggctgcgagccaaagaattcaggttacctctatttaagctagaaaaggcaaggaaaggttctcccctagaacctgcagaagaaagacaatcctgacaacttgattttatccctgtaaaacccatttggggcttctgaactccagaactgtatattaatatatttgtgtgttttaagtcatggtttttggtaattagttacagcagcaacaggaaattagtacaggcatatctccttttgttgtattttgctttattgtactttgccgatattgtgatttttacaaattgaaggtttgtggcaaccttgcaagtctatcagtgccattttttcaatagcatccctacttcgtatccctgtgtcacattctggtaattcttataatatttaaaactttattgttattattattatatctgttatggtgatctgtgatcagtaaccaatctttgatgttactactgtaattgttttggggcaccatgaaccacacccatacaagacagcaaacttaattcatgagtgttgtgtatgttctgattgctgcaccaatcagtcattctgctttccctctccctttccttgggcctccctattttttgagacacaaaaatattgaaattaagccaactaataaccctataatggcctccaaatgtttaagtaaagtcagagtttcacgtctctcactttaaatcaaaagctaaaaatgattaggcttaatggggaatgcatgtcaaaagctgagagaggctgaaaactaggcttcttgcacaaaacagccaagttatgaatgtaaaggaaaagttcttgaaggaaaagtgctattcctttgaacacgttaatgatatgaaagttagacagccttactgctgctgtgaagaaagttttagtggtctggatagaagatcaaaccaggcacaacattcctttaagccaaaacctaatacagagcaaggccctaactttccttagttttttgaaggcagagagaggtaaggaactttcagatgaaaagctgaaagctagcagagattgattcatgaggtttgaaaaaaagaagtcatctccacaacataaaagtgcaacatgaagcagaaactgctgatgtggaagctgcagcaagttatctataatctctagctaagataactgatgaaggtggctacactaaacaatacgttttcaatgtaaatgaaacagccctatttggaagaagatgccatttaggactttcgtagctgagagaaaaagtcatgcctggcttcaaagcttcaaatggcagactgactctcttgttaggggctgatgtaactggtgagtttaagctgaaaccaatgctcatttattattcccaaaaatctctgaggcttttagaattatgctaaatctggctgggcacagtggctcatgcctataatcccagaactttgggagactgaaggggaggattgcttgagcccagagtttgagaaaagactgagcaacatagtgagactccatctctacaaaaaataaaagaaatgagttgggcatcgtgagcctgtagtcttagttacttgggaagctgaggtaggggtgtcacttaagcctgggagatagaggctgcagtgagctatgattgtgccactgcactccagcctgggcaacagagcaagatcctgtttctgtgctctataagtgaaataacaaagcctgaattacagcacatctgtttacagcatggtttattgaatatacatggtttactgaatatacagtgtggtttaatgaagcccactgctaagacgtactgctttgaaaaaatattccttttaaaagggtactgctccaccatgtccctggtggctcaagagctccaacggagatgtacaaggggattaatattgtttttatgcctgctaacacagtgtacatactgcagcccatagattaagaaataacttccagccttcaattctgattatttaaaaaatatcttttatatggtatagctgccatagacaatgattcctctggtggatgtgagcaaagtaaattaaaaaccttttggaaaggattcattagaatggcatcattttagatgccattaagaatattcataattcatgggaggaagtcaaaatgtcaaaattaacaggagtttgggaaaaagttgattccaaccctcatggaagactttgaggggttcaaaacttagatgaagaaagtaactgcggatgtggtagaaatgacaagagaactcgaattagaagtggagcctgaagatgtgattgaattgctgcaatctcatgatcaaacttaaatggatgtggggttgcttcttatagatgagcaaagaaagttgtttcttgagatggaatctattcccgttgaagatgctatacacatggttgaatgacaacaaagatgtagactattaaataaacttagttgataaagcagtggcaagttttgagagtattgacttcaattttgaaagaaattctattgtgagtaaaacactgtgaaatagatctcatgctacagagaaatctttcatgaaaggaagaatccatcaatgtgggaaacttcactgttatcttctttaacaaaattgccacagccgtctcaatcgtcagcaaccaccaccctgatcagtcagcagacatcaacatcaaagcaagacccttcactaacaaaaacattacctctcgccaaaggctcagatgattgttaatattttttagcaataaagtattttttaattaagatatgtacacttttttagatatgtgctattggacatttaataccctacagtatagcttaaatatttatcttttatttgctctaggaaaccaagaaatgtgtgtgactcactttatcctgatacccactttactgcagtggtctggaaccaaatccgcaatatctccgaggtatgcctgtcaagtggttgatgaaaattgagtgaatccctgaagagtgcttagtgaagccagtaaaattaccccatggtgaaactttaatcaaagggcaataatttaacttctatacatatgccataacaaagaacagtgaagccacatgcaattgattcttgctgttcgtggtagctatattctgtaaactctctgagaacactaaattagcagatactgaaccattgttcctacgggaaacacagggttaagtttctgcaaacctctgcacaactgctcactgcataattttgttttatgtgtgtttctgttgaaagacatcttatttaatatattgttaattaatcacaattaaattcatagtcaacagcatcacaactcgtgcctgaatgaagctaacacatgtatcttctcagtaagacatatcacagccttcttaggcttaggaacgctagccagcactccaccaccacacttgggggccattttaaacagcgaaatccgcaacaataagcacaacatgtgaaaaacgtggcactaaagagatgttaaaaacaatgagatcacttggacacagggtggggaacatcacacaccggggcctgtcagggggtggggagctgggggagggatagcgttaggagaaataacctaatgtaaatgatgagttgatgggtgcagcaaaccaacatggcacatgtatacctacatatcaaacccgcacgttgtgcacgtgtaccctagaacttaaagtgtaatgaataaaaaaagaaaaaagaaattgccatatggtaaaaaataaataaataatttaaaaaagagatgtcaaaaaggacgcttgtttacaatatgagagctgaaacaagaaagcagagtgttgccttgtttgattctgcttggaatgtacacattgggagactcaaattttttgccactctgcacatgtctgagaaggaccattgaagtgccacgagtattgatttggggatgaataaattttaggaagtaggcaaatttgcaagtataaaactcacaaataatgaagattaactgtatttcaagcaaatatttagcttcacgttgatgggctgtttagttcagtgagattcattatgagagaataaacttttcccaccacatcgaagcgagagtcaggcctggaagaagcactagagtcagcatattgtggagcaggtcaaaccaatgtaggtttaagcctggttccaccagagatcgtgagaactactggcaaggtacttcactgctaagccataatttcacatctgtaaagtaggtaaagcagtatcagttgcaagaaaactgttatgaagattagctgaaataacagaggttagtttaatggaggttagtccgggcacttaactaattaaaataactttctgaaaaataattgatatcgagccctttgaaccagccaggagttaattattcttatctttgttcagttattaaatgtttagatagctggacattttttagtgatccagattttaagagtagagaaagaaacctggtcctaaaagtgctccatctgtgtcaaaactgcaaactatttctgaaaactaaggcaatgttgatttttattttaaactattacataatggcatcaatcaatctcttagattgtctcgtcaataaaacaacatttaaaagcaggatctctatattttcttcctatgagctggtagtttattttttatttctaagaacaagaaactactcggacaaatatcaaaacaacttcttttttacatttaagaatgtagtattagaaacaaattgtaaatgacaaattttcttttccaaagtgatataagcaatgaactacatacttttctacacattgataataccaatatccactggggaaagagacaagaaatatgcctaggttatgaaatttgacccaaaaagtacaattgtatgatatccctggcagttctgttaccaattgttcacccattagcttgttaagtttgaaaatgaaactatgtttttgccatacctccagttaaaatctagtagtttgtttttactaaaaaatcctaacttttttcaagaagcatgatgttttgattaatacgttattaattctatcatatgccaacttgaataaattagttaaatgtacaattaaggtaattgatcttttatacaagcttaaaagcacaaatgcattaacttttaccacacaattaattcttgctttatcagtgactcccaccctctggaactagaattaattcattcatctcatcctactatatatatcatacactgtggttgggaaattgtgtggtagtgaagaaggtggagctctaagtcttagccccaattatggcacctctaaataggaataataataacaaattcctagtgctgttatgaggatctattcataatttaatgtacatatggcacatgggataatttaatgtgtggatggcacatttatactcaataaatgtcaatgctttgctgaagggtttagagaatagaagaattataaattgagtcatcatgtcagcaatgacggttttctgagaatttagccaaactcgtgtgtgtgtgtgtgtgtgtgtgtgtgtgtgtaaggttttggaggtgttcataattattaatattagtgatctctaccagggtggctagttgctaactagatagttcttagagatttcttagggacccagagaataggtgcaggagactgtaccagcagaatggtctgaaatcctctgcttctatgactattaccatcatagcagcagatgctagtttttgtcttaaaaagaaacaactattcaaactgtttcagctgctcttcctcaaaggcacaaatagaaagctgtcctaagtgagcctggtgaaagtaaagtttacctgttcccagaaccatggctctttcacatatacaagagcgacatttcatccatgtgagtaatcccagcttctgtcttgtctttagccactcgtagtgctgctctgtgagccaaatatccccatcctggacttggcagaaagtaattccacagaaagaaagcaaagataacctttcaatctaaaaaatgaacttgcgtatagcatcatttagttgctacaaattcttagttttcattagattcaatactgaatggcgaaataatttaccattgagctatctttagggatatacatacatatacatacatagacacacatctttaaattagtgctaatttagttaatgtctgggttttatgcctgggtttgacacataacatttgtattcccttaagccagtcatgacctctctcagggtttgcatgaagtaccaataagattgtctgtatgaaggccatcttctttacattaggcaactctattcaagcattaattattgttgacacatgtacaacagtatgaattcacaagtatacacttaatatagatagggaaatactgggaatttcggaaattttacttcattataaaacatagagcataaaataattctcattttcatttccttcaatgaaaagtttaattactatggctttaataaaacctttattattccagtaaacaatgtgttcccattcaaatgtagactttcaaataaaaactgcttaatagtgttttaaagatatgtcctttgattcttattaatctatattatctatatggtctttttgaggtaataattagtactcatgcctctgttagaactcctcttctaataaaggtgaaaattatatgagccattagaaaacataatctcattcagctcttcctagtacaatgttttgctacatttattttgctacatctatttaactgctaagaaaataaccagttattaaattgtctacaattgttgttgcaagagccagaaagctaatatactcagtatgtccagctgattatatcactaggcacaactttagaccttttgaaaatgttcctgtcttcctgaattcttttcaaagaatattctgaaaatcatttccttttgcctaaaaagcatgtttttcagttacagtcagttctagtgagctgcctgtctatttagaaaaagcataaactctaaaatttcctttagctctgagctttgtaagatttggatttaaccataacttatatgaaaactgagctctaaccctaagtgcaaaactttaaaaaaaaaccttgaaacttgacaggcatttttgtcattaagaagagatcgtgtgccattggcaacatgtgagtgtgccaacatacttttacaaatgtttatttgttgcacaaaagaatccatgcttattatagaaaatgaagataagttaaaaattaaaatcatttataatgccatcagcctttcagatttatttctaggcagaaacagaaacgaccagttattatttacaaaatagtgtcatgatatacatacatatctttctatgttgctttttccacttatatcataccataaagctatgcctcttatatattggtctttattacaatttttaatggctgcacaatattttatagagaagacatacaattatttataaccccattattaaaaatttcaattattcccaaggctttacagttttatataaacaacccagcaacatatatatattcctacatacacatcattgctaagctgtccaattatttcctaagggaaattctctagaagcataattactgaatcaaagaatttacatgtcctgaaaattgtttttatatattttgccaaattctcttctaaaaggttaaataaatttacattcccatcaataaagtaggaggttgcctgtactcaagaccctaataaaggtggggtattattcttcttaagacttatcgattggttgctaaagtatagttctattagtaataagcctaaatattacatactttcaggaggaaaaatatatttctaaagcagacattttatttttcaaaatctgccaacccttagaaatgttgtttatatttttgtgccctctttccaatagcatacttcataatgaaatgaggaaagaaatactttcttttctcctactctgcaaataagaacttgaccaagacaagataaaagtcccagtttaacactactgagagaggacaatccaacttggtctgggtattttctcctctgtcaaaggttggcagtgggttagcatttcactgacccgaggtttactgcccttaagtcattggtgagtatttgtttccagatcctgaaaataaatgtcaaatgatgagttgtaagccactgggagaaataggtccatccatccttccacccattgatctactcattaataaatacatattaaagatgtataccatataaaacagcaccagttaggtatacgtatttgttcagtcaacaaatgtttattaagtgtctgttccatgccaaacattattctaagcactcaccactaaattaaaaaaatttttttttatttccataggttttttggaaagaggtggtatttggttacatgagtaagttttttagtggtgatttgtgagattttggtgcacccatcacctgagcaatatacactgaacccaatttatagtctttcattcctcaaccccttcccactatttttccctgagtccccaaagttcattgtatcattcttacgcctttgcatcctcataacttagcttccacttatgagtgagaaatacgatgtttggttttctattcctgagttacttcacttagaataatagtctccagttacactgaggttgctgcaaatatcattaattcattcctttttatggctgagtagtattctgttgtatatatacgtatatatatgtatatacatgtatatatatataccacagtttctttatccacttgttgattgatgggcatttgggtgacttccacattttcacaatttcaaattgtgatgctataaacgtgtgggcaatatctttttggtataatgacttcttttcctctgggtagatatccagtagtgggattgctggatcaaatgctagttttacttttagttctttaaagaatctccacactgtttttcacagtggttgtactagtttgcattcccaccagcaatgtagaagggtcaccttttcactacatccatgccaacatgtattagtttttgattttttgattatggtcattctgcaggagtaaggtggtatcacattgtggttttgatttgcattctcctgatcattagtaatgttgagcattttttcatatgattgttagccatttgtatatcttcttttgagaattttctattcatgtccttagcccgctttttgatgggattgtttctttttttcttgctaatttgtttgagttcattgtagattctggacattagccctttgtcaggtgtataaagtgtgaagatttcctcctaccctgtgagttgtctgtttactctgctgactgttccttttgttatgcaaaagctctttagtttaattaagtccagctatttatctttgcttttattgcatttgcttttaggttcttggtcatgaaatccttgcctaagccaacctctagaatggtttttccaatgttatgttctagaatttttatagtttcaggtcttagatttaagtctttgatccatcttcagttgatttttgtataaggtgagacatgagaacccagtttcattctcctacatgtggcttgccaattatcccagcaccatttgttgaatagggtgttctttccccactttatgtttttgtttgcttaattgaagatcagttggctgtaagtatttgtctttatttctgggttatctattctgttctgttggtctatgtgcctatttttatacaagtaccatgctgttttggtgactatggccttaaagtatagtttgaaatcaggtaatgtgatgcctccagatttgttctttttgcttagtcttgctttggctatgtgggctcttttttggttccatattaattttaggattgtttttcctagttttgtgaagaatagtggtggtattttgataggaattgctctgaatttgtagattgcttttggcagtatggtcattttcacaatattacttctacccatccatgagcatgggatgtgtttccatttgtttgtcatctatgatttctttcagcagtgttttgtagttttccctgtagaagtctttcacctcacctccttggttaggtatgttcctaagtattttattctttcttttgcagttattgtaaaaggagttaagttcttgatttgattctctgcttggttgcttttggtgtatagaagtgctactgattaattttgtatctggaaattttgctgaattcttttatcagttccaggagctttttggagtagcctttagtgttttctaggtatagagtcatatcatcagcaaacagcaacagtttgacttcctctttaccaattactttgaacaagacaacaagatcaatgctctttgaatatgtacacttcagtgtagagactaggtgtgctggttactaataacacatgtttttaggttattgaaagtaataagaaagtaataagcatcacattaacttgtttttcctaattttaaatggaatatagcctttaagcatgctgaaacattccattaaaaggtatcttgtatggactagataactttccataattttgaagttgtctgattttatttcagatcattagaatcctgcaatgcttttttctctacatgaaaaattgctcataattgaatctcaaaattttattttcttcataacctgctagttttatcaaccacttcaccaaaattgatatttcttttgtcagacatttggcatgatttttctttaatgttccatgacagctgaatgagtatacactatcaaaatgcagccttttcccctataactataattaaatttaaaattaacatgctggtttctcatgcttcattctgttgtacttgcctcaatttcccttggttacaaagcatattggttatgaatatgtattaggttttgctgtcaaattctgtgaacgtctcctggagcagaagattagatatgttattgcaaaacagatgcatcagtttatatcatcccctgcaatttttacctactaatgaacatttatgagaaagtgaacaacagaacaggggaaattactctgctagtcaaggtccatagcgctctttttttcttgcttcaatagattttagtagaatttaattttcatttatactatattatcaattattcaagagctcatcaatttgaataaagttaaagttttgtaactaacaaagacacagaccttgactgaatttaaggtttggaaccaaactctcacaagccaaaaattcaacatttcgatttcctatccagctggtgaattagaagggaattgaagctgaagtgggcaaaaaatcaataaatctttctcttttaaataaagatgatcatcacccctgagaaatataattgttcttattaattttctctaagtctgtgaaattcttcaatatctgctatacttctaaagtgatgcttatcactatcagcttttgtgcctaggctagaaacttgggggaataagcctgaccagtgaaatagtgcagccaacagagaactgagcttcattgattttcatttggaaatctcactgtagcaatacaaatatatacttttttaaattgctgttcctttgttggagaccatgattatggcaaagaagtttatgcatccataggatcatagattaataccatgttggagctagaagaaagtttagagaatctacaccaaacccttcatttaaaaggaagaaactgatgttcaggcttattaagaaaagacttctctgaggtcacatagttcactattagcagaaataggcctagaaccaaaaatttccaattcttaaccacttttaccacaattcaaatatattggcttcaacaaaatctgattttctttaggataacatggtcatcaacaaaccagaaaaatatgagattggaatgtatactcccaaataatctcatactgttttgataaaagctatctatttagaagcctaaagctttataatgatatacttacttttcacatataaactttgaatcgataagataaacataaaaagtcagaaagactctaatccaggttctgaggggaaattttcaccaaactgtcagctctttcttgctgtcacatccttctcaaaccaaagatccaacttcaaccaatctctggtaattatcttcattcttttgttctgccatcctttcatcccagatatctggcaaaacacagcattggaaaagcatcctctctgtgcctatacctaggctgctgaacactaatggacagggcagaatgatgtcaccacaacaaaatacatgatctccaacctcaaatgtccctctatactactaggaatccttccatgttttcttgctgaactctcactctgattctctgcttctttcaaactcctactttattatttcccttcccttcctaataaagaaatttgactcctaactcacaaggaaaaggaacgaaagaaagagaatgaaaagggggagaaagaaatggaggaatcaattagatagaaatgtcctcaatgtttttgcacccgcatatataatgacctatatctgcagccatctccttctcccctgtgacagcagaacttctgtgttctggatacaaccttctcccaccacctcgagaatctcttctattgttattctctcttgttctctattgactccttttcatcagcatttaaacatgatcaagtcattcgaattattaaccatcttccgttgacattgccatctgttttttgctactgtctcatccttctttcacagccaacttgaaacaatcatgttctcacattgtctcaatttcttcacctccagcttacttaacctgttgcaatccagcagttccactgaagctgctcgtaacaagaagaccaaaaatcctgtggctaaacatttcaatacatttttttctggttctcatctgataaaagtgaaaatgtaccaagttaatgtttggtgccaaaatatctttgtttgagaaaataccttgagattcccgtttagttggaaaatgaaatctgagttatgtgcaagaccccaatcaagaaagaacagggatcaagctgctgtaaaaaagaggaaaataatttggtatttgtttttattgatttttttattcgattacacagagggagagagaaggaaatggtggttgaaatgggaggtggaaaggatgggagactccaagatggcagagggttgcatggtaataaagtgccatcgagaaaaccccacaggcaatatggctaaaattattttaataatggaagtgtctgtgtgtttctgacatatttctcactccaacccatacacctacttcccaaaaaccttcggttgcatctactcgacttgtaaatgcttactgaatggaaagtcctgaataactacataaggagctgagtctcaggcatgtgttaatctgatagagaacagagatggcagctgcaatggagggcaggcagaggtgattttacatttgcagaaatttggaaagggctttggatttccaatattatggcataagggttcgagccaatgattccatatctccaagtctggaaggctcccacccatgagttatgtgtttttatgatgtgtctctgcagaatttgcctctgttgactcttccctacttctaagaacatttgctttccttggtttacattacactgtgtttctcagcaacacttctgatcactccttctcagtatctcttgtaagtaccactttttctgtggtacttacagaaagataagatgaagataagataagatgagatattggtatatcttagcttttggccctctgacctgttctcttctcacatcatataccctagctgatttatatgacccaatttcttaggcttcaaacatggtctaattgctgagaatgcccaaagaaatatctttatctagacctctcttctgagcactaaacctttatatcctatttctcttctggatatattaacttggaagtcctatgtagatagttcaaatcaacatgttaaataacaattcattttccctcaaaaataatcttttttcctcttttctttagatttaaatattttcagaattaaacactgggggaaaacacagcctacaggtccaagaatatgacagaggttgaatgaaccaaactacatttaacaaaagagtataatacagctgttaaacaaatgaaaatactctctatcaacttatatagagatacattgttaatcaaatacaattaaaatgccacagagaataaacgtatgctatgtttatgtgagagagaaaaaaaggtaaaaaaaatacacatagacatacatgtatttaaaaaacaaaaccacagaataaaatgttcagaagttaatgaaaattgttatcaagacagaatgagaggatgggaagaaaaggatagggaagagagtaaaattttcctaagtatgcatttttatactgttttgacttgagaactataaaaatgtttcatatagtcaacaagataaaatcaaaacaaagattttttaaactctaaaatttaatatgtatatatactaacctaaccatgtaacaagcttacacaaccacacagtaagagaaattaattttaatatctataagcccagttctctaacccatgtacctgtaatgcaatataatgcaaaaaaactgcaaataagtcttgaattttactttcatttttagagtagtgttaatataatagttccaaaactatttcatatacattacagaataaagcatacaaataaatatattagtgctgctagaacaaaggttcaaaatgtgagagcatggaaatacaaatgatacaaatatggagtgacggaggggaagaaccctgtggtatttgaattgaattggaagtattagtataagttcattagttttaaaaatatgtatagatcaataaatataaatattgatttagataggtatagatatatcctagctatgtcaactgaaagtacctggaagcaatgacacccctaatagcaatgaacacactactacccagatcctgttattctcaataccattctccaataaatggaactggggatccctggagaaatggctggttccaggtcttgggcacatcatcttgtgccagaaagcaaagcagtaataacagattgatgaaaatatgttaaaaggatacaagggctggcttgaaggggtctcacactagacaaatttggggcattttgagtatcataaaataatgaccataatagaaaacagcacattgaatagaataaacgaagccataaatctgtggtcagactcaaggcagagagagagaatgagagggtgaaagagaagaggggccgaagactctctcttacagaaagaaaaatgccatactgaaaatgagtaagaatcaatagcatttaaaaatcaccatttttcaaccaccagtagagtcattgtttccagcaaagataatcaatcaatagtcaaaccaatggatgaaatcttgttgaagaatactcacaatatagtataaaactatcagcccacaagttcctttacaatgggtaactctggtggatccacttcaatcaagggacccaacgtatagcatcaccagtaatgggacaaattgacataatgggactctcgatgccttacaagaggtggagataactacgcagtattctttccaaaaatggtgaagatgaatctaacagtaaagaatcaatcagaaaatccagataatgggatgttctaagtaactggcatgaattcttcaaaaatgtttatgtcatgaaagacaagaaaaagtgggggactcctcaagattaaaggaaactaaacagatgaaagagatgtgtcaactaaagcaaatgtataattctgtattggatctgtgattttatataaaagacattactgggacgaaaggggacattttaatatcaaccttttcattaggtaatgtataaagttgaatttcctgtgtacaaaaatggcattatggttatctagaaggatgcctttgttcctagggaagtttacttaaaatatagccctccataaaggaaggcctatgtctaagcagattttaactgacacagggtagacattcaataaatacctgttgtaagaatgagtaaatgataaatatattgtaaatattctcttctatattgaggaagagatattcatctattttactgataatagcaagtttggggaggggatcataatagtgaatgatggccaagattatagaataataatgtataaaataactttgggaaattataaataagtcaaaatagaattaaattgttcactagagaaaagaaacaaaaactggctaccagatcatgttggacaatgttctggctctgcaaatcactcaatagaaaatgacaaattccccccaatccccaccttttttttttttttttggatttctcttcatcacctgtaaaataaagacagtagagtggttctctatgttctctctcttaatgctaaaattcaatggaaggaaattaatgctctgagtataaggacatagtatctataaaaggcactgcttttaaattcagcactcttaatttcagcattactagacatacatttagaaatagtaccccagagtctttaggttatgaagacatgccagcattttaagaacatttatgtttgcattgaattatggtatagataaggtgcccacaaacccatttgctataacttgccccactacaatcacagttctctttttctataacctctacaccacataaatatgtacattttttattttagaatatgattatgcattattctgtgattttcttgttttcactgaacatcaaatcttgggcaatcttacataagtcttccttattctttttaataactgagtaataggagtataccacaatttacttatccattcatccagttgatgaatatttgggttataaatactccagtttgtaagtgatattacaatcatatttttgcatgtatttttttctgtacttcagaatgtatttagggaagcttggaggattagaattgctgattaaaaagtatacatgtggtacattttatatttgatatataaaggcaaattgccttccagaaaagctttgtcaatttacaatcttagtaagagtgcctattcccttggttcttcaccatcagtgaatgttattgatctttttaatatttgccaatctgatgattataaaaagaacgtcttctttctgattagagtatcaaatcaaattcttaacaagtttgggtgccttttcacatgattagaagctatttatgtagcattctttcttgaatacataaaatataatatatgtaaatatattctacattaaaaaagctacatgagatatgtatatgtgtatatatggataaaaatgcacttaaaatacaccagaaaatattaagagtagttacccaggggagtataatgactgagaatggaccatgctaagggggaaatttcatgtttagcttggattttttaccatgagaataatgttacttttatttatttaatttaatttatttatttatttatttttagttttgagattgagtttcgctcagtcacccaggctgaagtgcagtggtgcaatctcagctcactgcaaccttcacctcccgggttcaagcaattctcccccctcagcctcccgagtagctgggattacagacacctgccataatgcctggctagttttcgtatttttgtagagatgggattttaccatgttggccaagctagtcttgaactcctgacctcaagtagttgtgcccgccttggcctcccaaagttctgggattacaggcgtgagtcaccatgcccagtcttatttattttaataatacaaggattgctaaataggaatcataaaaataaatgaaattttatatggctggctataccctccttttttgtttgtttgcttcttctccttctacttctggaaaataactcagctgctttatttcttgtaccaactccagttgtttctccaccaccttgaagaattttgtaaggtccagtcttaaacagtctgttctctcctacagatatctcatctcatggcctctctcctccagaatctatgttgcgattctctcacactcaattttgtctctcatagcctgcctgggacttctatttgactttaaacaaataatggcattgcgttaatcagagcatctatgatgaaagcaaccaaaggaacatataggaagctatgagaagagaaaacagggtcattgtagggcgctaatcccgcctgcatggtaagaaaaggctttcctaaggcagtggtatttacacacatgtgagtaggagttggccaggaaattgttggggatgggagagaaatattccaaactgaggcaccagcatctggtaggccctaaaacaggagtaagtaaaatatgatcagcatgactgaaactctttgggtaatggcccaggtcagataattttgtgatggactcattggaaccataaatccagactaaacacctgtgtgtgtgttgggagttgagaggaggggagttgcaccagaaggaagaaggaaggattcccctgaaaggaatagatcttcccattctttacagtcctaggaagggaacatggaaaaataggtcttagactagagtgaagagaaatattttctgctatctctggggccaaggatcagtttggcctctgggttctaagacatgggcagtctgatgtgtttatagtgggattgaggagctgagagtagctccttgccacaaatatatgtccagaagtgaggaagcagaacaagttagtacgaagtcatgagaaagggttcgaagcagcattgtccaatggaactttctgcaatgatgaaaatgttctatattctttgcagtccagtatagtagctactgcgtacttgaaatggctggtgcttgtgaggaactgaactttattttatgaaattcttactttatttaaataaccaaatgtagcacatattgaagagtacacatctgtagcaaaactagtgtgataatttggccttgggtctattgagaagattagagaaaggtgtacacatgcacacatgggaagtgaagcagtagaggaacataatgtctctggtaatgcctccacagagatgtcggtgcctagagaatcaggatttcataatagtcacatccatagaacgttggtgagacatgatgaagggagaaaagaccccaaggggctttttcttgcacaagtatgaggtagagccttgggaaacggtcagaaatcactaagggacagtttagaggattcctatttctagcaatagagtgagggtgtcttgtgtcatcattaatacgttatacttggcaaaatgtgacaaattgaaaccaaaatgccacaaataatggttctttcattcttttattcatttttcttgtttaactctcaggaaaatttcaaaagtagcagtgcccttagttcacaagtctggctaagctgatgcactacacatgaacagcagtagacatctttgctttctttctccctccctcctctgtaacaagcttttcttggttgtcttcacttctccagttttggccaacactcaaggttaaaccacttgtttactaaaggcactcttcatcacacactgatccagattaatttttgtaagtgcctgttgtaaaagtacacagagagtttgaaaaggcaggaagctgttagaacttgtcacaaaaatcagcacaaaggcagcaggatttggaaggcaaatttttcatttgtagtgagatacaacttcacttccttgagttttggtgatgacgccatttgctagcattattcatgaattttaacaaatcagataaaaccaccacagaattcctctgccatttctaattgtgccaactgcagtagtattggatttgtcttcatgctatcaccttaatgttttctgctgccattaaaaataggtattttgattgcactaagagcaatgcgtgagaaatggtatgacctgctgtctttgttcagcagatgatgaattgactgaggctgcagaatgcactttttactatatacaggtgagactaagcttcacctgtttaccttctcacaagtctccactgagatgcctttagaaagaaaaaaatatttttcaaaaaagcaattggttattatcttcttttcattcttccaccctttctctaccttgatttcattgtagcagttgttgattatttgctgattatgcgttagttccaagttagcagagcacagggcctgtgcactattaacttaacatgcattttgtttaggaaatctttatcctgttggattcatgttccttagagcaacatgccaaaggaaggttatcttgtggccagtggaaatcatgccatatatggactccaaagttgacaatctgcctctgagttctggctctgcccatgggagaattcaattgaatatttttagtccttcatctccttatttgtaaatgggaagtaaaaatttatgccgtgcctatgtttcaggctggtaaaggatcaaataacatgatgccaacataagtgctttataaaatcttactatacttgaaaggtattcaatttttattcatcatttttacctacactgatttccagaaagaattttagttcagttacaacagaagatacataggcaataggaccgactattaaaacaaagataaaagaacaagaattatataataaaatagcagattattgtcccagaaaacctaagttaagcatagttgtaagagttgaacactaaatttagctttgaacttcctggcagctaagacagaacacaaaatacaattagacacaaaggtctccataatttacaaactgaagcatgctggttcattaggagagaaggaaattttcctcccacaaaattctaagaggaccatgggtgagatcattatctgggcacacagctgtccctacttgccatacgacttgaagtaacttgaagttacctgtagccatatgactgagtgctggccaatgggatgtgagctggaccacagaaaacattccctagtgctctccactgctaccagctgatgtatggcttgtgtagaaggcggaaggtggggacagcctgagacctgaatccttgcttgcaactgcttacccattagaaatacctgctttttactttatgtgaacaggaaataatacctctgtcatgttgcagatattatatattttacacagtttgcatacactataaaaaatattttctaattctcagcattgttggatagcataatatccaactttataccttaacagttttatctaagaaaaaattttaaatgaactttatggaccatctcattttatcagagataagaacatctaaaggttctggggaaagggagtgaaacaaaaatgagtaattttatttatgtgtttgggatggtggtgcctgggtagaaaggcaagaaggaagatataagaatagttttggagtatgagacacgtctaggaagacctgttcatttgggtaccttagtagtgaaggtacaatgggcaatgagaaggcctagagaaggatgggtcctccataaatttggaggaagcttgacagtttagaaagaaggacaagttaaaaaaaaggtaagaaaaggcccaatctgactttctatattcctgtagagcctagcttgcctggcaggacatcaacatcctcagctttgtcttgaagcaaacaagcacagttcatagaccctgctgtagaatgctttctaaaatccccaagatactgttgaggtgttttgggaattttataaagataatcaaggatgagaatatcaaaattctttaaatgtaattgtattacccgttaagcacaattctagaacttgcagaattgactactgaacttctccagtcttttgagattcagtttgaataagtgcattgtgtttagatctcattcacctccaagacagatttgttttaagaattctcaccacacagtctctggggcagtcttgctaggatttttactgtgcctttcttacactaaaactatttggcccttcctactttaaggataaatacctcacattttacatgtggcttctaggtatagttaaagctaaagatttagtagggcttgggcaaatgatagcatggagctgacagggtaaagccagcctccagctctcagcttacagtcaggccagaacaggtgtgccaggagaagatatagacacagttgctgataaaggcagttcaggacctaacctggagagcccaggagcacagggcaaactatggtctcagaccaaacgggcagcaattaatctaggatcaaggtccaatgttaaaccatcattgacatacagagatcaacaatggagaatgtaaaaaaagaaacactcagaacctacatagccagactctcaggagaagctcaataaatatcaagctccatggctttcccaaagttccattttccttagaccaaaatttttacttctcaccactcctataaaatcagcaaaccacagctactcttcctcaaacaatagttggcttttggagtttcaaagaaaatgtaaaatatggttgacatcaaaataatatgagcatccagagaccatgtcatttctctaagtattgtaagtgctacagggaagtttgagtaacaaccattttacgattctatgaataatgcaagtttctctcccttcaggctgatatatggctcttttgacaccatcacttaaaggaaaatgaaatccacaagttacttttctgtgcttctacccaggtaacttatttgttccaaagaaaagaatcaagacgtcaattagaatttttgcctgctaagaaaatatgaaatgagagatagaacaattatgcttttgactcttctatgtgaatttatgtctttgcagctctaaccacttccttccacaactaataggaatgaagacgcatagcagcaagtgtcacttgaagtttaatttcctttaagaaaagtatgaattagaatcaaggcactgtcagaggtcacatggtttaacttctacttactaaatgagataattagctcaattatctaatgttaattgagcacttactctctgtggcatgcactttttaaagtgctttccagatagtacctcctctaatcttcatgaaagctctgttatcctcatgttagaaataaaggaaactgaggcccagagagattaagtatttgcacagagtcacattgtaagtagcaaagccgggatttaagctcaggaaatctgactcctagatctgaaacactgcatgattctgatccatttatacaactgcacaatgaacataagcactaattgctttattcctaaatgttactactacgattagtatggtatgtgatattttattcggaaatacacgtaaaacatttactgcataattcaaagacccaacttcctgttttttcacttaagaattgccactgctatttaaggagatggacttcacctaatatctgacaactcttcagccccaaacaagcaatctgtgtaagaaaaaaaaaatgaagatataaaggaatctggtgccagaatcttgacatttctaagagcatgtccttagtaactggaccacaaatcactgcctttagagttcaaagttgcaggaatgctattgagggcattttatccttttacagcaatctatacctgtggcctctgggcctaaaactcatgacagatggactggataccattaaagtcatctagtgcatcattcttctttaggtgtccgtgctgtgtttggaaatcatgttggctcaaaggtctaacttttagtactggctgcacatgtgccatgggattattccattctctggctgttgagtctgctaaaatggatgaacttcattttttttttttgaaggtacacctgcaaagctcaatttcttttttagaaaaactgtctatgttcatacaagctccgaattaccttctcttctcctctttggtccattagttcctgcttttccaaccggtaatgtcaaaataagtggtctggcctttgaaatatttaacataaaatagaaataaattaaaacttgaggttgaattttccagtttcacttgggttcattcaagactaatctgcagtttggaaagaacacccacctctaaccttctgaagcagtttcaccaacacatcaactttataatgtagactctcctaataggccctagcattcaaattctttgtgttcttagcaccggaacaaaactgccacatttctgttcactatagagtcaaagctgtcataatctgctgttatgttttactgaatgtcctcaagctgtcaaaatgtttgctatgtctatcaaaatatgctaaatttacttggggcactgggcatgagcagcagcagtgaaatctttcagacaaatgaggttggttgaatagcaaatatatgaaggttgaaatgagaaaagtgtaggacagagcatgtcttgctactaaatatgataagttctattataaagaaatgattgatactattgggacattaatttatcaatacaggtggaacccaacttgttatattcttttgtggatatccaaagataaaaatgtgtgcctattacaggctaatatattgtgagcttttattatattttattaatttccaggtggtattccaaaatattttctatttcaaattagtatggatactccaagcacccacggacaatcttaagaaggccctagatcatactttagtaaacataatatagtagaaatgttggaggctcatgactacctaaattctacgtcatggaagagcacttctttctacccatatttgaaactaaaaaccactttgatgtatgctgttcattatgcatagctgcagaattcaaaattcattgactaagagagaagaaaattattcatttacagttaaattcctatggtttattttttatgcagagttaaaatgaaaaattctaattttgtttttattggcattgttccaggatttacaaaatgagtgggagactcgtccctcataagggatcttgggacaacaaagtgccagaatcagcttagaaaaggagctgtgccacttagggtgagtgagacaggaggaaattttttgcaaactgggtatgcatatttgcatttgctgagttctatgtccgtattaaatgcaagaacaattattcctggaggtcaccttagagatctggctttcttcactcacagccataattttttgtttccccaaaatatgttgatctctaagaaaaaaattttttccaacaataaatagttctttcttgatagtaatgaaattcagtgaagcaatttcaaactaaagaatattatttggcccaaagaactgaggggcaaagctaccaagcacattgtgttaaatccaggcctaaccaattatttttaattctctgctataacaattaagtgtatttttttaatgcttaaagaaaaatatctctgtgtttcattctaggctccttcatgaacaactcaaactatctggtcaataagcttcacacttacctcaaaggccttctgtatttttacaaagtcacccacgctgagttggttttcaagcaggcctgtgccatagtcttcaaatgcagttacaccttctgttctctcaggactctttggcccaagctgtgaccctatgtttaactcaagtacagctttctggcaactcataatggcttcaccttttctcagttgccttcaactatttctataaggatggatcttctttttccttcaacaggtgcctttgaaaagaaactcaacttagcaacagaattccaaaatgaaagtacaaacctttcaaggcatacgatcaggaggcaaaatgttcaagctgaggtaggaaatgaaagccctcaaccctctcacttatttgattctagagtttattttcaaaatttacagttgaatgcttttaaaatggtatttttaccccttccttatactctgtttaacctggcttgattaaaaatgtgtaaagctttccccacatttatagtaactgacacagaaaacaacttccaatcctcattttaaatgcattagaaaagcaccttcccaaaaatctctttaactaaccttgcttccattaacatgttgtagttttcaattccactttcttgtctggaagagttagatgacaaagctgcagagtttccctaccaatgaagtacttgactctgaatgccaccttcccagcaatgtggagttgtttgtttcatctgttctgatccttttgtatgtttcctggcaaccaacacaaagccaactaaaactttccctttcacttccccctctccaactgaaagtttaaatatataatgtaaatgttgaaatggttttttttgaaataaaaggacagttcattccactcattttttattaaacgacatcttgtattatttaaagacaacttttaccattatataggatatatattatgaaactatatgattagtcaaagagaaaagcatgaaattctggaattttatgttttatacacagaaaatgttttatttttatataaaaggaatctgtttcttatattctttttgtcttagtttctatgtatataaaatagagatggttcaaaaaagcttccaacttgttgaaaatgtgataaaaaaacacagcataacataatatgataaatctaatgataaaattgcttgcagtgtcattactggttcagctaataataatgaaaaggaggagaaaaagaagaaaaattaacattttttgagtattaaccatgtgccaggcactaaaactttatgttcattgtcttgtttaagcttcacaacaatcctacaaggcagatgtgatcattatccccattttactgataaagaagcaaaaagccgggcaaggtggctcacgcctgtaatccctgcactttgggaggctgaggcaggtggatggcttcagctcaggagttcgagagcagcctgggcaacatgacgagacattgtatctagtaaaaatacaaaaataatcagccgagcatggtggcgcacacctgtgatcccagctactcgggaggctgagttagaaggatcccttgaacctggggggcagaggttgcagtgagccaagattgtgccactgcactccagcctgggcaacagaatgagaccctgtctcaaaaaagaaaaaaaaaaaaagcaaagaaaatgccaaaggtcacacaaatagtaacatacggaagagaacagaatggctcccaaacttcagatactgcatgtattagtctgttttcacactgctaatgaagacatacctgagactgggtaatttataaaggaaagaggtttaattgactcataatttcacatggctggggaggcctcaaaatcatgacagaaagctaatgagggcaaagtcatgacttacatggcagtaggcaagacagcatgtgcagggtaactcccatttataaaaccatcagatctcatgagacttattcactaccaggagaacagtatggggaaaccgcccccttgagtcaattatctccacctggccacgcccttgtcatgtgaggattattacaattcaaggtgagatttgggtggggacactgcccaactgtatcactgcactttagatggatgtgcccgttgcactttattttcacttctgtaaactaaaaagttggcattacatcttctctagggtctcttccggctctaacattctctgagctggtgttcactagaggcatggtacagaacagagagaagagcatcctgtaggagttcctgtacccattatagaaaaaaatgaagtttcattcatgctttcattttttcatccatctctcattattctttcaaaaaaaacatttattaagagcctaataggcagggcacggtggctcatgcctgtaattccatattttgggaagccaagacaggcagatcacttgaggtcaggagttcaagaccagcctggccaacatggaggaaccccgtctctactaaaaatataaaaattagctgggcatggtggcaggcgcctgtaatcccagctacttgggaggctgaggcaggagaatcgcttgaacctgggaggcggaggttgcagtgagccaagatcacgccactgccctccagcctgagtgacagagatagacactgtctctctctctctctctatctctctctctctctatatatatatatgcctaatatatgtcaagtcctgaattgtgacctggtgcctgccataagggctttacagtctagtcagggcaattatccgtctagctcatctttaatgccaattccaacctcttgtgttcagtgttccaacacagtgctgtgttcagagcattctgaagccatagctaggctcaaagggaaagagtggcattatagatgtgtatatatgtattgatatgtatcacacacacagaacgggggtgtatttaccagatttgcttttcttcgataagtccttcttgtaagttaggaaaacatttttaagccctaatactacaagttcccctaagttatcttacatgggaacacgatttgtcttcttatcaccctagttagtaagttaataatactttaaatcagctggatcagccccataaatgtttgtaaaatgttttatagtgatattctagagagttgggcttagttcagtagcagacactaatgagggaagggagaagaaataggaaaaacattctgtaaagatgaaccacgagaggtaggtatcccactggctgacaatgcaaaattctctaattattctaagacagacaagatgcctggcctacttagcttccataaagttgcagccctaaatgttttcattagtcaaaacaggaaagtataatgagcagctaacaaattacagtagaagttaatcaattgacacagttttcttgctataaaattatgacattagaaataattcttgatcataaaggcttaaatggctctaaccttctctgtaactgtgtggttaattttcaggttaaattcctgcggcactgtaaaatccataactagtgtcttgactggtgaaattttccctcttgcttgccatgaatcaagtatgatattgtgaaaatcaagatggtgacagtttaatcacctttagaaggccaaaaagcagattgacacttgcccccttctcctgtagggatcagacaacacctgccagcatagtggagccctaagcaccaagagggcagagtaagctgatacatccattggcctttgacactttgggactgaataattctccccaccgaatagacacacccatctgtgtctttatcacaattcacagtccacacccaaatccctgctctctccttcccccacaatttattgccactgacataaatatagaccttccttttatattatttaaggactactttttaccattatattttctacaaagtaggatacatattatgaaacaatatgattagccaaagaaaagagcattaaattctggaattgtatgttttacacagagaaaatgttttattcttaaaggataggaatccattccttatattctttttgtcttagtttctatgtatataaaatagaaatggtccaaaaaagcttccaacttattgaaaatgtgagaaaaacacagtataccataatataataaatctaatgataaaactggttcagctaataataaagacaaatgagatacatctctatgcccaccattgctcagagacacatgtctgagcataacatgccctacaaggcagttatgatcattagccccattctcctccccccccacaatttatccccaccaacatatagatctcccttttccttttcttctaactcctctttctttctttgcccaccattcacactgaagcctgttcttactcgttaatctttgcctaaattctccctccacctcctcacttcaactgaaatcagttttaccttaggaacctcatttccggcccagccttctcaggtcctcactgctccttgttcttctcaagtcctcactgctccttctcaagtcctcactgctacaggaagagaaagaaaggatgtttttcccatcatcttcttgcctcttgacctcatgccttccagcaaagccccagacacccgctggctctgtgtaaaggaacctcctctcaaagcctggggaaagctctggccctgcccttggcaccttttaagccctcaacagatattagtttctttccttctttgttccttatcctcccagttagaattaattactcctttcactctgcaaccacagcatttttttcagactttaaacacagcactgtttcttcctgctttgtaatgtaattagttgtctgtgtatctctctctcccattagattaactcctaagaacagggatgatacctcactaatgctgcagccttacattgcccaacatggtgttctgcataaacttctcgacactacagcaatgtatgctcatttgtaaacaaggtgggtaaaggagacattcacctataaccttgagttatcaagcaagggtcctgggaataggcggcattgaatcagaaggagaagcagaattctgtgaaaaaaagaaaatcatatgactcaaaggtcattaagaaaaagagagaaagaaaattagtgacagaaatgaaatttgagacagtatcttcaagccacttaaaattatcaagtgctttttgaaaaaatgcattttcttcatacaatttctgtgtaatgtacaaatatgtgttgaagctttactctgtcccaggtgctgcttctaaacactggaaaagcaaagataaatgagatacatctctatgcccaccattgctcagagacacatgtcacagtaaatgttggctttcaattaatcctatcttttgagaaagtagtttccattgttaaattaacaacactgtaatttttaaatcattttctttctttccttttttttttttttttttttttgagacagagttttgccttgtcacccaggctggcgtgcagtgctctgatcacagctcacttcagcatcaacttcacaggcccttccacctcagcctcccaagtagctgtgattacaggaatgtgtcaccatgcctggctaattttaaaacttttgtgtagaaacggggtcttcctatgttgcccaggctaatctcaaattactgagcttaagccatcccgctgcctcagcctcccaaagagctgggattataggcatgagtcactgtactcagacaaaactgtattttcataacagcatttctcaaacttttcaagtatttgaacacagaattattgaaataatgatatcctaaaacaactaaatatataattttgcagtaaattacatatcataaagaagcaagcagcggtagctaaatttaaaaatagatgcggaaatagattgtaaaactgagaaaattattgacttaaatgttctaacttacttgaaaaaagcccactaagactttatcagtagacacttaggatccgctgaatttaatattgagatcagtacttaaaagtattcatggctgggcacagtgactcacgcctgtaatcccagcactttgggaggccaaggcaggtggatcacttgaggtcaggagttcaagaccagcctggccaacatggtgaaaccctgtctctacaaaaatacaaaaaatagccgggcattgtagcacacacctgtaatcccagctactcaggaggctgaggcaggagaattgcttgaacccgggaggctgaagttgcagtgagccaagatcgcgtcattgcactccagcctggcaacagagtgaggctgtctcaaaaaaaaaaaaagtagtcagaaggtcaatctatttatgcaaattctgatgagtatttccaacaacgaatcacttttgtccctctttgctttagcatatcttctctttgaaatccagcatccttgttttcagtcacacgtgggtctctcagtcatcagtggggccttcataagggagccacttactcggcaattgctctgaactagcttactaaattcctttccattgcctctctgagaaaactgcctgctattctacctggggctttagaacagtgtgtcaaagccacctagatatcgaacactcgcattcatgtttagagccactagaaaacagtcaaaaaatcattgcatgaaaggagtcactgataatccagtaagcatttactgattgtctccttgaagaaagacagaaagcagttaggtgggaaatgaacaattattgagctcctagtatatgccaaacattgtgttaagcactttcacaaatgttattttacttaattcttgtgatatctctgcaagatacctaatgttttctctctttttttgacagatgaggaaactaaaacaaaaaatatctcatccaacttcatacaacttgcaaattctataatgtagcaatgccaatagaatgacgttatgcactttaagaacattacatagattagttcctttaattttcctggaaatcctatgatatgggcactattattgtcatcatttttagctgaagaaactgaggcttaggcagggcaaatgacgtgttaggatcatccagcaagaagtagaaaagctggagttcaaatcccaagtttctccatagtataaagccctgtgcagggtagactgctaaacaccacaataaattctaacccagttcaggagctaaaacgtgcaaaaagtaaagaaataagaaagcccatactaggaaataaagtcaaatgggcttaaaatttggagtcagaataccaggttcaagtcttgtttctctcattttcagccctatcatcttgggcaggttgagtcatttctcaaaatgaagatagcagaattgtttatctcatagaatcattttaaggttaaaaagataaaatacagtgaaaactctatgtaaattttaaaacattatgcacatgaattaacattaatattattacacagttggaagaaggtaaatttcctgcaaccttgggaaaataaggtaggagttcacagagagattggaatattagaattgtaaaacagaatgaagcaaaattatctatatcatgatgtttcacattaaagctgagattctgtaatcattttcattgtgtttaggaaggtcttatgtctaaatctattccagagagcaacgctatatcaatacttcaatgttagttattaaatgcaatgattgtgtgcgcgcacacatttgtatgagttagtagatgtgtggttttatcattttgaaaaaatgctttcttccttatgattagtcagagttaatgtcaactatagacatcttccctaagagggcctggtctgttcggcactgtctgaatctgttttttttaataacaacagaaatgatattcaaagcagtgtaactactgtctatcataatgtgaccctcttagactgtctgagtgcctgaatccccagaatcagatgttttgttcctaaaacattaaacactctattctagaaggaaagtggattttaatttaatttggtctcactgaatggcttaaccccaaaggaagagatatatatacatataaacacacgtgcacacacggagacagagacacagagagagacagagagaaggagagagataaagagagagaaggggagacatgtcagggcaaagactagaagtttctcagataagttgcctcatatggggaaactgtgggcagttacagtactttgggtaagcactgaccactaactggggtggcagaggtataaggtagcgataagagtatctctgaagggaataaaatacaatgaaacagtaattctaaatttagagtcaggagacctgaattttggtgcagcctccaccatgtccatgtgactctaaaatttaccctcattgggcgtcagtttccacagtcctaagtgaagataatgattcctacatgtacagtgcaaataattactttgaggctcaaatgaaatcatgtatagagacattttctagccagaaatggctatgtaaatatttattttttggttgggtcattcattcgttttatatgtttatgtgacttaacatgtgtagggcactaccctggtgatacccaatagctatcagttatgggtcttaatattaaggagcataaagtctagaaaatgacataagccatccatatgaatcagataggtaaaaaagggtgtagatgaaatggtatgcatgttaaggaaaagactgcttaattatatatggttgaggaggcatggtaaatggagtaaaaatagctttggaattggtgacatctgaatgggtgttatggcttgaactgtgtgcccccagaattaatatgttgaagtccccactggggctacccgagtaccacagaatgtgaccttatttggaatagggtcattggagatgtaattagttaagattaggttatactagagtagtgtgggctctaatccaatatgactggtgtccttataaaaataagaaattgtctataaacacacacacatacacaaacacatagggaaagccatgtaaagactggggtttgctgtcacaagacaaagaactatcagaagctgtaagtgaagcctggaataggtcctttcctagtgccttcatagggaatatggccctgccaatgcctttatgtcaacttcttgtctctagaaacaagacaataatttctgttatttaagccactgagttagtggtattttgttatggcagcccatggaaactaatacatttttttatatgggaagacaggaaaaaaagtttatggatagaaatctatgttgttgaagtttattattattaaactaatataagatagaaataaatacaatcattatattgtaataatatacctacaatactgaacacctagcacagtgcttgacacatagtaggcaccaaataaatattgaatgaatgttttaaccaacaaaaaggagatcacagaaaggggaatggattggcatcaaatatatatgttttaatctgtttcatactcttttttttctgggcaaaacctctacttaaccacaaaaaaaatcagaaacatccatatttctatgaaaaatgctaccatttcacctttgtttactttaggaaattctgtctaggaaaacaaagaaataaaagggaaaaagggcaatagaaaggaattttacacttgtaaaaatcaaagttctgaaacaaaacgcactttgaaagattgaaagctatagtcccaagaaagaatactggcacaataaatatttctcacagaacatagtgtgcctcctgagcatggtgcctctgattgaaagccgtgaagaccaagggcctctatttgtctacagcaggagcagcagtcatcaaattaatatcggaagtgcactcctacatcaagttgttgcaagtgtactcacaaagaagacatcttacaaaatgcagatggagctgttgcaatcattgcctaggccaaatgctgtcagagaaaatggatctcaatttactcaacacattttggttttgtaattttcaagattaactcttgccatcgtctgaaacaatatgaggttcttaggagagctttaaaaacgcactcttgtatgttcagagcaaatggtacaagtgataattgttgtgttcatgtccactacacgggggtggggtggtgattagctcaggaaaaagagctcatgtacctattgggaaaatacagtggaggaaatcatggggcttac

SEQ ID NO: 1339 - DNA, 45470 bp, Homo sapiens
agcgctgggggctgcaatgccagaggattccttgaggagaaggggctggtggggcgggtaggggctggccgggagcaggaccgggaggaactggaccctctggactggggagtgcggggtagatgaaggcagaggagatggaggttctgcagtgtgaggcaggcggacagggaagcctgcatccagctgagagaccttgagcaaccacgtcctcctctgagctccgcgtttgccgtgtgcaaagtgaaggggtaggccgaccccgcagggcccttcttgcgctcctctgcggtgtgtgggggggtctctggtccgcgagaggacagtccctgccgcgccgagcgtcctccagcgtccgcggccgccgcgagcagcgctgaccggcagggggcgctcctgcagaaggctggccgcggtggcgccctcggcggggcctgggctggcctggggacccgggaggcctccccctccatccctccaggtcctctcccaccacttgccttctcacaccgccccttcccactctatgctctgggattaaaggcttgggaagttgctggtatttaggtccttgggcaggccacttcgcctctctgtgcctcagtttcttcaggcgcaaactgggttgtgtgaggaagagatgagttattggtcaggagagccttccagccacaggtgaggtagatatgccgctgctgcacaccccaatatcattcctagggcaggggctgctgctctacaacctcagggttacagttagctttaaatctttatttatttggttgttttttcagacagggtctccctctgtcgcccaggctggagtgcagtggcgcgatcacggctcactgcagcctcaaactcctgggttcaaaccatcctcctgcctcagcctcccgagtagctcgaaccacaggtgcataccaccatgcccagctattaattttttttgtagagatgggatcttgctttggtgcccagagctggtctcgaactcctgggctcaagtgatcctcccatctcagtctcccaaagtgctgggattacaggcatgagccaccgtaccctgctttaaacttttattcaaagtccttttgtgcaaagatagaaataattcctggatcctacagagtgcctggcatgatgagtgatgctcaaaacgtagctgtggaatgattagttttttgaaaccatccagacagaagctatgagaaaatcagacagtgcacctcttctgaatcacactggaagatgtccacattcatcttcacatttctcaccactgttctgtgaggaaggtggacagggagtgttgtatccattttatggatgaagaaaccgaggtcgcagaggaagccagagacaagattttaagttaggacccagggttctctccatgcaacctcaggtaaattatcctgttgttgctagtgactcctattggagacatgtggtattgcaaccaggccacattagacactgaaggcacctcatgaggaagaaggtgggcacatcctgggtgccaagcccagagagggagaaactagggtagatattaatatcggagctgggggaatgaaaatgatatttcagaatcaacaacagattggaaaggcttaactagtttaaaacacattccctattcttaagtccccaacactttttcaacctcctctcactccaaagtagaacttaatgtagcaaaggtatgctttgtagggtgaacccttataattataatgacaaccagtgggaaaacttggtttcctttcaaacgtttgtgtgactaattaggagggactattccattcgttaaagtgaagaaagaaggactgaaaaaaaaaatcactctgcaaaatccagctcaaacattgctgcatctcagttgccattgtcttagctacctcttccctggaacaatgaattgattgtcttctttcctgggttcctgcctcatttggtactttcttctctttactgctgcacagtcgttaaatatgtgtctttggtgccagctccctgggttctaatcccggttctaagcttactagctggccagttacttgacttctctgtgcccatttcctcatttgtaaaatgctgtgagcattaaatgggttaacagttttataggacttagaacaatacctggtgtaatgtaagtgctcaataactagtttacacttatatagatatgtcagaatgctctctgtatttatttatgtgtctttcccaacaaactgtgtgctcctcaaggacaagaactgacttcatcatctcctattccagggtttagcaccagatgcttattcaaagtatgttaaactgaatattatgtattcatactttattattattttttctaagacaaggttcttgctctgttgcagttcttgctctggagtgcagtggtggcatcatggctcattgcagttgcaacttcccatgctcaagaaatcctcccatctcagcctccagggtagctgggactacaggcatgtgccacaatgcctggctaattttttttttcttttttgtattagcagggtctcactgtgttgctgaggctggtcttgaactcctggcctcaagcaatcctcctgcctcagtctcccagaatgctaggattataggcatgagccactgtatccagcctatactttatataaagtagaaaatatgcagtgaggtggagttagccaccttttttttttttttttttttgataagttaagcctcagcttactgcttcccagagataaaccaaggttcgagtctctcctttgtttaaagaaaaacatctggctgggccactgcagtcctaccatgagttcaggaaaacgtgctatggtccaactgtctaccagtcaggacacagttaatgagcacttcctgtaaacttatttgtacctgcagttctgataatatgacctggaggaaatggtgtggtggtggccgatttctaaaactaactgcaaaggattgcattcctctaggcacctatgaacttcaagatgggacccctttcctctcgtccttctttttagagagtttagagagcaagaacttactcagatgaaaacaaactaaaagatgttgagaatgcctctgtgcagacccaaatctataggatgttatttatagtaaattatggcatatttttaaacttctagtccctaagaaagttgttttcttgcctccctccttcccttccttccttccttccttcctctttcttctttctttcttttttattttttggagatggagttttgctcttgttgccccagggctggagtgcaatggtgggatctctgctcactgcaacctccgcctcccagctgcaagcaactctcctgcctcagccttctaagtagctgggactaccggcatgcaccaccacacctggctaattttttgtatttttagtagagatggggtttcaccatgttgaccagtctggtctggaactcctgacctcaggtgatccactcgcctcggcctcccaaagtgcttggattacaggcgtaagccacagtgcctggtctccttcctccttcttttgagcagtatccatagctatgtcctgtgtggaatgcctttctgttgtaaaacaccccaacgtagagtctttcactagtgctttgcccataggggacttcacggtggttgaagacagaatgccctgctgctccgtgccacctgcccagccatctcctagtctctaggtcagctcactgtattctatgctcctggaagtggtaaccagggctggggtgggggttatattcacggtgagcccagtgcccaaacagagcttggacatatatgtcacctgacatacatgagtcgacttacagggacaatggagtgagttatctgaattttttttttttttttttttttgagacagagtcttgctctgtcaccctggccagagtgcagtggcacaatctcggctcactgcaacctctgcctcctgggttcaaacgattttcctgccttggcctcccgagtagctggggactacaggtgcccgccaccacacctggctaacttttgtatttttagtagagatgggtttcaccatcttggccaggctgctctcaaactcctgaccttgtgatccaaccacctcggcctcccaaagtgcagggattacacgtgtgagccactgtgctggctttttttttttttttttttttttgagatcaaatctcgttctgtcctccaggctagagtgcagtggtgtggtctcctttcactgcaaactccgcctcctgagttcaagcgattctcctgcttcagccatctgagtagctgggattacaggcacctgccaccaggcccagctaatttttgtattttcagcagagatggggttttgccatgttggccagggtggtcttgaactcctgatctcaggtgctccacccacttcagcctcccaaagttctgggattataggtgtgaaccaccgtgcccggccatgttatctgaaattgagagttctcctccaggtcactacttacttacctataactactagacagaactggactgctcaaagcactcctgctagtttcaaccgtttcagtacagatggctcatcctgtctctcatgaacattataaaatcagaggcagggtttgtagccatcaataagtcaggtctgaccttccacagtccaatgtttattcattcagttattcattcattaattcagttatttaacaatgtttttactgtgggctgaaactcagtaccactatgggaggaagtgtgggatagaaaagaaacaggggacagggtctcagatcttgaggtgtctgcagtctacacatagcagggatgcctaatctcccaaactcaaggacagtgtatatcaacataggcactggcacaaagtacagttgtgccaataaaggttgtagaaccaatgtggtgagtgagcagaggcaggaattgtcagtcaaggtggggttccagctgcccttggccacagaagcatggctgggtggggggccaccaaagggctgcttctctgcattcagcctgccttggctgaactcaaagatgctgctggataaagggctggagaatggccttgaataggcaaggggcaagagaaggtgggtcccacaccgtcctcacaacacaattcaaagagttctgtgaggaagaagagggagggagggaggaacagaagtgagaaggcctcgaactggaagtgccatggggagtggtgagctctgccagctctggagtgagcttcccaagataggacaggggcccttcccgcagaaggacagatgagtgaaggtcacagaggactccagtccagaaatactgccctgcccctcccaaatacctttcctgcaaatgcttaaagttccaccattggagatgtattgttatgtatttttctcctccccactttcagtaatttttttcattataaatgtcaaacattcttgtcatagaaaactaggaaaatgcaaggaagataaaaacatttcttaccccacactcccaacctccaaggcagcccctattaacattttggtgtccttctctgcccccttttttgtcattttcaggcatggctgtgagttccctggaggggattctgaagcccactttccccacttagcttcagtcctatttcagtctggtgttccagaaaaatcaagtcttccatccccgagagccagtgagttctatgaccttgaggaagtcattcatctttctggactttagtgccctcatctgtataatggggacaatcatggcccacatgctacctcacagtgctccagagtcaatgctagtgcaatgttgcaagggcattgccaatacagttcaagtatgtggggctaggactgatgggagtggtcaggactcagccagtcatcataaggctatgacaagaaggccaggtcacctggaggatggggaaggacagggagagggacaggtgagcccacacccacaccagtcctgtccaggctccccaggaccagccctcctgggcagctgtgtgtcaggtcagcatgggcaccttccctcggagctgctggggcatcatctgttccacttcctgttgggtccagagttcatttccagtgcagtttgagggagattagaggagagagccagcctgggaagccgcatttccacttgggaggcacaggagatatggagccaaccaaaggcggatggttcctgagggtttgtttcaggcagggtgggctggcctgggggcaggtgccgggaagaggaaggagaggtctgcagacatcctggagctagatttgatgtggccatagcaaagctttcagcctcatcatgtttgtgatttccaaagtgtgtgtgtgtgtgtgtgtgtgtgtgtgcacgtgcatgtgtgcacaagaggaggagagggctccagccctgagcgctggctgccttgggctggttaatggagacaggtagctgcatgtggatatccaagaatgcttctcttgcatacctgtgtgaacgtgtggacccaggaccagctgtggggctgcccaggaatgtagacacccatgggggaacagtgggggtctgtgtgtcaccaaatgcctggacttgggctgtagtgtgtgtgccccatggagcccgtgtccgagcccaggaaggagtgcttccgtcaccacacatgtgtttgtatgatactttacatgtttactgccataaaaaggccacaaaccagggttataagctgaaaacaacacttgtttcctgagtacctactatgtgctgggacctgtgccagactctggagacacagagagaagtgaaactcaggccagcccttcaggagcccacagggcagagggaaggtggcagagcaacaaatcatttatggcacaggctgtaggtcccaagggctgctcttcatgtccttcctcagggatcctataatatcacaattgcagggatgatctgttttcactgccgtctccccctccaggctataagccccttggggatggacacttaggaggtacacgatgctctgtaaggatgtataatgcaaaggtgtctgtgagtcaggctgtgcctgggcagttctgagccagccatggccaatcatgagccatagccagtactgacagtaccgctgggctagggctgggctcaattcctgcctccactacagctggcccacctacacctgctacgtcagctctcccagcctctgttttttcatctgtgcaatggagttatgattgtcccagcctcccagagggcttgaggctttagtgagattgtgagccaggcccggcacatgtgtgcacgtgcacacacacacacacacagagcttggtacacaggagctgctgtggaattattattattagcaagaaggagctattatctgggcagttctatgcagccttattggccaaaaagatagaagcagaactctgaagcctccatgggcaagctggaaggcaccccagcagacagaaacctggtacagttctaacatcaggaggagggaacccaagggtggggccacgccattggctggcaaggattcaagagcatccatctaaatattttcctcgtgtttctcactctccagccactgatgtctccatcgagtcttgggtgcttcttccagtctttgattcataggcttacccatcagacatcaacatgtaactttcatgaaattttgaaaaggtgtcactttgggagaatgtgccctgccttctccatgcacaagcatgcttatgtgtgcttaggggcatgagaacaggaggagcagctgggcagcctgagctgaacccactccatcctcacctgcctagggggtgtggctggggcctggtggggtctgtctgccaccccagtccatggctcttccttctctctgactcacactggtccagctcaggcccctcatcctctagcttctgtgatcgtggttcaaaatcttaccagtgatatgctggagctgggtccagctggcctgcagggctagctgtgcacatctcttcctaactccagtgatcagaaacgatgccacattggtggcatgaagtcagccatgatgggaatatttaaggcacagagatcaacagatgatacaaatcagaccaccatcaaccctccttgagaaccagttgtaaacaccatcacaccccagtcctgcctgcaggtataacgatcactgatattaggtgccggcacctgctaggcatttaatatctttttttttttgttttgagatggagtcccattctattgcccaggccagagtgcaatggcgtgatttcggctcactgcaacctccacctcccaggttcaagcgattctcttgtctcagcctcctgagtagctgggattacaggcatgcactgccacacccggctaatgtctttgtatttttaggagagacagggttttgccatgttggccaggctggtctcgaattcctgacctcaggtgatcctctcacctcggcctcccaaagtgctgggattacaggcatgagccaacgtgcctggccagcatttaacatcttacctgcacaaaaatcctgttagatatttctcatcatccatatttcatatggggctcataacttacatgatttgactccaggtctctgcacattacattgggccatgtggcctcaataagtagaaccatgggatttgatagggctggcagagctgttaggaatcatcagatcatgtaatcactgcgctcatttgacagagaaactgagctcaaagaggctcaaagaggtgggggcttcctctgttaatgccacctaacacggtagccaccatcttcccaacacctccctcaacacctctctcagccccctaccatgctggtgtccactgaaaagccaaggtcgcagtcacttgatgttccctatgcatggctgattttttggaaactttacatgcagatcttgacattcattgcaagttatattttgttttgcttgatttgaccccgtgttcgagactctcaaaaacattttaaatctcacttgggtcattggttgtatgtctcctttctagacaggtaccacgcgccgctttgatctctgcaccttcgcagcagaaattggggttaaactttaaaaaataataagcaaaacagaactttggggcccaacacttgaagttcccaccctatctaccagagattctggcatctacacaccttggaaagtgggtccctcctcccgcagggctctgtctgccccactgtccactttggatttctgcgctggggaacatcagcagcattttgtcaaaagcccacggaggcccacgctgcgcgcctcgccggtaacagtcactctcccgtttaaaaacagagcgccctttcctctctcccctctgcccaagactctttgcctggcaacagggtcccctgagccattggacatgcatttcccccgcttccagagagcggttctgcaccaggacccggccctgccctgagtctgcgggctgcggcgaagagaccgcacttgcccggcaggagggcggacaatgacccgggttttccaccgactccagatgcgtccctcctcctacccctccaccttctctacctcggagaagccattgcgcttgcctccgccccatcccggagaggcagaatctcctccgtccccgcctcgtaccctcctccccgcctctccaggcccggggggcttcacgttcagccaccgcgaccccgggcgggcgcggcgccaggtgagcgctcacctggggccggagggcggggcaatgggggaggggcgggggcggtccaggggcggctgccccacccgcgacggggcggggcgagggcggtggggccaatggggcggggggctcgccgcccggggctggggagcctcccaatctcctcctttcccagcgccgcctgccccgccccacccgggtttaaagtcccgcgggcgggtggtggcggagctgcgagcttgagcggcgcgaggagatgctagagggcgcagcgccgccagcaccatgcgccccccgcccgcgctggccctggccgggctctgcctgctggcgctgcccgccgccgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagtcggagttcgcgccctgagttcggtctccagcttccccggctccgaatccatcgccctgttcagtgtccgagtctctggtcgccccccagccgccgctctcctcatcccgccgggtctcggactctgcgcacgcctcggaccctggccccgtccgccccggccccgcccgttcaggcgtcagtcccgctctctgatgccctctcgggatcctcacgccggtgccctgtctgccgccatcctggcctccggcgagccgtccttgcctcggactccttccccaccctccgccttcgccctgcggagcggagaccgagagggctgggtggatgggtgggacgggctgttcccggtctcggggcagaggatcgtgcgcgtccagggagaatgggggaaacctcggacggtgagagcgccagctggagacgcaggaaggaaccgtgcgctggggaaatgcgaccacatctcagacctggcatggggtgatttctcaggagaacactggaaagagtgagagggcccagtgtgtgtgtgtgtgtgtgtgtgtgtgtgtgtgtgtgtgtgtgtgtgtgtgtacatggttggaaaaggaggatcacagtggggggtgacacctgggggacagtggggtaggtgacactggggagagagccggacaggaactatgtggggaatgtttggagcaaaagttatagggcaattgtttccagtcccttcttctctgaccctgaattgcagggatttggtgagggatgggggcgggtatcatgggtaagaaggcaccttcccaccatccacccaaagccaactccaatatgtacagcctgttactttaagccttgcctccttttaaaatcttcaccccaaatcaataggaggcttacagtctgagtatatacagcaaaggcaagaaaacaccaagcaagtgacctgctagaggctgctttgaagaagtagccagggagaggtatgtaaaggtctgagaagttctgcacaggttggagtaagggctgtgggctaatttccaggtcatgacccctggtggaaacatgtctgggctgtggaggagggtatcatcccagaccctagctctgggcttagcttgctaatgatatgggaagaccactcagtctctgggcctcactttctccttttgtacaaagaaggggttgaacttgatatgactgatccttttgcgatccaccccaacagcagtgcacaacttgtttgtttccgaagatttcaggcttgaaggaatggttgttccctcggcaggcaggatgtcatcatcactagggcacagactctggggtcagtcttgccacttgctaggtgtgctcttggccaagtcacttaacttaacctctctgtctctcagtctctcaatctgtaaaatgaagattatactgcctattttataagaagattgagctagtacatgtaaagcacttaggacagtgtctagcatgcagtaagtgctcaactaatgctagtgacttttttttttttttttttttttttttaagacggagtctccctctgtcacccaggctggagtgcagtgatgtgatcttgggtcactgcaacctccatctcatgggttcaagcgattctcctgcctcagcctcctgaatagctgggactataggcgcgtgccaccatgcccagctaatttttgtatttttagtagagacagtgtttcaccatgttggccaggctggtctcgaactcctgatctcaatctgcccaactcagcctcccaaagtgctgggattacaggcatgagccaccaggcctggctagtttttttcattaaggaaaccagttatagaatcttgatgtcctggccctaacagttttctgagctggaatggaaagggatgggacaaatggtacctatatcctcttacacactggctcatttccacgattcatttgtttgcttggtttttatggttagagatggggcaagagtcaggtgagatgagaggagaggggttccaggaggaccaccctagctgctgtattggaagggaaaggtgttctcagcagtgcatggggttagaattttgagggaactgagcatggagcagccttgaaaatgacatgtgagatggtcaaataggcctgggttagggctgagagggatgagtatcggagccacctcttccaggtcaggagcccagctggaaagagctgacaaaagacacaaaagccaccaccaccccaatctggggagcaggacagatgctcagagaatcagctaaaactggggcctcatgatgttaagtgtttggtctcagggaacagacaggattcagcctgagctctcagttaagaaaccctctggtgactcagaccaggtttcccagcttcccatctgcattcgctgtctgggaggaatctggtatcagtcatctacactgtagtgggaaagtgaggcaaagcgcttcttcctccgcagtcatttgcatttgattataacacaaagtgctttggcatcctgataagagaatatgcaaacatcaggagggcaggtgaggccgatcttcttgggctctttgaaatcatagaatcgtagacttcagagttggaagtgaccccagaaggatctctggtccaaaactcactgcttcaagcaggatgtattattatcccaatttttcagatgaggcaacccccaaaccccaaaccacagtgagccagctgttggttctgctgcttttgagtgagcctagagcctaattctgttaatggtgataaaaaaaaacataactagtattgcagtttacaaatctcttttttctttttttgagatggagtcttgctgtgtcacccaggctgggtgcagtgtcatgatctcggctcactgcaaccgccacctcctgggctcaagcaattttcctgcctcagctttccgagagctaggattactggtgccccccatcacaccccactaatttttgtatttttaatagagatggggtttcaccatgttgggcaggctggtcttgaactcctgacctcaggtgatccacttgcctgggcctcctaaagtgctgggattacaggcatgagctaccatgcccagcccatcactttctcatacagccatctctctcatctgatcctcagagccatttctccagagccatgtaggatgggtgtaaatagttcccacaaggaatctgaaggtcagaaaggttcagtcagtcacccagtgttacacagtgaatcggtgggggaggttgaatagaaaccctgcttccagtctgggcccttcaacctacaggaacagcctccagtgctaagacagtatgattcccccagggcagcagtggctgcagagaggccgaagggggtgagggtggagggagcctcccttccctgcttaattgactcttttagactctcttggctgtagtgagatggataaggccgcacattcttttctgtcctcagtagtgagacgggttgcactgacccctgctagactgtcagtttggctcacagaacagcatgatggcagtgggacaggaggcggaccagaggtgagggtccaagctagtcctggctctgggacactctctgtgttgtccctgatcaagtcactcatctccaaggtcagtagcacctggaggtgctaaggttccctaatgctaacagggctggtcctggctctggaagtctaggattgctgaagagtttttattttggctttgaatgcctaggaattccacaaatgttaacttctgtgatgttgtataaatgaaaatgcactgcattatgtgatgagctgggcacaagacaggcccagttacccaatccagtctatttatttatttatttagagacggagtctcgctctgtcacccaggctagagtgcaatggtgtgatctcggctcattgcaacctccacctcccaagttcaacagattctcctgcctcagcttccccagtagctgagattgcaggcatgtgccaccatgcctggctaatttttgtatttttagtagagaccatgttgatcaggctggtctggaactcctgacctcaaatgatccacccacctcagcctcccaaactgctgggcttataggtgtgtgccaccatgcccggcccccagtccagtctgtaagttatccgagtggctttgtaactagaaatagtttctgtggatgcaagtttttaaatcataattaactttggtgatgtttcttcagtgtgtgacctctgcactggttgagtttctttcctctctagggatagtacagagaagtttatgaaagcccaagacagtgaatcccagctttgcctgttgctaactgtgtgactttagacaaatgtcttaaccttgctgagctttgggttatgagaatacctatctgagaggtgagggtgaggcttaattgaaacaatgaatgaaagggctggatagggtgtctggcacatatgtgctaagtgctcagtccaggctcactctcagtggatgctggggttctaaacatcatcccaggtggtggaagtgtcattactataattccattggagaaacaaaacataatctttattttccccccaaatcgttgttatatacaatgaaatgcatgctttttctttcttttttttttttttgagatggagtctcactatgtcgcccaggctggaatgcagtggtgcaatctcggctcactgcagcctccgcctcccggttcaagtgattctcctgcctcagcctctcaagtagatgggatgacaagtgtgcgccaccatgcccagctaatttttgtatttttagtgaagacacggtttcaccatgttggccaagcaggtctcaaactcctgacctcaggtgatccacccacctcagcctcccaaagtgctagaattatgggcgtgcaccaccacggccagccaatgcatgcattttaaattgcacagtttgggttttaacaaattatacacctgtgtaacacatttgtggtgactccaatgactacatagaacatttctaccatcctaaaggatcctttgttcctctttgcaatcaaccctctcccaccagcccatggctactccacttctccgctttcagtcactatgtgttagttttgcctattctggaagtttatatcatgaaattgtgagtatatagcctcttttgcttggattattttgctcagcataaagcttttgagattcatccatgtcgttgaatatagcaatagcgaattcctttttatggctgagtattcctttgtatggctataccacaaattatttatccattccccacttgatagacatttgggttattttggctgggcgtggtggctcatgcctgtaatcccagcactttgggaggccgagacgggcagatcacttgaggtctggagttcgagaccagcctggccaacatggtgaaaacccatctctactaaaattacaagaatcagctgggtgtgatggtggtggtgcatgcctctaatcccagctactcaggaggctgaggcaggagaatcacttgaacccaggaggcagaggttgcagtgagccaagactgtgccactgctctccagcctgggcaacagagcaagactctgtctcaaaaaaaaaaaaaaaaaaaaaagatatttgggttatttgcagttttggactattccaaataaagctggtataaacatccatgtacatctctttttgtgggtgtatgttttcatttctcttggataactgtctaggagtggattgttggatcagatggttgatatatgcataacttatagaattggcatttttcagagtggttttaccattttacacagtaatgtatgagagttccagttgctccatattctatggtcagctatcatcagttttaacttgtggctattttcgtaagtatgtagtagtatctcattgtggttttaatttgtatttccccattgatgaatggtgtgttgaacattttcccatgtgtatattggtcatttgaatatcatttcattgggttatttgtcttcttattgaattgtaagagttctttatgtattttgttgttgttgttgttgctgttgtttgagatggagtctcactctgtatcccaggctggagtacaatggcatgatcttggctaactgcaacctccacctcctggattcaagcaattcttgtggctcagcctcccaagtagctgggactacaggcatgcgccaccatgctcggctaatttttgtatttgtagtagagataaggtttcatcatgttggcctggctggtcttgaactcctgacctcatgtgatccacccacctcggcctcccaaagtgctgggattacaggcgtgagccacttggcctaagagttctttatatattttggatacaagtctttgtcacaagtactggtaatattttattcctgcccgtgacttgccgtttcattttcttattgatgtcttatgaagaacagatgtttttaattttgatgaagtccagtgtatcaaccttttcttgtatggtttgtgctttgttggtgttctacccaagaaatctctgcctacccaaaagttgcaaagatttcttcctacgttttctcctttttattttattttattttattttattttattttttggagaaatgatatctttcggtcctccaggctagagttgcttctgctgcttttgagtaagcctggagcctaattctgttggtggtgataaaaacataataactagtattgcagtttacaaatcactttctcatacagccccttctctcacctgatcctcagggccattcctccagaaccatgtaggatgggtgtaaatagttctcacaaggaaactaaatgtgttacacaatcacagctcactacagcctcgaccttctggactcaagtgatcctcctgccttagcctcctgagtagctggggccacaggcatgcgccatcacgcccagctaattttttatttttttgtagagatggggttttgctatgttgctcaggctggtctcaaactcctgggctcaagcaattctcctgcctcggcctctcaaactgctgggattattggcatgagccacagctagaaacttataattttagctttttttttttttttttgacagaatttcactcttgttacccaggctggagtgcagtggcatgatctcggctcactgcaacctccacctcccgggttcaagtgattcttctgactcagcctcctgagtagctggaagtacagatgcccgccactgtgcctagctaattttgtatttttagtggagatggggtttcaccatgttgggcaggctggtcttgaactcctgacctcaggtgatccacctgcctcggcctcccaaagtgctggcattacaggcgtgagccaccacacccagccaatcttagcttttacccttaagtctatggttcattttgagttaactagtgtgtacagcatggagtaaggggcaagcttattattttgcatatgaatgtccacgtgtttcagtgccatttgttgaaatgatgatgttttctccactgtcatctttgttgctcatcaattgattcaatatgtgtgggcctatttctggacactctactctgtttcatttatctatatgcctatccttatgccaatactatacagccttgattacagtagctttaaaaaaaatttttccccaataagccttttatattcctagattactatagctttatgttaagtcttgaaactaagtactataagttctctaactgtgcactattttttcgaaattgcatgggctattcagggtcattgtatttcggcatagattttagtagtatctcgtcaatatccacatgaaagcctcctaggattttgactgggattgcattgaatctatacatcagttcatggaagattgacgttctaacaatattgagtctgctgatttgcacacaggccatatctttctatttagagcttttgtaatttctctcagcagtgttttctagttttcagtgtgcaggcattgaaaatttaaaaaaagaaattcttccaatgtgctctatgtatttagatagtattgtttttatttttaataaaaacacatttttagaaattgaattggggcctgagaaaaacatagttggagggaaggaaaggtaaaagaaattttactgctttgggggtggtggactgaaagccaaacatcgctgataagaatcactgtgttttgggaaggaatttaggccagcttgtctctggctgagctgtaacccctgaggagctgggctccagagttgggctgagagtcatcctagcctcttcagtggatgatggtggactttctgtggctgaggacgggaaggaggagaggagggaagcggggccggcagactcccgggctggaatctcctaaggaagagaggtcctggtgcctttgggattatgtgctcaggtggaagttgggctcaggaggaggtgggccaggtgctgtgagggtgactcccatcctggcatcagcatgagcaggatcggacatggcccaaggccctgttatagtgtaaggggcactgggcttggggtcacacagatcagagttcaaatctccatctaccacttactgactgacccagggcaagtcagataaccattctgaccccagttttctcatctgtaaaatgggataatcttgatctcttaggcttgttgtaagagttaaatgaatgtatatataggtattcaaatgctatctctatataaggattccaagaaatctagtgatctgccttacagcgtcccacgtttagaagagtctttggtggtgacatctgttccttcttctctgtgcctgtatcccagccactgtacaattcagaacaaacccagccttttctgtgctcagcactttatgtgcattacttcacctcacattgtggcaacccaggaggtaggtgctgatataattctcatttattttaaaatttcactttttttttatttttagagagataggttcctgctctgtcacccagactagagtgcaatggcttgatcatagctcatggcagccttgaactcctgacctcaagcagtcctcctgcctctgccttctgagtagctgggattacaggcccaaggcatcatacctggccagttatcctcatttataggtgtgcgtgttggggggaaactgtcagaatccaagccaacctcttcatctctgccatatgttggcagtggaaccccaactggaggcctgtccccttagggcagctctgtccctctgagccccgaccctgtggcccaggccctgcacttggtgcatgtcctgggcatctgttgtcctgtgtgtctcaaactcttggctcattagctaatttttcaggtgctcaggtcttcaattcacttgtagtttcctttagtagagacctcggggccctgctgttggctgagtcccacagtctctagcagtgctccctggtctgcagtgaatatcttggtgggcagcgtcctctccctttcactggcccttcctttcccctggaatctccctctgtgccctgtcccattcactccttcatcttctgcctccatgggctctctggggcacatactacctcacctaggcctggccaactgggagccatggcctggcttctgtcaggataggaactggacacaaagcagagagcagagacttatccccatcggactccagaaatcagccacacccaccacctcatggcatgctggtagcagcagacatgagctgggggcatagggtggcctcttctacacccaagcccctcattggagagatgaaggctgaagaggagggtgaagagtcttagagccagaaagaccaactaccaagctctggtcagtcctggaaacttccaagaggctggttttagggcaagaccaaagggtttgtttttcctggtgttacaatccctttgaggccagatgctgtcagaattcaacatttctctttgaattttagaaaagtaggccgggtgcagtggctcatgcctgtaatcccagcactttgggaggctgaggcaggtggatcacctgaggtcaggagtttgagaacagcctggccaacatggtgaaaccccatctctactaaaaatacaaaaatagctgggcgtggtgacagccgcttgtaatcccagctacttgggaggctgaggcaagagaattgcttgaacctgggaggcggagtttgcagtgagccgagattgtgccattgcactgaagcctgggcaacaagagtgaaactccgtctcaaaaaaaaaaaaaaaagaaaaagaaaaagaaaagggaaagaaaagtaatataggaggtaggggaggcagaacaaataaacttaaaaaataaaaattaaaaaattaaaagtacagaaaggtaacgtatcgtatattccatggctaacagcacctctagcaagatctggggcagcacctgtaatcagactctattaattttgcaggtagacatctacaggttgggataaacaaagcccataatattctccctggtttgggtcagggcttgctaccgtatgagttcaccacaattgttaaaaaaacttgtagttttctgagtttcctggaatttggaattgtggataagggtttgtgaatctgtggcaaattctgagcccaagtcactgcgagaggttgtgcaagctgagttttttttgtttgttttgttttgtttttttgagacggagtcttgctctgtcgcccaggctggagtgcagtggcaggatcttagctcactacaacctctgcctcccaggttcaagggattctcctgcctcagcctcccgagtagctaggacaacaggcgtctaccaccacacctggctaattttttgtatctttagtagagatggggttttaccatgttggccaggctggtctcaaactcctgatctcaagtgatccgcccgcctcggcctcccagagtgctgggattacaagcgtgagccactgtgtaccaggcctaagctgagttttaaacaaagactcaggccagttgcttggctggtcctcgctgggtgtcaccaggctacccaagcacagatcttccccaggaactgaggttcagagggaacgggcctggctctcagaccccaaggtacagggccccacaggggctgaggaccatggcgggatggccccgagatctggcactggggagagcatacgccagcaatcagtcgtgggctagggagggcgtggcacaggcagcctcctccagagccacgccctcccaaagcccgcccagccccagcttgggaaggtttggcggtggggcgttaggtggtagcctctgcagccagagagcaagaccacagcgaagccagcagggtgggactgcagggaggctgagggacagccccgaactgcactccttgcgtggggttagacacctaaggggcataatatgcagccagcaggtgtctgtagagcatctgcttgggaggagcacgcatctggactgggaaagaatggatctcagggtatgaaaaaccatggcctctgccaaggagcttacaggatacagctttgaagaggaagaaaggagtgtctgccatgcggaactgatggtactatatatacaaaagtgggagaagacaaagaaagaggatggttagagggggatggggctggcaagtaaggagggcttcctggaggaggcaaacaaacatcacagcatactagagctgtctgggacctcggggtgatcaaatgttaaaaaaggacatggctataaaaggttccagggtatccatgagggcttttggactgggagaaggttacagcatgggggtcggaccgagttagacatggcagaggacaagggagagactagcctggctgaggggagggtcccctttctccagccctggctggctctggatttaggacagtcctagtggttctattcccaagggagccgctcacaactacatccatcccagggggtgtcctggactactctgggggtggatccttgatcaggcagggaggttcctgctgtccctacagctgggcgaagggtgtgggccatccgtggggcctgcaggagaacaagtggaatctgcagcatgggacatctctgcctagagcctgtgcaaacaatggcactgtcctcatcattgagggggtcacgcacaaggcattccccagaggcctggcccttccagggcccaagcccagcctgagcctgcctgtgcgtgggaagagggtgatcggagcccagggtgcattcaagaacctgtcaaggtagttagttggtcaatgcgtcatggttaaataacttggctgcagtcacccagccagagtcacccagtaccctggttgggtaggaacttgccaccaggagtgcggtttcagccatgatttgcctttccctgaacttcccacccactgcctccacatccccacaccaagctcccccaactccttctcttcacataccaggccctctcctttgaacttccctctatctagccaagtatgttctcaagcactggtattgtatcagactctcacactttagtatgaagaggtaggccacttctgtaagcctgattcctgactttttgctgaagagactgagtttcagaccagggaaagtagcctttaaacagagggtctttctctcccttcctgagggtccacccttgggccacccagggggtcagaggagtcctgaccaggtttccttccctcaaaacctagctgtcttgcatttccaccaccttagatgcttgctgtggtgatggctgatttggcttccctgatgtgctgggtctgcaagcagaaactgccaggcttggtggaagcaatcaagagacctgggccacagacccagccctgctaccaagccagtgggtcgccttggacgaccaatcttgcatgaatttgtggccaccggagacctgcacacttggcatgcccttgccctcctgcttccccgcacagcctccaggacaccttccaggagccagcagagcagaacttctgggccgggtgaccttaaagggtttctccagctctaacgtataatggtttgaatggtgtacatttggactcagcctaggaactggggtagatgtttacagtcacagactcatagaggtgatggatccttctttgcaggaatgactttggggaccctccgcagccactgtgacacctgatgcatacgtgccagggacaaaggcttcctctccttggcttcagcccgagcctgagtggagagggagagagacaggaggaagaagaaaaagcatttccttcacagatgttgaactagccacactctaaatgccggggattgttgagatgcaaagcatgcttgctgtgcgagctgctcactacccacttagcccctgagcacgtctccctgatgccatcccctgcaggcagcctggtctgcggctgtgagacaggaagtggggctgtgcttggagagacaaagcctacagctggacccggctctttcctctctgagtcagggatgggtgggggacgaggctgtggggtgggctccagcggggaagtgtggccagattcagtcctcagggtgggttcatggggatggagggtgagagctgggtagggaaggaaggctggatccaggagtaggggttggggagccagacaggaggaacgagtggttttgaggtctgtgggtggactgggcaaaaagctgatgcttagaaaagtcctttttggtgtgtgtgacagggtctcactctgtcacccaggctggagtgcggtggcgtgatcatggcccactgcagccttgacctcctgggctcaagcgatcctcctagcctgtagctggaaccacaggcacgtgccaccatgcccagctaattttttaatttttaattttgtagagacaacgtctcacttacgttgcccaggctggttttgaactcctaggctcaagtgattcacctgccttgacttcccaaagtgctggtactacaggtgcgcgccacaatgcctgaccaaaaaaatcctttatagttgtacttttgtttattgatactcagttaatagaggtataaatgaatgagcgagtaagtgaaaagagggggtggagagagttgggcataaaggtaggaaggttggaaatagtagcttccgaatttgcctggctgcaggacgtcatggaggaggtgcaaggtggcattgggtgctgtagaagagaaaggcacctggaaggtagaggggagggtgtgctcacagtaggggaaatctggggcctcccagtgtaacagcaggaggggagagaagcctggagttggtgttgagcagccaccctcaaaaaagggctgcccagagccatggtgccctctcttactgggccaggcactgcccctcactgaactccccgctactgggaagaggttgggagcggagagcacaggaggggctaggggtgtgtgagagtgtgtgtgtgagtgtgtatgtgcgtgagaatgtgtgtatgtgtgagagtgtgcatgagtgtatgtgcgagtataggtgtgtatgaatgtggatgtgtgtgtgagggagtgtgagtgtgtgtgtgtatttgtgtgtgtagggggatcagtgagggccaggagaggtagactgagacgtttgagatgaaagcacaaagggcgcactcaccatgcaaatggccttgcagcggaagcctgttatcaggagcatctgatggggtttttcagggtggaagccagcaccccgggcagcacaaggctttcccggttcccaggcagctgcctgtagttggcatggccctggcgtaatgcactactcctggaccctccagctaagagtccagacacactggcattacctggtgccctagaaaccacctgccttgtcctgtgccacccacccaccacatcctggggatagcctctgctgaaagcatcagaccctctcaagcagaaactaggatgggagtaggtggaagaacagggcttggggtcctcttaggtgatgagaaaagctctccaccaacctggtcttccccaaacagcctggagtgctccctgagagcttcctcttgcctcctcctcacccccaggcctcctacaggcaggatgggactggtcaagatcaagttctcacctgcatggtaccaggagttctgatctgggtccctaagcagctactggtgtttcctcaaggaggcaggccagtgcaaagctttctcttccttccccttcttggggccttgagagagtctggaggactcctgagtccaaccaacttccttccagactgtgagcttcttgagggcaggaccgtgtcccagcacagtacctggcacatggtagatgctcactaatgacaaatacttatctggagcttactgtgtgctcactgctctcagagcatagagaggtaaagcaccttgcctaaggtagcacaactaggaagaggtggaggtgggatttgaacccaggcagtctggctccagccatcccctctcatgagttaaggtgtatttgtttgatggaatgagctcagttggtgaggggacaaccctgaggtcacctcggagtgagtcagacctaggaccagactacctaggccagaacagccttggggcatgagatccttgggccccactctccaggcagggggtgggtgattactgaagggtgaggtccctggggtcctgctgacggtggacagagcagtctcctgggaggcttttgccaaaacctgggagagccatcttctgcttccttcaaggtcaccccagcggggcagctttagccacaattgtgggtggggtgtgtgttggagagtgtgaaaggaggtggggaaggaggttccaggaggatcagaagagatctgagggtgagagtgtgtgagatgaagccctgaggggcacccttgacttctcccactctagagaaagacaggctggtctgtcaagtggttgggggtgtcctggggtccaagccagaggtcatcgcatgtgtggaggtgggggctctggttttatgatgaacctgaccaccaaggaccatggggtgaaggtgcagagaacagaagggcacagactgggggcagcaaggggaggaggcggccgctgttcacctggggtcattgctttcttaatgggaaaagagaggctggaagttagcctggggagcctgagacagacaggaatagtggaggtagctgggccaaagcaggtgcagcctgatagagtggtggccccaggaggctcaggagcacctgagtcaggcagtagcccccagcccagaagagcaattagcaagttggcaaacaacccttcctctgccctttagttcagaaccctggttacttgtttaactgatctgatagcatctcattggccataaggcagcatcttcattaagacccccatatttggctgggcgtggtggctcatgcctgtaatcccagcactttgggaggccaaggtgggcggatcacatgaggtcaggagttcaagaccagcctagccaacatggcgaaaccccatctctactaaaaatacacaaaaaaaatagctgggcgtggtggcacgtgcccataatcccagctactcgggaggctgaggtaggagaattgcttgaacccgggaggcagaggttgcagtgagccgaaatctcagcactgcactccagcctgggtgatggagtgagactcgattaaaaaacaaaacaaaacaaaacaaaacaaaaacaccaaaataaacacatttttctgggttcataagactaaggaagcccacttgaatttctccagttgtccatcttacccccttggcactcagctaactgtgggtaattgagatttcacagagggacccagtgagtggtgtctgcagggctgggatgccaaacagtatgacttcttccaggggatgacgttgttcctgctgacctctgagcaggctgaagcctgccacacccagaattattctggggtctaggaagataccttcccagcagaagccatgggctgagcatgtgtcggataattcactgttgaggaaaatagatggtcattttctaaatatgatgtcatggtactatttcttcaaaggaaatacgatcccaaactgcaacacagaaaataaacagagggaaactgggtctttgaggcctcccaggctgtcttcatgggccctgtggggttcccgaggcagtgccagggagccttctttgagagcagccctgggcagaccagggcccggtgtggcctgaggcctctgtgcggttggctacctttcctggtcattaatcgctactaagtgtcattaccactaataaaattaaccgacttgatactggactctctgagccatcaatctcagggtccattagatgaaatttaaaaaacagatgcctctggggtggggcctgaggatttgcattccacagagctccaaggcaacactggccatgcagagctgggcaccgtttgagacccattgctccctccagggtctcttcccctgggcatcgcggacattgtggttggagtggagccgttctgggcactgcagagtgctgggcagcgtccctggtctccacccactccatgccagaagcaccaaaaacgaaaacaaaaatgaacaaaccaacaaaaaccagatgcctgttgaatgagtggaggggtttgctgggtctggctcccaagtgcagcctagggaattctggcactcttcacatgtcagaggtcataatcaaggatgatgcatttagttagacaaaccaactttgagccttcgctccacactacatgggagtcccagacaagaacacagcttgggcagggtgcagtggctcacgtctgtaattccagcactctgggaggctgaggcgggcaggtcacttgaagtcaggagttcgaaaccagcctggctaacatggtgaaaccccgtctctactaaaaatatgaaaattagccagggatggtggcgcacacctgtagtcccagctactcgggaggctgaggcaggagaattgcttgaacccgggaagtggaggttacagtgagctgagatcacaccactgcactctagcctggaccacatagcaagactgtctcaaaaaaaaaaatgttatatatcatgtcatatcatatgacatatactgtagctataatgatataataatcatagctattattcttaaaatggcatttgaggcaggtcttgaaggatatgcagcttcattggccaaaatttccatcactccctgcttgctctcccctctgtcaatcagttgctatcagggaggtccagtttctgaaacacaggaattgtgtgagcagaagtcgccactcacaccagccctcggtgtgagaaggaggacatttgagggcaaggtagctgcagcccccaagctgccctccacactggaagccagtcaaggcgtggcctcctcagctggagttgacatccagttcttctctggacctgccaagggtcaaactctgaggatttcctgccaggctgcagggaggggtttgggtgtagacctggtggactggaaaattacccatttgcccccagattaatgattaacgggtccctgccctcaccctgtctgggagaggagcccagggccaggctaggccaacgggagcccgatagcatctgtctctgctcggaggtttcggagatatgctccatgatgggttgactgcacctgatgggtgtggaatctacaggtgatttctgagggcacctggggcctggccaggccgcataccctctggtgaggcttccaacttctggggcatacagagagggcatggcctccagccagatgtcctggctaaggcaggtgactccaaagaggagagctgtgcccttggctcagaggaacatgggcttctctgaccactcctggcttgaccacaggacttaccttggccagtggcacatgagcaacagtggcaagtgccacatccaagcaggagctctaagagacattgcctgcttccacctttgcttttttttttttttttttttttttgagatagggtcttgctctgtttcccaggctggagtgcagtgatgcgatctcagctcactgcagcctccacctcccgagctcaagctatccttccacctcagcctcccaagtagctgggactacaggtgtgtgccaccatgcccacataatttttctatttttagtagagacagggttttgctgtcacacaggctgctctcaaactcctggactcaagcgatccacctgctcagcctcccaaagtgtggaattacaggtgtgagccactgtgcccagcccacctttgatcttttaccctggctatgaggccaggatatcccagaacagggttacttctcttgggctgggtcctggaatgatgtatattccacccacactgggggcaccaggatataggacagcaaacattttgaaccagcagagccatctcacagagagcttctgggaagagggaagacgaactctaattccaattcccaccctgctgctgatctgttgtatgaccagtccagtcactgccccctcgtaaatcctttgtttcctcatctggacaaaggggagactctgcttagctggagagtaaagcatcttgcaaaatgagggaagtttgggaagctccagctagcaggaaggtaggcctgcttgtcccaggcactgtggttagtccatttcatataatcctcccaccaaccctaggaggtagagaagatcactctgcccagtttccagaagggaaaaaaccaaggtgtcaagattgcatagctagaacatcagccttagaatttggtagcttggctccagaatcgatgaactttcaatctaggagaacaagaagtctgggattgatggcctgatgggaattcagctccttcaccttcatctaaccatccatcagtccttccttccttcccttctctttccttccatccccttctctccccaggcatctgtttgtaccaggcaccaggtggtcagatggttgaaggtctatctgggaattatggaaacatgttagattggtacaggattacttgggcagcagcataatgtaagggagagagggatgtcaggggaccttggctgggtgtccgctcaatgtccacatcccctctgcctgccccctctcaggaatgtggctctcttggccaggcagccaccaatactctgtgcattatttcccaaacttcccggatcacaaaagctgcctagggactgtggtaaatgtacagattcccaggcccaattccaaaccaatagacccagaattgcccagcatggatcctgggaaagcgtatttttaataagcaccccagatgatttttctaactgggccaatagggaaataggaaaatagggtggataagaagagcagagaccggaatctggaaaacaggtttaaggtcctgcagcaacctttgttacatgaaccttggtttcctaatctgtaaaatggggacgggacctccagcgggtcagcctgctgcccagaagggcagtaaatgaagcccctgaggaggccccttcccttcatttgcccctcaccaccatccccaaggctcacctgtctccctcctctcgctctctctagcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggtggggaggagggctaggggacggggagggctgggggaagaagccttcagggaggaggaggctgggagaggctgccctttcctttttcctggctcccgtgcccaggccacactgcccttcctgccctagcacggtcccaaatgagaagagtcacaagagttaatgaggggcagttgaaggccagctgtggcccagcctcaggtttgggggagcagaggagcaaggaagatccaagagaggaggagacacaagcctattcctggaggagctcacagataagatggggtcccccagttgtctccctctgcctcttcacacacacacacacacacacacacacacacacacacacacacacacgaaacaaggcacatgaagacgtgaggatgggcggcagctgattccaggcccgatgacacgagccaggcgatgcatttgttcactcctttatctgtccctttgtttgtcacatccatcgatccatcagtccctccttcccttccactcccattctacctccctccccactccacccacccactaagcatccatggaggcccatagtgagccaggcactgtgccagatcctggaggttcagagctgaaccagacccagctaccctcgggaagcatgcagtctggaagggagaacacaggtcaccatgtgactcccttgccaaggggaaagggcttttgacagggaaggatgagggaatgtggcttgaggacacagctccgggtgggtctccctgtcaattgccccttaaactctgactcaagttgccatttaaatggaacttctagcctgggcgcagtggcttgtgcctctaatcctagcactttgggaggccgaagcgggtggatcactttaggtcaggagttcaagaccagtctggccaatatgatgaaaccccgtctctactaaaaatacaaaaatttaaacactgcagttggccggttgccatggctcacacctgtaatcccagcactttgagaggccgaggtcaggagtttgtaaccagcgtggtcaaaatggtgaaaccccatctctactaaaaatacaaaaattagctggcatggtggcaggagcctgtaatcccagctacttgggaggctgaggcaggagaattgcttgaacccgggaggtggaggttgcagtgagccaagattgtgtcactgcactccagcctgggagacagaatgagactctgtctcaaaaaaaaaaaaaaaaaaatgcagtgatgctgtacagggcagccaggcccctcctaggccagctgctctccacggtctgcagccaagctaatggcctctctctgtgtctctctcgggacatcaccagcacccagatgcactggagggcaggcaggaagtagtgagctggtgggaggccaggtttgggccacacccagcagagaggagtgtcggtggttctggagtgggtgggatggtcagtctgaggcaagtcagccaggagactcaaggtcactgtatcattgggtctattccacagtgggtagcagagaatgacatttgagaaccatcatgtgtcataggaagcccatggggcttatctcaggggcctcagaaatgggcccatccaaatggtcatacaccgacctggagtcaaaatggcaggtttagccccaactgtgcctacgccaggtgtctgagtagcttctctttgcatctcagtgttcttctctgagaggtgaaggccgtagcccctggcctgctgccctctgggaatctgggaacatactccatagtgaatttgtaaattccatttatttatttatttataaattaaaaaaatttttttgagacaaggtctccctctgtcacccaggctggagtgcaatggcgcaatctcagctcactgcaacctccaccttccgggttcaagtgattctcctgcctcagcctcctgagtagctgggaatattggcatgtaccaccatgcccggctaatttttgtatttttagtagagacggggtttcaccatattggccagactggtcttgaactcctgacctcaaatgatccgcccgccttggcctcctaaagtgctgggattaggggcacgagccactgtgcccagcctggaagttccatttaaatggcaacttgcagtcagaatttaaggggcagttgacagggagacccacccggagctgtgtcctcaagccacattctcttgtcctgcccatcacagcgctgccaccaccgcctctggccctcagagggcggcaggcaacctctaagcttcctcctttcctctcttccccctttcctccctccctatgcccctgggtgcccgatccaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggtgagcatgtccctggctgcccgcagtgccttcccaccagggtacacagctggggagcatggcttgaaggaggccagcaccccactccccaaaatacatgaagagccgtgaacttcataaaggcaggatgaacttcacgtcttcaaccagcattcccttggcatctactctgggctgtgactgggtgccaggaacacagcggaagcatggaagggtcatgagtgtcattggtggaagcagtggtcaccagtgggagccaggcttaggactaggtctggtgaagcagggacatgtttggagaggggtctccattccaaggaccaggccttcctggaggtcctggaagcccaacattgtttgaaaacctccatctagagcaactgcccacttctccattttatgggtgggaagatggaagtggcccagagaagggaaggggctgaggttacacagtagtgggaggtctggagggtgaaaagtatcttggtctattgaggggaggaggctgggagacaccagtgctctagctgtttatgagattaagttctgagttgtcatcactgagttgtgaaccggggctgctgtgttcaatcattgagttggtgtgaaccggggctgctgtgttcagtcactgagttggtgtgaaccggggctgctgtgttcagtcactcagttggtgtgaactgggactgctgtgttcagtcgcgtaagttgtctattccacaagaactccaggccaaggggaggagctggggctgagaccctgggtctctttcccattctcctgcctctgccctgctggggttggtgctctgggggcaggctctggctgctgggcccaggcctctgaccacgcctctgttctgcctcccccacaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagaggagggcagagtgagaaagacatggagggaaataagggagaccaagagcacagcaggactgaaattttggacgggagagaggggctattccatcttgcttcctgggatgaatggcttggagccagcatgttcttgggaggtgaactgctgggctaggaatgccaaggcaggcagtgccagctggaagtgaaggcgggagcctggctgagatgggtcaatcgggtcctgtggccctgctcaggtgcagtgggctccaggtgtcacacacctccaccactcccctggttttgctgtgccagagatggggagaaagcacaggtggtagaagccatccgttcagagaaaggagagctttctgtgcttgagtggacccgagtgagatctgtgccctggagccctgtgtccttgatttggcttttcaaatatgcctccgctgaggcctcattcttgtctcgagagctgggttatgcacactcacccagccgtgctcaaaactaccaccagtgcaggtaagacaggtgggagaactagccaccaaggcgggactcagtgcacctgaggttgaacagggagacaacggcccctccctgtgttccctgctggccaaaggaatcttcactcccagcgcagaggaggagggcaacagcttcctggtgcctggcagtgacgtggcgagctcagtttctcagctggctcttgagtgagctttggtgacttcctgtggctggggcctgcctggtctgtgacacccccataccagctgagttcacaatactgaagaacagctggctcacgagctatgacttgaagttacatttctattcttgtggctgctcatctagttaaggcttttgccctggctggggttataggtgcttgagtccttgctaagcctggctcctgggtagcctccttcagttcctaatggcctctcacttggccctcactttggctcttacttgaggaggagacgtgactttgataatttcctcagatcctgtggacattttcagcagcacctgccaaggccctctgtgaaaggaggagagactggtacctccacacaggcacacatggatgcacagcccctggaccaggctgggggttcctgttgcacatgcctctcttgttcaggatgaagaccttgcaggggtccccttgctggaggcattgtacttccccagagtggggcccgatgccacccaggaggaagtgacttctttcgggaagcccttggccactttgctggccctgccacgcccatctgtcagcttcctttctccctaaacctagagttgctgacccttcaccaacacaggaaatttcagaatcagctgaatgctcagaaacctcgcctgtgccagctccaggacaaaggcccgctgactgtgccctggccaactccctgagacctccaagggcgaggaggagctgcccagtctccagtggatcagggcagtctgctggatgctggaaggatttttgactgcagaggcccggctgagaagccaaactgacctgagcccctctcgttaaaatgacattgctgacccaagcacctggcccacaccttggcagcaggagaaaaatggggagagggctggttttctcctttcttccacttccccacagcatggagattttctctgccttcccaatccatcttgctcctccgagaccccaactctgcctccacccaggctcagtgctgggcgtaaggcagcagggacctcactggcagagcagggggcctgggagcaacgtggaggccagagcaccctgatccaccaacatgccacctgcattctgacttcatggctggcagtgccagggtcgtgggagggcaaagggcaggctctaaggcatctaggcagtggctggctgctaacatggacaccccaagtcaatggcacagtgcaggttctgagggctccttggcttgtggggtcttctctgtctgtctctctccctctcttcttccttgctctcatccctttcttttccagttacccctgaagacccacctcggccctcttggggcccctggggactagagtgaccactgacccctcattctacagctttaagggaaatgctcacagggtatttttgtctacctcaaatatatagtttttagagcaaaggagaataatttatatagctaagatatatgagaaagtatttatattatttatatagttgctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaacttttacccctttcatctcacttgatttctccgttatctctgtgaggtaggtggggccacattactgtggccattttatagatgaggtccagagatggagagctgtgctcaaagtcacacctaagagacttgttcaatgaatatttactgaacatctccatagaccaggcactacgggctgacctgctctgagcccaggagccccaaagcctggataccactgtgagcccaagaactcagggaagcagttccttcccaggctgtgatcccagccttttggatctggatggcatgttggcacttcccccaagtggagtcccatgtctcaggggctttggctgcctgagaaggctggagagaccaggaacccatggaggccactccaaggggtccttctgcccacactgcccaagaagcttgggctacaccactgggcccctcccaacctacagatgaattttgattgctctcatttgtgttttgcttgtaaaaatgaattgttttccactggatttctggctgcttttgcaaaagtcagctgcgctggcagactgggcctgcatgtcctcctgcaggcagctagagtgagggagtctaatggacaggatgccccaagtgcccccgttgctcatggatgcccctgcctgcctctcatgagcacatagtcctgtcccctggtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgcatttactttgtctcaatttattgcaataactttgcacattggacatggtccccgtaatggataaggaaatggaggttgtgagatgagaagcctcctcattgcaactggcaggcagtggggccaggattggaacacagatctcctggcctccaaagtatgggatttttttcctctgtacactggtataggtcgggcagggatggatcgccccattttattgattctgggtaaactaaggcctagaggaaggaaataatccatcctggattacacaccaattcagacaggccagagcctgcatccttcctggagttgataagcatttctggagccctcatgctatggcaagcagcatggctcagggtggggcgggatgaagccaaccaggggccttcagggacctacagtctaataggagaaatgagaagcacagccatgcagtggtttgggtcatttacacacgaatcctgtgtcccttttctggccacagttccttcccaacatgctttgggaggcctcgcccaccaggatcctcctgggggtctgatgggagaggaggcctctttctgagccaagcacagcagagagtgcctgtctcctggctcaggcctgccctgccccagttcttcagccctgctggggtccacattgccttaactgggctccccagggcgggaggcagaggtgggcccacagtccagccctgcaggggcctacatttccaccagcatccccgtcctaacatgctccttctacccagtgttcctgggcctggagaccagctggctctgagtaatgacagacacgtccacatgcagcagcaggctccagtttatcaagggatttctcatctattttctctcttgaacctcacaaggtggacacccttcttctttttttacagataggggaattgagacacaaaatggttaagtgacttaccaaaggctatatcgctagcaagcggatccaggccttttgcctccaaaccccatattctctctaccatacaccatcctcacctcctcctgccctcatctgagccttactttgttcctgctcataatctagttcccaaacaggcccgcagacccctccacctccagctgctcaatgccaccatcttccaggaggaccggggcttgttgagacagtcactaggtgggtaccctacccgcaatatccctcctcctttaaaaacagccacatgtgctttctgtctttgcatttgcaatatctatcttgttgaatcacttgtgagacctttgcagacaccaagacacttacatactttatcatgtatctcctaaggacaagaacattctccaacagaaccacaaggccatcaccacatctaagagatgtaacattgacaaaaattatctactacatagtccatattcagacttccccaattgtccctcaaaatgtcctttataacattattttctggccaggcacaggttcacacccataatcccagcgattggagaggccgaggcaggaagatcgcttgagcccaggagttcgaggatatagtgagctgtgattgcaccactgccttccagcctgagcgacagagtgagaccctgtctctaaaaaattaaaattaaaaaatttttaaaacatgttttcctggcccaggatccactcaagaattaggcattgcacgttgttttcatgtctctccagctccctgtaatctagaacagtccccctctttctttgctttcataacagtgatagtttgaagagtccaggctgcatgtctcgtggaatacctctcaactgagatttgcctgatcgtttccttgtacttggattcaggttaaacattttggcaataagctgcttgggtgatgtgtatcctattctgtgcatgctgtaaggagccacaggatgttttgctcttgttgcccaggctggagtgcagtggtgcgatctcggctcacagcaacctccacctcctaggttcaagcgattctcctgcctcagcctctagagtagctgggattacaggctcacccatgatggggatggggacattctggagggagaggcactggcgggaagcatcctatgcctgcccccacccttcccatttctttccgattcttgacttcgctccatctctcacctggagttccttcttgcaaccgatcatgcagcaaacacggattggtggcctatggtgcacgaggcacgtgacagggtcctagatgccatggtaatgagactaggtccagccttcagggaggtcccagacaaggggagagacaagcaaagagatggctggcatgcacggtgtccagcactccaataggtggctctgtgcaggctccaccccacacaggcattcctgtgcaggccatttcctcatactcccctctgggcaaccccaggggtccatacaaccatgatccccatttttttttttgagacagagtctccctctgtctcccaggctggagtgcagtggcatgatctctgctcactgcaagctccgcctcccaggttcatgccattctcctgcctcagcctcccgagtagctgggactccaggtgcccgccaccacgcccggctaattttgtttttgtatttttagtagagacggggtttcaccacgttagccaggatggtcttgatctcctgacctcgtgatccgcccacctcagcctcccaaagtgctgggattacaggcgtgagctactgcgcccggcctttttttttttttcctttgtgagatggagtctcgcttttgtcacccaggctggagtgcaatggcgcaatcttggctcactacaacctccgcctcccgggttcaagtgagtctcctgcctcagcctatagagtagctgggattacaggcgcctaccccacgcccggccttatttttgtatttttagtagagacggggtttcaccatgttggccaggctggtcttgaactcctgacctcaggtgatccacccatcttggccttccaaagtgctgggattacaggcgtgagccactgtgcctggcctatgatccccattttatagatgaggaaactaaagctcagagaggttcccttgctacacaataagtagcagggctggaaatgaaacagcttcttcactgcctcttcccggggagtgctgggcacggcctggggacagagagacggggtatgagggagttgcaaggattcagggcgactggtggcatcttccagtcctgccacttggtcctccttgtcttctcctctctctctttctccccaccctgcataccgcaaagaggaggttaatgcctctcacgcgtcttatccccccactcccatccctcctcaagtccccaggggctgtggggcccatattcctccctggctctcttgggcccattagtgtgtttacgctggagccgtctcaggggagctgagcccctacccctgccccaccgtcctcccgccatggagagtgggcagtggagtggtggaggccgggcagaggcacgggagaacctgacccagcgtccgaattcctgcccccacgtctcaacaagtccagggtggccagaagcctggagagcaacggtagccccccgggacccccacctcttcccacacagccccaccagagcctgacaggctctaatctcagctgtcttcatgcagccagccctccgagcccggggtcacctgacgctgacacattttaattcagaagctgatttctgcttgttggcaacatgtcatttctgaaattgctttctctgcccagaggcgggagatgtcagagctgcgcaggtgttgcagtggtgccgcccccgccccacacccagccccctctccaagttcaggaaggattaaggggcgtgagggggcacacaggagatcctcaagctctgcttctcatgtttccccaagtgctgggggccagggatgggggactcctggaatggcctctgctttcctttccagcctgatgacagaggcccagggtttggtaaatgaagttgctgctctgccagtgctgacaacagccacagtagttgttttgcgcaggcttcatacaggtaccaagtgctctgcagagtgcctctcgtgtgcattgttgtatttgaatcttatgacaacgctccaagttggtgtcatccctcctttgcagctgagaaaaccggggctcagaggggttagaccacttgcctgaggtcacacagcaagtatgaggcggggccagctttcagacccagtgaaggcgacagctggactgggattgggaggtctgggaagggagaggccgtggagctggggaggactatggcctggcttctcctatatttgcttcctgacttggttcaaatatctccagtgaaatttgtgaactcccccaacttccccactcctgcaacccatcaaatagttatttgctccctcttttatatttccttagcttttttttttagacgaagtcttgttcttgttgcgcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatctttaaacaaaatttattgtcattttgtcttttgacattttacagatgggcaaagtgaggccaggtgagcaacagcatctgttttttttgtttgtttgtttgttttttgagactgagtctcactctgtcacccaggctggagtgcagtggtgcgatatcagctcactgcaaactccacctcctaggttcaagcaattctcctgcctcagcctcccgagtagctgggattacaggcgtgcaccactatacctggctaatttttgtgtttttagtagagacggggtttcaccatgttgcccaagctggtctcgaactcctgggctcaagcaatccacctgccttggc

SEQ ID NO: 1340 - DNA, 49200 bp, Homo sapiens
atgaagggatttttttccagtagctggacaagcctgtttccgagaataattgactctgagctacccatacctctgttacctctgttgaccaacagatgctccttactcccaccaaggagttcagaatgtttaaaacctaactctatctttatttttttactataattattttagaattagagacagggtctcgctgtgttgcccaggagggtcttgaactcctgggttcaaggacttctcccacctcagtatcccaaagttctaggcttataggcatgagccactgtgcctaaccataaaattattatttttatttgacacataataactgtacatattctggagtacactgtgatatttccatacatgtatacaatgtgtagtgatcaaatcagggtaattggcacatctatcaattcaaatatctattatttctttgtgctgaaaatattcaaaatctgctcttctatttgaaaatatacaataaattgtttgttattatagttacccaatggtgctgtagaacactagcacttattcctcccatctagctgtactgttgtatctgttaataacctctggctgtcccctccctacccctaccctttccagtctctagtaaccgctattctactctctacttccatgagatcaacttttttagctttcacctatcagtgagaacatgcagtacttctctttctgtgcttggcttatttcacttaatataatgtcctcctgtggctaaatagtattcatacatatatatgtatggatatgtgtgtgtgtgtgtgtgtgtgtgtgtgtgtatatgtgtatatatatatacactcacacatacacaatttttttttctttttctttctctctccttttctctttctttctgggatagggtctctcccctctgtcacccaggctggaatgcagaggtgcattcatagctcactatagccttgaactcctgggctcatgaaatcttctcacctcagcctcccaagtagctgggactataggcgcacaccaccatgcctggctaatttttatttttttgtagaggtggggtctcactttgttgcccaggctggtctcaaaccctccttgagcaattctcccacttctaaattcccagcctcctaaagtgctgggattacaggtataagccaccatgcctggtcatatataccacattttccttatccattcatctgttgatggacacttaggctgagtctttatcttggttattgtgaatggtgcttcaacatacatgggaacgcagatatctcatcaacatatgaatttctgaaataatattttaataatagtctagtaaaaattatgataacaatctactgaattattttttaaaaaaaacttagaatgtcagaagtctttgtggtctgcagagaaaatgaagactaaatgttatagctttaattataattttaaaaatctaaatgttcactaaatctgaaagattagatatattgggttatgttgcattgctgctcacagtaaaatcttgtaagtcagtataaaatccactagattagaaaaagaaaagtaggctaggaagtttggtttggcttccctatctgtaaaaccacaactgtctatgcttgacacaaactaaggtaaataaataatgtgtcttaggctaattgctaactgtgaataggagataacctggcatagaagagtagaaagagcattccaggcagaaagaatggactcagcagaggtactaactggtgaaacagcatgacatggtcatagtcacaccagacgtgagctcttgagagcgtcgtggattaacattaacatttttaaccaacaactctgataatctctccaggatccctggatttctgggtgccaataacaaaagctagacttactgttttttttttcctctgtacttctgcaatagattgaatgtttgcgtccacccaaaattcatgttgaaatcttaacccctaatgtggaggtaggtggtgaggcccttggaaggggattaggtcatgaaggtagggccttcatgaatgagatcagtgcccttataaaagggaccccatagagctctcttttcctgttttcaccacataagagataagagaagtcggctggcatggtaacccatgcctataatcccagcactttgggaggcagaggcaggtggatcacgaggtcaggagttcaagaccagcctggccaacatggtgaaactctgtctttactatgtctctactcatgtctctagctgagtacggtggcatgtgcctgtaatcccagctactcaggctgctgaggtgggaaaatcgcttgaaccaaggaggcggaggttgcagtgagccgagatcgggagaggtggcttgtgcttgtggtcgcagctactggagaggctgagacaggaggatcacctgggcaaaggaggtggagtctgcagtgagccaagatcatgctacctcactccagcctgggcaacagagcaacaccctttctcaaaaaaaaaaaaaaaaaaaagttgcaggctaagtattaggctgatggcaaagaagtggccaattcacttaatctaactcagtattatggttttttcttttattttcttttttttttttgagagagtcttattctgtcccccaggttggagtgcagtcacgcgatcttggctcactgcaacctccacctcccgggttcaagagagtctcctgcctcagcctcccaagtagttggattacaaatgtgtgccaccatacccggctaatttttgtattttttagcagagacagggtttcaccatgttggctaggctggtctcgaactcccgacctcaagtgatctgcctgcctcggtctcccaaagtcctgggattacaggcatgagacaccatgcccagccttgcttttttttttttttggtgggggggacagagtctcactccgtctcccaggctggagtgcagtggcacgatctcagctcattgcaacctctgcctcccgggttcaagcgaatctcctgtctcatcctccggagtagctgggattacagacgcccgccaccacgcccggctaatttttttgtgtatatataaatatatatttttttagcaaagacagagtttcaccatgttggccaggctggtcacgaatcttgacctcaaatgatccgcccacctcggcctcctagagtgctgggattacaggcgtaagccaccgtgcccagcctgtatgtactttttaatacagtaatatgtaaataactgtgtgtgtatgggaaagctgtttttcatttctccaaaaactgcaccaaggcaaagcaaagctctagttgatttcggtgtgttgtgcaggagttagcagtactgccctcactaggtacccattggacagtagtgcaaccccaagaaaaggatggtagtaagttaactttcatcacgcgttgatatttcatttgaaatggtgacttgaagctggttagatactgaaactgagactatagtatgcctaactcagctgctcaataactatttattgcttatagtcttacgactttttttttagaataattatctttgctagtactatcagatttgcatgacaaccctttctcttgtattctctgtaaactggaggttgtcccactattactgatactaaatttgatggtttggttcaaatggtgaccaccagatggctccactatacaggtgtattttctttacctttttttttttttttttttttttttttgagacagtgtcttgttgtgtcgcccaggctgtagtgcaatggcgcgatctcggctcagtgcaacctctgctcctgggttcaagtgattctcctgcctcagcctcccaaggagctgggactacaggcacatgccactgcacccgactattttttttttgtatttttatttttatttaatttttatttatttatattttttaattttttttttgagacggagtctcgctctgtcacccaggctggagtgcaatggcacaatctcagctcgctgcaagctctgcctcctgggttcatgccattctcctgcctcagcctcccgagtagctgggaccactggtgaccaccaccacgcctggctaattttttgtatttttagtagagatggggtttcaccatgttagccaggatggtctcaatctcctgacctcgtgatctgcccgcctcggcctcccaaagtgctgggattacaggcatgagccaccgtgcccagccgttttatttatttatttttgagacggagttttgctctcattgcccaggctggagtgcaatggtgcgatcttggctcaccacaacctccatctcctgggttcaagcaattctcctgcctcagcctcctgagtagctgggattacaggcatgtgccaccatgcccggctaattttgtatttttagtagagacggggtttctccacgttggtcaggctggtctcgaactcccaacctcaggtgatctgcctgccttggcctcccaaagtgctgggattacaggattacaggcatgagccactgcggctgaccttttttttttttttttttttttttgtatttttagtagagatggggtttcactatgttgccaggttggtcttgaactcctgacctcatgatctgctagcctcggcctcccaaagtgctgggattacaggcgtaagccaccacacccagcctgtaatttcttttacaattaggtaagtagcctgtagagtgatactttgatggcatttcccagcaatctttcatctaaaggttttgaagtccattgatagtccttgtctgagtcaattatttcattaaggtttgcatcatggttattgtctaattctatattttattttatacttattagctggcatcctatagtaaagaagagtttttcctcatcaactgggtataaaccacattctttattaaaaaaaaaaagaaaaaaaaagcagggtaggttgggagcagtggcccatgcctgtactcccagcgctttgggaggttgaggtgggagcatcacttgagcccaggagttcaagaccagcctgggcaacatagcaagaccccatctctaaaaaaacaaaaaagcaagcaaaaacacttagccaggtatggtggcaggcacctgtagtcccagcttctgacgaggcacgaggatcacttgagcccaggaggtcaagactgcagtgagccatgtttgtgccactgcactccagcctggatgacagagcaagactctgtcttaaaaacaaaaacaaatgaaacaaaaaacaaacagggtaaatgctatctccctttaataactaattttcagagtatcaaattggtgtaatagacactaccaatgatggaaaaatagtttccctcttctcattctctcttctctgtactagagagtagacttttatttattcagtatttgcaatcaattgtattcattttctttttgacgctaaaattgccctaaatttgccccctgggagatccttcaagctggctcccatgtctctaaaatttatttttgagagactgaaaatacaaatggtaaatggccagaatatacataaaaacagaattctgacccattacctacaacaactagcccagtaaaccaaccacttatttaccataagtgtactctcagcctgaaagccaaacctgctatcaaccagacttgtaggaagtcagactgctatctctggtagcaatccaggaagctaaataataacttctatgacaatcagctcaaaatggccaggacttgattaaaacttgacagcttccctactttttgtcctcacttctagcttatgcccatccagagaaagccaaatatgctcctttaaccaagaccataggatgccaacttgtagttagcttccagcttccccatgccaacagcttccaatcaggcatacctgtgaaacctttccttttgtccactgtaaagctttcccactcctctgcatgcctttgaacctctgctaaaacataagggatggtggctgactcccttgctacagcaagttctcaatcgactttgcttttctcatttggtttgcaataaaatgcattctttacagtgacacaatttgatgaattttgacaaacgtatacattcccactaaccatgacacagaacatttccatcacccccaaaagttctcccattttcctttccagtcaattccttctctcttcccctcctaaccaaccactgatctgctatctaccactatggattagtgttgtttgttctcctaactacagttggcatagcctcattggtctaagcacttcctctgcattcaggcacaacgaaatacctggctcatcttgtacctttcccgtcccagagctggaatcagccagttctccaaaggagctctggatctttttagtgggaaatggaatttagaaaccaagatctcagtgtcagatgtgctcactgttactgtagggtgcccatgcctatacatcctggttcagccaggactgttccagttttaatctgaaagtccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggctcatttgggcctctcgcctcagcctcccaagtagctaggactataggcacaggccaccacccctggctattttattattttgtattttgtagagacaagatctcactgtgttgcccaggctggtcttgaactcctaagccactttggcttcccaaagcactgggattacaggtgtgtgccactgcacccagccctccagtttaaactcaatactacagactttttttttctgaacttcttaaaattctttatattagtttccacccccacccccggatgaatgaacgtcttaaaaattgttttaaattttttaaaaaatggagacagggtcttgctatgttgcccaggctggtctcaaactcctggactctagtgatcctcccgctttggcctatcaaagtgctgggattacaggcatcagccacccggcccttttctgaacttctttgatcttgtgtttgtatctcattctctcacacactgcacatctttgtatatagtaacattaaaatacttatgttatcctaccatatacagtacagagttttaaaaccacagtaacaatgttaccattaatcataaatcagtgaagctgaaagctcctgtgcacttttttcatccttagaatacacagttgacccttgaacaacactggtttggactgccagggtccacctatatgtggatttttttcaccccaacacagatgaaaaatacagtggggcgagggacggtggctcacacctataatcccagcattttgggaggctaggtgggaggatcacttgagcccaggagttcaagaccagcctaggcaacacagctctctactgaaaatagaaaaaaattagctagatgtgctggcacatgcctgtggtcccagctactcgggaggctgagatgggaggattgcttgagcccaggaagtcaaggctgtagtgagccatgatcgtaccactgcactccagcctggacgacagagtcagaccctgttctcaaaaaagaaaaaaaaaaagaaaagcaagagaagggaaggaagggaggggggaagagagggagggagggaagaagggagggaagaagagagggagagaaagaaaaaaagaaaagaaaaagaaaggaaagggaaggaaggaagaaaacaaaacagaagtacagtgggatgcaaaacacacctacacaaagaaccaactttccctatgctcagctccgggactttagtatgcagatttctgtatatgctcgcagaaggtcctaaatccaatctcctgcatataaggaaagactacactatcacaacacagatacactactagagtactgtgttcaaaagctcagaggggccagtggtggtggttcattcctgtaatcccagcactttgggaggccaacctgcaggcggatcacctgaggtcaggagttccagaccagcctggccaacatggtgaaatcccatctctattaaaaatacaaaaatcagcaggggatggtggcgcatgcctgtaatcccagctattcaggaggctgagctgagagaatcgcttgaacccaggagacagaggttgcagtgagctgagattgcaccactgcactccagcctgggcaacacagtgagactgtctcaaaaaaaaaaaaaaaaacccaaagaataattattttttctgtgtatcttagttatattagttaacagttaagttcatttgtttcaatttgctttcaaccttaggatttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgtgagtgggccagaaggcgaacatggcggagcggggaggctggcgggaggcgggaggcgggaggcgggaggcagtggcgctggcctgcggcgcgttcggaccggctgtggggcggggcagggcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggtaggcgcgggccggctggcgggagcggacgcgggggacctccggggcctgagggctgatgcgcagccgcccccggcgggtaaggggcgggcagggcccgaaaggccacacgggcctggtgcggcaccggtctctcgtgagccgctctaccttcccgcctgcggggaacacttccgccgcttcgaggccattttatctctgtcctccgtccccaaggcccgggttgagaggggtgctctggcggccggagagaccggccactcacggaggccggaggatgccctccccgggctgagcggcggcgctcgttttttcctcgcctcggggtcgcccccttcacctcccttgggcctctcctgaggacctggcggcactaacgagttcagcaaggaaaaaaagaaacattcgttccctacatttcatgtcacgcagtaggatgttactacgttctcttgtagacttccatttttaaatgagtataagcattctgaggaaagaaactgaattattgcagatttttgtgaaatccaagtcttaccttggatccctgtgagacagttactagatttttttttcaccgtttttcataagtctgtgtacacgtaatggaaaagcccgagttcttgttttgataagaaagtcacttggttgtttgatcccaaaggattagcttaacattatcaaggactagcataactgtgattatgtaaaaaaaacaaaacaaaacaaaaaaactattatttagtctggtagggaaatacttctatgagtatgttacaattggaagttgtatttgtgcctattttatctagttttagttaattccattgcttcggaagataagtggacgtcatagatccatcgcaagttctcgttttttggattttaaaattttgaccattaagttttctacgatagataaacatgttgtggacatttaaaaccgtaatttaaaactatgagcgaaaaatcttttcaagatggatacattttaattcattcaagtagcatctgattagccaagtcggggaaagattgcagtccgcaaagctggcttgtgataaggttgaggttacattttaagggtttgggtaggtgtgtttcttacagtgcttttatatgttaaggtatcttaagcagacacatggtttaaaagttcagtatttttagtactttttcattggcagaatttggacaagctaccagaattgctaactcctaaaggataaaagtaataataatagtgtgtcccaggcactgcttatttttacatggctcttttatgtctagcttttccaattcaacgttgagtcatgtttgctgaaaatatttttgtgtattgtttgtcagaaataagctggtagagatgaaacacaatgtgtaaaaagccctgtgatgtggagatgagcattgtcacaatttgtacagtacattaaagcgttcaaggtctcttatggtcttgtatgtagtattgaatccccttgaatatattgtttagcagttttgatcattatgtatttgcttcttgctcctcaaaattgtacgttagttagtaggtccttcagcaaaagaagactgaagatagtattttggttttattcttgtttttaatttttttagttgtctccaacttttctgcctctaaatattttgcttcttgtagttactaagcttaacacagaaaaacttttcagtatctccacaatagtaaacttcattgtgtattgtgtataacaagatgttccatctgactaaaatatattgctgtaaatattttctgcctttgaagatgtagttaatagaatttaatcttttctaagtgcacattgaagttgccttttatgttcatattatgttcatattttatttgaaaaatctatagcatttttattgtgctgaaagcattaatatttgcagcactttgtgagacaggcaaaattatctttttgctgacttggaaactgcaagagttaaaagacttgcttggaatcacacatggcagatagaggataaggaaaagatggcctttcagttcctcatcagtaccttgctactacagtgtctgcagattggtgtcttacattcagctatgatttgttcgccaaggtaccgtgtcttcttactgaagttgttttggctggcgcttgcctccgttcagagggaactgagttacctaactttatgatgctaagagccaggaaggtactgggatctgggatgctaggcacctaaccagtctagactgaactccatactaagctgtttttctgtgttaaggcatcaagagtagatggtggtcctgattttctgagatatattatctctgaattatctacataaataactgaaacttttatgtaattttaaaactagtcaatcatgttaccacccttttgaggggcaccaaatttgagacccttacccccaatttattaattaatagctgttttaatcacctaatagctgatcacctaatgactaacagtcattttcatcctggaaaatgggaactaactttgactttgaaaagtgctgttattaaatgtgtgattcataagaactgaacatattttctttattattttccttcaggattcaactttaattgactccaaatgatgttatggtcattctgtttttctgatacgagaatagattgttctgagaacctagaatattcattgcctttatgaatctagaattgactttaaatttaggttattgtgtttgtcatttgcgctaaaaaaaaaattgccctggggaataccaaacttctcggtacattcgtgtggtgtgaaagtcaaaattgccaattaggttctattttgaccaaatagttgaatgttgtagacagttgtaaattttgaacctgttctaatttgccttttgccagatggcgcatttaactttgtggcatatcatcgactttcaaggaaagatttacttttcatcagattaaagttgaggaaggattttctttctaaatactgaggctctgaatttcccaagttggataccccagacagctagagtgatcttaaaagtgactctgagagttgacttaggaagtgtagacatttatccaaaatctgtatttactcctgacttacattacaaatacagagttttatttttaaagaaaatttcaataaaaagcaccatttaattaaaatctactcaccatcaaactttttaaaaagaacataagccaatgtcaggagttggagaccagcctggccaacatagtgaaacgctgtctctactagaaaaaaaaaagaaatacaaaaattagctgggcatggtggtgcgtgcctgtagttccagctccttgggaggctgaggcagtagaatcgcttgaacccgggaggcggaggttgcagtgagcccagatcatgcccgtgcactccagcctgggcaacagagagagactacgtctcaaaaaaaagaaaaaaagaaaagaaatttcaataattgcaggctgggcatggtggctcacaactgtagtcccagcacttttggaggcccaagcaggaggattcctgagcccaggagttcaagaccagcctgggcaacatagcaagacctcatctctactaccaagaaaaaaaaaacaaattagctgggcgtggtggttcatgcctgtgatcccagctacaaaggaggctgaggcaagaggatcagttgagcccaagagatggaggctgcagtgagctgtgatcgagtcactgcactccagcctgggcgacagagtgagactctgtctcaaaaaaagagaggaaaaaaagaaaatttaagtaacttctgtttagaatcctaaatattggagatgccaaagaattctgcagtaagtgttagaaacagtcgggaggacagtatgattattatcctcaacctgtggattatctcttcaggtttttcaagaaacactgagtctgtgtttttgatggggagaagaaactattaattaaatgcccattttgtgccagttaccatgctaaagattaatgtctgtcttcagaaatagcacagtatttgggccctggttgtggtaattctttttgagatggggaaactgaggtgcagagattttgctacttttgtatttgcaaagttgacaacctgtttcagaataccaaggttatcagaactttcttcatgtgtttctcagtccttttaatgccctttaaaaacagattatcatctcattttttgctaagcttactgttaattttattttagtggaataagaatatggatacctgtctttaagaagagagtaagcaagtaaacctagggaaagtatcaggttgtagaaccacataccgatgatccttgccaaaatcctggcataggaatttgaaccctggtgtatgaaaagtctgccctttgcatactcaggtttcgcatcccgtgaatgctgtatttttgatccgagtactgtattttttaatctgagtttgattgaaaaaaatccaaatataaatggacccatgcagctaaaacctgggttggtcaaggaccaactataataacttttataagctggaatttatattgaacagcatccatgatactttagtattacaactaaagttgtacatactgagtaggtaggatgccttagtaactagataaaaggtataccacctagccatagtgataaatatagctgttttcaaactgtcattcacagatctctaccacagtacctgttacgtgaagttcctggttggttctcaaaattttatgttcgtatatacatagatacagatactgatataccggttaaatatgtacagctcaaatagctaaaattgtctttaagattttttaaattaaaaatattattggccgggcgcagtagcttacacctgtaatcccaacactttgggaggccaaagcaggtggattacctgaggtgaggagttcgagaccagcctggtcaacatggtgaaactaaaaatacaaaaattagccgggcgtggtggcaggcacctgtaatctcagctactctggaggctgaggcaggagaatcgcttgaatccaggcggtggaggttgcagtgagccgagatcgcgccattgcactccagcctgggcaacagagaccgggcgcagggggagggggagtgtctctgtctgcttctttctctctctctctctctctctctgtatatatatatagtgtgtgtgtgtgtgtgtgtgtgtgtgtgtgtaaaattgatatttagctccagacaaatgggaaattacaaggaaatgccagatttgatatctgggttctaagactttgcagcctaatgcatgtgtcatgctaaaatagaagtagttagacatgtggagttaaatatggtgatggtttctgagatgattaaaatgactgccaccaggttaaggtagttacaaagcagctttctgtaatggcagcagagataataaactgggcaacaagggaggaaccaatttaaagaaaaaaagaataatatacattttatatcatagtaatatggtttatgtcttcataggacagagtgacttgctcagtgaaacagactgtatacaattagctcagaaacaaatactgaggtttttatctgtttgctgtatcccttgagaaagattaaagagggaaggcagggtgcagtggctcacgcctgtaatgccagcactttgggaggccaaggcagttggattgcttgcgcccaggagttcgagaccagcctgggcagcatggcgaaaccctgtctctaccaaaaaaaattacaaaaaattaactgggtgtggtggcacatgcctgtagtcccaggtactcgggaggctgaggtgggaggatcacttgagcctgggaggtcaagattgcagtgagccatcatcgcaccactgcactgtggtctaggtgacagagcgagactgtctcaaaaaaaaaaaaaagcccagcacgctggctcatgcctgtagtcccagcacttgggaggctgaggtgggcagatcacctgaggtcgggatttccagaccaccctgaccaacatggagaaaccccgtctctactaaaaatacaaggaagttagccgggcgtggtggcgcatgcctgtaatcccagctacttgggaggctgaggcaggagaattgcttgaacccaggaggcggaggttgcggtgagccgagatcgcgccgttgcactccaccccgggcaacaagagcgaaactccatctccaaaaaaaaagattaaacagagaaagaagcaagccagtaatctaagatcaatttatgatttttcctctaaattctgctttcttcaacacaatttacttaatctgaaaaccagggtttaataacagtatgattagaatgtttcatttataaagtggagttgagattgtacgtagtataaaacatgctgttggaagattatctccttttgaggaatctcaaaatcaagtgggagaaatcaagtagtcttggtgtgtgtgtgttttgtttgtttgttttaatgagagacagggtcttaccacattgcccgggctcggttcaaactcctaggctcaagcagctctcctgcctcagcctcccaaagtgctgggattacaagtgtgagccaccacaccagcctcaagtagctttcgagatgatgccacagcactccagcctggcaacagagtgagactccatctcaaaaaaaaaaaaaaaaattcagtttaacataccaagcttttggtcaaatttctagtagtttagaatttataataagtatgggtaattaaaataaaccataaacactttaaagtaagggaagattcatgagtatactattagaaataataactagggctgggcgtgatccttccacaggtagttctagctacttgggaggctgagatgagagtatgacttgagcccaagagttcaagactagcctgggcactatggtgggtccccatctcttaagaaagaaagaataggaaaaactaaattagtataagaactaattacttaatttgtataagttatgaatatgccaaatgcaatttagatgctttttcaaaagagcactggtactcagaaccctgattcaattttttaatcctcatagaatttttatataaagattttatgtttgtcaggttagctcttcatgtcgtatacttttttttccaaccttgtattttaatgtggtgtttatgtttattacacattttttctttgtcttttttttgtgtgtggatttgtagtttaatgaataatacctgctattagcattcgttctaaaaaacagcataataaagtgttccctacttgaattcattaacctatctttgaaacagggttaagtgaattttgtataataaagaagctaattttgagatacaaaatatttggcataaaattaaatactgtaggaatatttttattaaggtgtgacatacatgtgtatgtgagtttttgttgtttgtttgtttgagatggagtctctgttgcccaggctggaatgcagtggcgcgccatctcggctcactgcaacctccgcctcccaggttcaggcgattcctgcctcagtctccctagtagctgggattacaggcgtgtgccactacgccgggctaatttttttaattttttggtagagaccgagtttcaccatgttggccagacttgtcttgaacttctgacctcaagtgatccacccaccagcctcccaaaatgctgagattacagtcgtgagccatcacgcccaaccagtgtaacatatattttaaaatatgtaataggatgggcgtggtggttcattcctgtaatcccagcactttgggaggccaaggcggacgggttgcaatgtcaggagttcgagaccagcctgaccaacacggtgaaaccccgtctctactaaaaatacaaaaatgagccaggtgtggtggcacgcacctgtagtcccagctatttagggggctgaggcaggagaattgcttgaaccctggaggcggaggttgcagtgacctgagatcgcgccactgcactccatcctgggcgacagagtgagactgtgtctcaaaaaaaataaaaataaaatatataatatatctaaaaaactattgggcagtagtaaattatggctgtggtaggtactaccttactttaacaacataatgctataaaaggaaagacttaaactggtattacccttttatagtcccttagcaacatgcgtaggatactacttgaggtcattatatttctcttcaccctttatggcgacatcaaatgatttgaatggctgatcagcttttttacgagggaatttgtaaaaactacccaataactctaatgatggaagatgttaacaaaggaagatctgggtacagagtatataggaactctgtaatatctttgccacttttttgtaaatctaaaactattttaaaattgtttatttaaattctaattattcaacagtaatttagttcactaataaattgatttgaaagagtcagtattttttattcctactttcactggaagaaaataaattgaacttgttttccgcaacttttttttttaggattcaagatgaccaacgaagaacctcttcccaagaaggtatgggttttggttttgggtttttttgttttgttttgggttttttgggggcttttttaagcactttaaaaaaaaatagacttgaagggattatcgttgtttgcttatttttcatttctttgcctttataacaataatagcattggagttgtacagtgtgccagatattgtatcttatatccagtatattttttagaatattttcagattttggaaaactttagttataataatattcccatggtctactcttaatgttcattatgtgaatatttccaggtctactcttaatgttcattatgtaaatatttccaggtacatatatacaaataatgtcaaaaatggacattatgagtatattattattcttttcctagtgtaaatccctttgattgtaattaaaaactactttattaaaaaaatggttatagctaattttcaaattctacctttttctctgaagttttgttgtctagtctcaaatctccccctgttgtgcattcctaccttgagtttaattactcttacatacacacacatacacacacacagtggctgttataaaagaggtaacatcgtctctaggaggaatttgtgattcaattgggaaagcttactaaacttaatatttaagtgaataatttagatattacagaagtttcctattgtggagtcagattactcattaaatgaataaaggattgtattatgctttcataatctgagaattactgtgtgctccctctggtaccctttgattttcctcccttggaacagggtcttgctctcttgcccaggttggagtgcagtggtgcaatcttggcttactgcagtctccgcctcctgggctcaagcgatcatcccacctcggcctcctgagtatctgggggctacaagtacgtgccaccacgcccagctaatttttgtatttcttgtagagatggggttttaccatgttgcccaggctggtctcgaactcccgggctcaagagatagccacctgcctctgccttccaaagtgctgggataataggcatgagctgcctctggcagcctttcaatatgttacattataatagttccctcgttccattttatggtaatactattttactggttagtattataatttgaaacatttttaaggaaaaaaatttaagtgtcttgtaagggaatactaataaagcctttattttatttttattttttattttctgagacagagtctcactctgttgcccatgctggagtgcagtggtacaatcttggctcattgtggcctcataccccagcttatgcgatcctcccacctttgccccccaaagtagctcagactacaggtgtgccactacgcctggctaatttttgtattttttggtagagatggggttttgccatgttacccaggctgatcttgaactcccgagttcaagatatactcccgcctcagtctcccaaagtgcaggaggcatgagccacaatgcccagccaaagccttaattttatactgaggtaggagaggtatctcacctttacagcctttatttggtgtagtgaatatactgtttctcaatttttgaagcatgttagcttatgcccttctttcagctttttgttttgaaataattatagattcataggaagttgcaaataaatgtacagagaggttctgtgcaactttcactgagcctgcttcattgttaacaccttgcgtgactagcagacatctctaataactgtgaaaatcagggaattgacattggtacaatccacagagcttattcacatttcacgttatactagcactgttattgggggaagtggggaagagctatatgcactattatcatgtctagctttgtgtaaccatcattaatcaagatacatatctgaactatcaccataaagcttcatcgagttattcttttatagccacatctaccccgtccctctccatgcctgacccctggcaaccactaatttatctccatttgtataattgttacttcagagtgttatataaatgtaatcatgtagtatgcatctttttgagactattttttttccttccacttagcacagtttccttaaggcttatacaaattgtttcatgtatcagtagtcctgtttctttttattgcttaaagtgttccatggtgtggctgtatgatagttcaatcatttgcctgttaaaggacatttggatagttttcagttttttagcttttacaagtaaagctgcttgcatgttttcatttctttgagatacatgtttaagagtgcaactgctgagttatatggcacattcatttttagttgtattaataaaaggaactgccatacttcttcagataccatttttatattctcacctgcagtgtaggaaacttcagtttctctgaatcctcaccagcgtttggtgttgccactaatttttattttagccattctaatcagtgtgtggtgatacctggggttttaatgtgcattttcctaatgatgatgcccattgttaagataccaaatagtttaccttaaaaaaaaaaaacttttgtaataaaatactttttcaaaaaatcataatatgtactgagccgtttaaatctcacacttgggagatgtttcataggtctcattatagaactttgtgtcttcaggaagaacactaaattcatattgtaattctctttataggttcgattgagtgaaacagacttcaaagttatggcaagagatgagttaattctaaggtaaaatgttctctgttcaaaaacaaagtctttctatagaacattatattgtgactctacactgtaattgtctttgtgccagatattgtttttaatgttgttctatcctcaaataatttaatgtactttttgagcatactatgacctatttcttatattaacaccgaggaaaacgtaacactttaaagaactactaggaagctataagtttaacaaatatatggcttgttttgtgtagtttttcctttcgtgtttaacatttgaaaaagaaatgtaatcctaaaagatgcacttatatttatggaagaaatacataatttactaatgaagtgaggttactttttcttattagtgtgaccttcaccagctcatataacttcatactcttcattttctcatctgtaagttgaagaggttgggttaagttattgttaaaggtgacttccagttctgaatttctgcggttatcttgtaaatgtcttacaaaagcagattgtcaagtacaacgtataatctttttagattgtgtaagaaatcaggaagtaggatgttctgtgttttgtaatttaaatatattctttctgtattttattgctatggttagtaagtttcttgataacttagataaaaataaaataagtattttaacaggctgaaagcggaggagagaaaagatgttttgtgagataggctaacacagattttgttgtttcctagagtgtgacaatttcctactttcacctttggacagctactgtattatgaacacactttttacctttttttttttttttttttttttttttttttttgccataatctcatacataggacagtttccattgcatacctttgtctttctgcacataaaatttaaatttttgttattctaaaacacttctgtcttatgctgaagtatatacttaagatacactactactcaatgctgggtttttttttgtttgttttaatgtgcatataaattataatagaggtgaggtgctgctcaggctggtcttgaatgcctggcctgaagtgattctctcaccttggcctcccaaagtgctgggattacaggcatgggccaccatgcctggccatgattttttttttccctgtctctggcattgtatactttttttaatgccttcttacataattgctctggttagtctgtgcagtcatttttttgatttaactgtaggaggggaaaaatcagtaatcttaataaagaatcatagaaatgttttattttaagatacctttaaggtttctaaatcatatgcagtgtatttccttgaggtcagtttaacatctttccttagggaattcatgtaagacttttaggcgagttttttctctttgattcccttggagattttaaaccagctgctacttatttaactagtctgtgccttctatccttgtgatatacatgttcttgcttcagtttttatatttttctgtacttctaaaataaatcgttcttttatagcctccactgaagatctttctctatacatccccaaatatttggtaaactacgtgtcttaggttgtaagtgccgtaaaaataaagcatggccttggctgaacatcagtgtttacatagaaagtggattagtttggtattaggaaggttttttttttttcttttttctttcttttttttttttttaagacagagtctcgctctgtcaccaggctggaatgcagttgcgcgatctcggctcactgcaaccgccgcctcccggtcaagcggttctcctgcctcagcctcccaagtagctgggactacgggcatgcgccaccatgccctgctaatttttttgtattttcagtagagacgggatttcactgtgttggccaggatggtcttgatttcttgacctcatgatctgcccgcctcggcctcccaaagtgctgggattacaggcacgagcctttttgttcattatgttgtaatattaataactcatgacaagcctgtttttaagattataaaatggttttctaaagccaaattttaattaattgtacctgaagagcagcttgaaaacatggctcttaagtatgcaggatagcagacattcagggcagggtgctttccattaggaactgcctaataagactaggaaaaatctttattgctaagaggacctagcagtgtatatattcagggtagagaagtataatgaagaacaacggtccccttgtattctgatagcatatggcatttatgcaggtttctgacagttagatgtgattgttaaattacagtcttgaaaaatgttatattctccccctgtgtttacaggcagaaattgatactaccttgagaagagtcacatggtattttcccaaaagagccaagataaagaaccttcaattctacataatgaggcacatttctaatatgccttttgttctaagtggacaacatatgaaagcagcagtgggatttttttttcagcttctataatccaggattatcctgaacatcagtgatatcaaagtgaatctggggtttgatctcacccagggcatgcttggcatgttctcagcagaaaaaaccttctctatatatctctttttacctgtttcctgtaaaatgggaaggaataatgagggactattttatgatcagttaaactagatttaggctgggtgtggtgactcaggcctgtaatttcagcagtttgggaggccagggtgtgaggatcatttgagctcgggagttcaagaccagcctgggcaacgtagtgagaccccatctctacaaaaaaatgagccatgtgcctttggtcccagctatacaggaagctgaggcagggacatcgcttgagcccagaccctgtttgcgccacgctgcactccagcctgggggacagagcgagactctgtctaaaaaaaactagatttaaaatgaaaaatccagaagaatgctcagtattactaaaatctgtgagtttatagatatcttctagtttatttaataaactattttatcgtaacaactaatgtatggatttttttttattagatggaaacaatatgaagcatatgtacaagctttggagggcaagtacacagatcttaactgtaagtttgagttttagcttcctaaagactgaataatctccttttgattgttaaaatcaaaaggatagttgtttttattaaagcaaatgtaatttttctcgtgttttattataagaactgtacataggcactgtgttgggtgcaagaaaatataaagatgaatgagacacagtctcagtcattggagaagacagaggtgtaatagtcatgtaatggcatgacttagcaaaattatatgcaaggttctgaatatagatgcagtaactcagaactacttgaaacttttcttacttgtccctaaccccttctgcataggaatttgacttgaagcatgagttactagtctagaagagaaataaacagaagcaaccagtaacagatttatgacagcttaaatcaatatatataacttaataatatatacagatttttttaaatctgctgaaaataacgtttatcattttaagccattttagtctcactttttactgtttgaatcacatactatttgttgagtataaaaaccaatatatattgttttgtaacttcagaagggttaataccctgaaattctaattttgcgtgactgtgttacccatagaagtcatgaacattgtgaaagtttaaggctaggcacagtggctcacacctataatcccagcactttgggaggccaaggtgggaagatcacttgagcccaggagtttgagaccagcataggcaacatagggagaccttgtctctacaaaaaaaaaaagagtcaggaggatcactagagcccgggaggtcaaggctgctgcagtgagccctgattgtgccactggactcctgcctgggtaacagaataagatcctgcctcaagtttaaaatacaaattgtccagcagttattactattttatttatttatttgtttgtttgagacagggtctcgcactgttgcccaggctggagtgcagtggcacaatctgggcttagtgcaacctctgcctcccaggttcaagtcattgacctgcctcagcctcccaagtagctgggattacagacatgcatcaccacgactggctaattttgtatttttagtagagacggtgtttcaccgtgttggttaggctggtctgaaactcctgacctcaggtgatctacctgcctcagcctcccaaagtgctgggattacaggcgtgagcctctgtgcccagacagcatttttatattaaataggttaaaacatactaatcaggattttgtgaatactgtataacacagatgttttctgtcttctgttgggagtagatgaaactataaaaacataatttagttagtagtcatggagcactatgacaccattgtctcctaaaggagctctcgtgaccaggaagaaattcgcctgttataaaagtagttaggatggaaactaaagacttgattaattttttgaccctagttcttattgttcttgacagaggtatttagaacttgatcttaaaattgtatttataatttttttttgaatcatcagctaatgatgtaactggcctaagagagtctgaagaaaaactaaagcaacaacagcaggagtctgcacgcagggaaaacatccttgtaatgcgactagcaaccaaggaacaagagatgcaagagtgtactgtaagtatttcaagttatataaatgtctttagttgaggaattggtttttagtccacattattacatgttaattttaaacatttaatgctaaatataagagcttatcttttataggtacgtatgctttgagctttaagaatactagatgaaaaattttgataatgtctcatttagactgttttttgtggccaagaaggcaaagttttaagttttttttgaaattttcatgccttataagtattagttcatcaattccagacatttttcagatatcttggtgtctgaggatgtaatcaataaaagaacatttgctctttattgctttactttcactgattaggaaagccatctgaggactttatctctgttctcttgtcccctctgtgtatagaactgtttttcctagtgtcagcaacctctttagtgtctcctttttaattgttagaactttgatgtgtactgtgtagtatttactatgtctacgtagatctgaaatctagtgacataattgatcatccagctctggtagtttaggctcaatcttacggtgtaattatacaaaataattagaggcagctgtatccttgtttctgattttaaaatctgaatgtttcttcaattctttgtgtactctcccttcatttggtacatatagaagtcttcttatgtgttattaaagtcttctaagatagtattctggtcattggagacaccaaaaatctatgggcacagtcctgttctgtttcttttgccaatagaatgttccttaaggttcagtcacagtccttttacttcccttacagagattgtttaaatttccacaaaagcacgtatttactcttctttcacttgttactaaatgacttcttcacattttactttgctaaaggctggcttttatcattttctttacttttttttcccactaacccccccgcccttttcttgagacagggcctctctctcatccaggctggagtgcagtggtgtaatcacacctcacttcagcttcccgagtaactgatttcaggtgtgcgccaccaagcgcagctaatttcttaatttttgtagagatgaggtcttccctatgttgcccaggctggtcttgaactgctgtactttggcaatccttactccttggcctcccaaaactgttgggattataggtgtgagccatcgcacctggcccattatcattttctctaccttcttaacacattttgtccttttgtttctatcagttttgttgtaattcttaccaccactgatacttctttctccatagttactaatgaatgttttaacaaatttccctttacacgagaaatggatcttacctttagactgctagcacttgggagatagagtgtgaatagaaggtgttgatggtaatatctcataggatcagaatgtcttgaattccatttctcttccggattcctactcttgacatcatagttgatgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcaggtgagagtgaaaaaagatgaggtcagcctggaatcttgggtattctagaagagaggggactactgaagaattcttcagcaagagatgtatgtgatggatcagatttagatttacattttaggtagatcactctgacttgagtatgaaagatagatttgagaggaacaggactttaagcaggaaaaccaattgtgaggctgttaaaatagttcagatgaaatacatgaagccactggtggtagcagacaggacagaataggtgttttggaggcacaatcaataggacttgtttagtttggatgctgttgtggaaggaatgaaaaaaatctagggaggaatcacagcttcaggtttgtcttgtttgactgagtaacgatgctactaggatagatcctacaaagatcaaattttaaaagaagagtagagtgtggtgttaggaaaacaggaaatccagcattccctcctccttccccaaaatacaaagtgattaaaacaaaggcatacataaagttctgtacaatacgaatttaaaattgttcgttagatttggcagttaagaggttgttggccaaggaagccaaaagattggatacccctgctctagaggaactgtcaagtgggaagtgagagaaactaaatttaaagagtagaaagaatgggagtgatgtactataggagtttggagggaataggttaagcgaatggttgaaaggattggccctgagaaggagggtttcttaccctcttgagtgaaaaatagtggaaaggtttgtattaggtacctgtcctttaaaacagagctgctgcatttacccttggtgtttcaaattaagctaagcttagaaaaaataaaatatacatccttaggaatctatttgtgtagatcttttgtttgtccagcatactaactcatccatttgatcttttaataataatgctttatttctttgtctacatgcagtctttgccaagtacatcagtagtcaatttagttagttttgagcgtaaggcataaattagccacgtagttactatattcttaactatatactgtattcttaactatattttattttgttggtaagtaaaatctgtcatttttgttcacctcagtggtatttctgtttttcatttagtcttttgccaatcaactcaaaatagatttaggaataaaactaactttgaaaacactttactcagtgttctcttccctagaacatggaatttattctagtctgattcacctctcttttcatgaatgaaagtgttgactattgggtctttgtaaagctaaatagtaactgagtctcagtcagtgctgtagactgttttaatcagtcctgtcagtacatggagtgcactgtaagtcatggtttattctcgctctgttatcttagcagctggcttcacattgactatgcagttgtactagatttttgctcagtgaaacaaatatattcccaaaccacttagtatatttgttccttttactaaatttatattagaaaattttaactgtaatcctatttaagccttagtatggagttagatcttgggccagatctactttgagtatgaagaaaatgatgaatttaatgctaataactatatttcatattttagaaatgtatttttagtgtgctagtaaatagcacaactgaagtcgaaattgaaggtttcatatgtaagtagaagggttctggtatggtggaaaaagctctagactgggaatcagaaggccggagaactagaattgtagtcccgctatggcactgaactaaacagttgggttatttaatctcaaaataagcagtttggattaggtgagttactttccagctttacaattctatgattcggatctattcagaaggggaaaaatatgaattatactttattttggcttaaggtcctatagagttttgcttttataaagctgtaacagcaactcttgtagctataagtactgtatattttttcctttagaaattcaaatgtgtattttaagttataatcttgcacctgatgtatttttaggggactttacatagaataatttccacaggtaaaaaattaagcaaaccaaagacttcattaactcttaggtaattaatattttaaactttgcttttttccactgggttgtcagcatttttagtaaatataatgttgattttcgtttgttttttggtaatgtttggattgtaaagtaaaatgtatgtagccactttaagtcccagatttggagatgtaatcaaatggcctcaattcctaagtgagtaaccttaaatagttatttttttaattgacaaataagttttttacatattcaaggactactacatagtgatgtttcaatacatataatgtatagtgatcagatcggggtaattagcatattcatcaaatagtttttagtctgtactttttctagaaagttttaagatttttctagagaatttcaggatcaaagaggggaggagcttaatgaaagagttggtaaatcaagtgaatggagggagttttccccaccttcttatgtatgtttcctttgatttggtcgtaattgtttcttttgctttgcacagactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaatagttggtttttttttttttttaagttcaaagaatattatgatgattttgttgtactctttaacattttaatttggggcggggagggcctgttgagagcagattcattttggaaatactgttgctgtgctcttcaaagtgaaggaaaaggcgctgtgcctcatttttaaaagacctacataaaagacaaggagacttgacacttgttacttttatgacactttgtcccagggtattgcagtagaaagtaatgtgggacagcttcacagggtgtctgccagaagataatgtgttggaactgtgggctggcctaagtaagacattttgtgaattgaaaaaaggtatagtgatcatttctagcaaattcatttaatcatttagataaatgaggcattattttcttcatgcttccatccaatcctggaggtgaattttttccgtcagatcattctataagtcaccaattcaaattttcgcttggtgataatggagtctaagatgagtggaagataaatgttccagcttgtcccaacgtttaagtgcagttttaacaagggtgacttaagttctctcttaatcattcaaatcaattgtaagtatcatatgtttgtgctttagggaactgattgtggggcagagggtgggttgaagaagtggtttgtgtgacttttcagcaagaaatctgcttctaaaattctcactatttgtgagggttggagggtaagtaaccagatctgtttgaaattagcttatgtgcttgcattaaggcttttgtaaatattttatgccatttaagttcacagtagaaatggcctaagtatctttttagtagattttagtagaagagtaatccataaaatgtattattaacatgtactcaaattgagcaggcatctttctttgacacttagataacagtcatgagttctatggtttttttcttgtcattgttaaaattttctcttttaataagataatacatgcttatgtataaaattgaaatactgtagagaaagggggagatgaaaagtgagtgtcactcccggatgtgaccttgacatcctcattctcttctccaagagcagtaactgctattactttttcttgggtatcatcaagataatttctatgcatatacagttattttatgtatattgttttaaacaaatgtgatcataccataaacacagatgagttgcaccttgtttttttttacttggtctctttggcatttttccattttttaatgtatctagacaactacatttttaatgcttacatagtatatttccgttatattaaggaatcataatttatttgaatcacttataaatggatttttttctataaaattggctgtaagccagagtatatcaggtactataaatacatcactaatttgaaacaaataatggctcaggcaatcccgtctggaatatttccagtggtggaatgggttttgctttgggttgcgtgcacgcgcacgcacgtgtgtgtcttcgctttactgtttttctgttctaattttgaggaagaaagattcccagaaataacctgtccagttcagttaaaatatttcattcatgtgagaatgcacacattttagagtgtttagaggtatatctttcaaagtgctttctattatgtttgtgggttaatcgattttaggaatgggttgatttttttgtttgtaattttaaaaaattatttcaaaaacaactacttgtaattaaattattttttcaaaactgtgattttgttaaaatttattttactaatcactagttttaaacgtgatatgactatcttagcttagacatttatttattaaaaggtatgactttttaaacgaaaccttttttgcattagaatttgtgacatttttatatggggttaagtcaggtcacagattaatgtatcttacagttgtctttttctactctttaaaattcatatagtaagaaggttagttgtaaacaccaatgaaatatatatactttgcaagaagacagttttgagagcataggcagtaaagtggaaggaattccattgtttttgacaatcttgcatatctctcattttcccattgtttaatttctaagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaaaatgctgtaggtgaaagaaccatgcaacacttcaaagattgataaaatatttacaaaatgctctcatttttaaacttataaggcatactgaagtagtgtatcaggcaagtgaaagcctcactagaagaaggaaagactagaatttaaaaaatgttttaacccataaggtcatcctggacttaccccaaggacaagaatgtcacactgtctttatccaagtctcaaaggtaaatatcacaattatttacttagatccctttaaaagtgatcatttctttttttttcttttttcataaataattacaagaacaagcaaataatttctccttttattgctgaggctaaagaaaagcagtaaaattttattgggaaacatttgagcttttcattacatatttgcaattgctatgtatgtgcacataggttcagtagtatgttgcactagcatttggaaactataatctgtggaaagtgtgacactcctagattggcagatatttgcgtgtttgaattgtgatacgtgaccactggtcttatttttgtgtcaaaaggatgatcttttccaataaagtcttaagtctttaaaaaaaaaaccttaactgctgaatgtgcctcaattaatataatagataatattcttgagagttatggaagatggatgtaccagaaaacttccctctctcctcctcttttttgagacagggtccctgtttccgaagctggaatgcagtggcatggtcacagcgtcaaccacttgggcttaagcagtcctctcacctcagcctttccagaggctggcactacaagcatgtgtgcctggctactttttaaaaaattttttgtagagttggagtctatgttgcccatgctggaggacttcctgttaaggaaaatccttattaaatgtttttctagcaagaataaatactctcattcatttttatttgtaggtactgattttcataaatatttgtgattgatgttgcatgtaccttttcaagaacttttctgataaagcgctagattccttagtgtaataatactggtatagccaaggtgtgtgttaattaactggctctgtttccatttcaaatgataatttgagatgaaaatagatggatttcagaattgattattgatgtaatagaaacaaggtgtagctgtttgggcactttttgtttagggtttatttttactgctgtgttggcaaaatactgaaatgcagaagatggatgtgtcccagaaaagaagatggtaattatggggaagcatctgctgtgatatagttatgtttgtatgtgttacatctatcactgtaataattgtaagcaaagacagagagttttgtcttcattttgtgatggatggctctttcctttgcagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatggtaaggggtttgtttctttttggaacgttgtctcaactttgcattggctttttaaaactgccagtcatgaatattataggttagattctgtacattgttaacctctgccctatgattgtatattattgtgagtgaagcatttttagttgagtccgcaaacaaagccatataattttagtttgtttatccccaccctcctaattctttattgttcaaaatttcttacatttttgtttttagttgggggtaggatttggtaaaagataaaagggtgttgtattacttaacaagatggacaaatttgtattcattgtttgaaagggagaataagcatttctcgttaagtgtaaatcttagaaacatgggcagttttcagcgatctgaaagtaataaagttgattgtatctgtgaaggttttattagtgaataagagatttaatctttaaatttgctgagataaaacttgtcagcctccatcctttttagtgcaagtgtagctgtatctctgtttctcttctttgtaaggtgcattattaataaggaaaatatccaaattctttgaaattttaaattgaaaattagtgtctctggttaattgcaaagatgatcagtagccaagtaatttcttctgaactacctaccttttcaaaatcttcaggaattatttcctgtgacttttgtccttttatatgtaacagtccttggttgagaacatgggcctctttggagtgttatagaggaccacactatccttaaggatcagacttgctatggaactaaggcactggatcaggaataaggggattggccatagtgggcccataggtaaacgtgagtcaaactttggggctgtaatcaggcatatggcaagatggatcaaaacaattttaacttggttgcttaatacagttgccctcggtatccatggtggattggtgtcaggacctcccacagtaagcccctcatataaaatgatgtcatatttacatataaacctatgtacatcttcccctttgagccatctctagattaacagtacctaatacaatataaatgctaggaaaatagttattttactgtattgtttgggggataatgacaagaaaaaaaatctgtacatgttcagtatagacccagttttttcttccttgaatattttccttctacagttgcttgaattcattgttgcatgtggagggccaactgtatattattttaagtatctgacttcccccaaaacaaactcagtcatattttaagattccaagcaaaatttttaaatgtagtgtgattttagaattgtatttgtttacttgagcgtttattgactcccttgctttgtggcaggcactaaagaaacatttttcaatgttataaacgatattaaagttggtctgactctcctttgcacagaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttaattgagacagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttattttaattttagtagagacaaggcctcgctatgttgcacaggctggcctcaaactcctggccccaagggatccttctgccttggcttcccaacgtgttgggattgcaggagtgagctacagctcctggccctttttgagttttaattgaaaagcagcgttggttttttgtgacctgatttcaagtagagtatctttgtagttagtgatgtttgttttaaaacgctggccagcactactgatttttactaacaacatatctggtaatattatatgagtaaggggtgttagaatgtaggtaggagaaaatgtttttaaggtggaagaatgtcaaaatttgctccattttctcagaggtaattaagtataaaagtatgatattgaatggccttcaaatgtgtagctttcatatatggttgaaatgaaattccatttctgttaaaagcaaagtattgttttagacataacttgtaatacaatcaaggaaccttgggagtggagttataatactcgaaaactgaggtacaacttatttgaaagtaattgctgcttttgcttgtttagctgatacaggtatatccggtcttcagcagtatgttaaatactgcactgtctcttgattaaccttttcttttttttctttttctcttttttttttttgccgagagtctcgctctgccacccaggctggagtgcagtggcaccatcgtggctcactgcaacctccacctcccggattcaagtaattctcctgcctcagactcctgagtagctgggattacaggcgtgcgccaccatgcccggcttatttttgtatttttagaagagatgaggtttcactgtgttggccaggctggtctcgaactcctgaccttgtgatccacccacctcggcctcccaaagtgctgggattacaggtgtgagccaccgcgcccaaccttgattaaccttttctacagtctgctcaagtgagtaaaaaatcctatacgatttttaatttgcatgtgattaaacattttggtgtttgatatatcagatactgtgtttggcttttgttatgtacatccttcaacttgaccaatttaaacaaaaatgtaatttctctgtcctgttggtgtaatgtaatcaagagtttgtgataggaaattaatttttcaaccagtgatacaattttatgactgaatttaatatggacctgttaatgtgacattttcatgtttctgttgagtctgccttgatgaataactcagagcacttattctgtggtacacagagtcagtatttctcatttctggaattggatgctttattttctggtatgcctgtgataagagaggtgatagagtggcttctgcatctaattggtttgaatcctggtattacacttaactgatttgggcaaatgtatcctcgaggctcgatattttgttttgtttttctcccctgtaagagcactcactgctgtcttagcttgggctgctgtgaaaaaaaaaaaaaaccacagactgggtggctttacacgcgcattcctcactgtttttggaggctgggaagtctaaagatcacagtgccccctgattggtgccccagtttggttcctggtagtcctcatacagagagcgcaatagatgtcagtttccttggctcctcaggtgtattggatacaactgactactccagtttttgagacacttttgcaaaacaatgtaaagccattccttctgacaacttactttctcagatgttccctctttcatgagtagttatgccctgtactcaaatcattgcctgctgctctacgtcactgtcttgggagttcacctatccctgtggttatagtgaacactttcataatcccaggtaatgtcattaactgatctggacccatcatggggtggctgtgctgagggagtgttgagctagcccctagtggtaaggagtacactgctgaccttcatcctatggcaattccactttggtgattcactgttcccctcatggagaccaaggaggaatttgctgcatggtaggttggtgaatccagcctgtagcaaagacctggcttggactcctgcaactctttatgaaacttaaccaagaatgattgcatcttccagcgggggaagatgctgagaaggccccttcaggataaactggctccatagcactgctgtaatgatggctcctcatgagtaagcacttggagatttttgtggcttcctgcccactcaccctgctcaccagtccaggtagtttatgatttgagatctagatgtaattttattttatttctttttttttttttgagatggagtttcgctcttgttgcccaggctggagtacaatggtgcaatctcggcccaccacaacctccgcctcccaggttcaagcaattctcctgcctcagcctccctagtagctgggatttacaggcatgtggcaccacgcccagctaattttgtattttagtagagacagagtttctgcatgttggtcaggcaggtcttgaactcccgacctcaggtgatctgcccgcctcggcctcccaaagtgctgggattacaggcatgagccaccgcggccggccaagacataattttaaaaattatcttccagctggccgggcgcggtggctcacgcctgtaatcccagcactttgggaggccgaggtgggcggatcacaaggtcaggagttcgagatcagcctgactaacatggtgaaaccccgtctttactaaaaatataaaaattagctgggcatgatggcacgggcctgtaatcccagctactcaggactctgaggcagaagaatcgcttgaacccgggaggtggaggttgtggtgagccgagatagcgccactgcactccagcctgggtgacagagcgagctccgtctcaaaaaaaaaaaaaaaattcctcttctttccttcattcattattcttagtctctgtctgtctcatatgagtagataatcatatgagtagctataatgaggactcctcaggggacagattctgtttggccactcagcagaagcatgcaattaccttctcaagattggctcctaaacttactctagatagagccttcaggcaggaaactctatatcccttggctccagaagaatatattcatactcattcaaatgtgctaggcactggccataaagaatattggtgttcattcataactgcctataatgtgctaggagctgtgcataaagcagtgtaacaggatcatcttggaaagcttatgtagtcagtagaggagacagataaactaggaattacatggtaagttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccc

SEQ ID NO: 1341 - DNA, 353099 bp, Homo sapiens
gtctcactatgatggccaggctggactcagactcttggcagcctcaatgatcctctagccttggcctccgagggtttgggatgacaagagggagctattgcacccggcctcaatcttcctccctaattagtaactttaatttcatctgcaaccttaattcccctttgccatgtaatgtaatgcattcacaggttctgagggctaggatttgcacatcactggaggcctttattctgcctaccacagtacaggaacttttggcagagcgaagtcaatggactgagctaagcaaccagaagaacactagtgtgaggactcacgtcaccaactggacttggcccacagctatagtatttctctttcctgttactgttttagggaataaaacccacatttgatgaaaggttgattatgaacagagcttatgacaaggcaggtacgtggttggaacttactacccagagtgcaggaactacaaaagaagaggttttcatgtttatagaataacaggagaaatagtagtgtctcagcaagagagagtgtggctgccggctggccagggtgtgtggctggttcatggaataaactggagtagaacagtctttcctcaatacctgcatataactgacatttaattaatactggtagatgaactgacctccaaggccaagtctcttttactctgtcaactgcttgaccaaagaaattggaagttcaccagatcccctttaatgccagctgaaaaataagaaatggacacgtgtaaacctagataaggcattaacaggcagacataatgaaataggggaatgttttagaatccattattttttcccctattgaaccaaatattaaactctcattgcttaaattaattttagcttaatagtttaaaatattctggcttctgcaatttacattgtaaatttctcatatgtgtttgctgccttgtatgaagcaatgttaaaataaagctaaagtcaccattcaagacattaatgacagtctggatatgtggagacacaaatgagtggactgggtgaatagggtggtgatggacagatggacggatgcacagagacagagggatggggaaatgaactcataaaggtgaaaatgcaggagtacaaagaggctacattgcatagtggttgacagcagatgttcaaataccagctctgacatttactgggtcaccctgggcaagttacttaatccctccatgtctccacttgttcataaaaataaaggccatgtggatgagcatggtggctcatgccggcagttccagcactttgggaggctgacgtggcaggattgcttgaggccaggagtttgagactggcctgagcaacgtagcaagacccaatctctacaaaaaaaattagccaggcatggattttatagataggcttgaggaggcagtgtctgatttatgtagggcctacagattgtgtagttgttctcgtgtcacaggtgtgacgtttacatattgcatggggaagactggccactccactctaatcttattaagcagataggctttccacttggtcagcaccatgttgtctgctccctactgcacacatggtttgaaaggaaaaaagaagatggagctaccgttttgaacacgcctagtcccacgtagccttttcctattggcacagctgccagcattcacttgtgcaagcttctagcttgcttgcccatgtttgcagctcgattttacaggctgctctttgttagaaaagaaaatgatttggagactgcttttcatcaaaaggaaaaccttatcaatggttcccataccctcactatctgcctaagtaattactttttaactcctatgtcagtatcagtgggacctgacactgggctgaaccaggggtgtgcagggaagaggtggaaacagagcaattgctaaggaggcactgaggcccctcagacatttgcaaagttctgacgtcattgttttaactgtgcctctgttggcatcctaggttaccaactcccaggcaactacatcctcctctcctaccctacccccattggccatgttgccactctatcacccaaattaaatcactgttagttctgagagcagcttgactggattaattccctgtcaatgcattccccacccatttgctggagggcttaaaaaatgtaaatttgggcctgcaaggtagctcatgcctgtaatcccaaaacttttggaggccgaggtgggcggatcacctgaggtcaggggttcgagaccagcctggccaacatggtgaaaccccgtttctactaaaaatacaaaacatgagccgggcatggtggtgcgtgcctgtaatcccagctacttggggggctgaggcaggagaatagcttgaacccaggaggcagaggttgcagtgagccgagattgcgccactgcactccagcaggggcaacaagggtgaaaatccgtctcaaataaataaatatataaataaataaataaataaataaataattaaataagcaaatttgattgtgtcactcccttgcttgaaaggctcccttggctagacaggtgcttggctatatatcctagaggtttctcagagtaattcttaataacaccctcttgctctctccaatgtgtctccattaggaatataaagttatatggtcaccctacttaaggggctcagagtgatcttaccacttcccctcctgaccccatcacaggcttctgcagctgtagctaacacttggagtgtcctaagtgctgatgctggagagctactgtttcctcctgttgctctcagatccattccctccctttcttctggagaggagattcttcccaggtgcccaaagccctctggcttctgagtggtttcatccgatgagaagccctggcaggtgacttcagggagccagctattcttctccccatgacctctgcagggttttcctgcagcaattattctttctccagggtccagtcgcctcagggcagcctgtcgtggatgagcagtgactatgtgggctggtgtcgtgggtgtaaaagaatgaaccaagacagttgtaggtaaagaaaggcggatttattaaaggcagtaggaaaatctgttgcaaggttgcaatgggcagaatcagcagaagaggagctgacggcaaggatacaaaggcttgttggagattttatatagttttaaaatgattcttgggctgatggataacgccaaggtagcagggagctaacttgcattcttctgtcagccgaagtgtttgataaattgaagagttagatgacaagcaggaaacttgtgtgctgtgtgcgttatctgtgcaggagggccatgtgtctggggccgtaaagaaaggccgatctatagcttcctctttgctttcccctggtcctgccagcctgactcctttttcctaattaggactccacatagcccccttcttgcctctggctccctagcttctgtcatagctcctcttcgtccctccagcctgtgtcctggaaatgactttccattctggctcatctctcacttgcatcattagcccgaatttgtcttctcagctgttccataccctgtgtaatgaattccctctgtcaaattcgaaatgtttgctggtgttgggagctcatgcctgtaatggcagtgctttgagaggctcagtcaggaggaccgcttgagccaaggagttcgaggttacagtgagctatgattgcatcactgcactccagcctgggaaacagaccaagaccctgtctcttaaaaaaaaaaaaaaaatccaaatgttaatcctggcttattttcctgatcagaccccatcatatatatgatgacatgtgttgacttatttaatatcgtaacacggctgtgaggtgggcattactattattttcatttttcagacaatgaaactaagggaagttgaagggcttggccactgtcacagtttgtgacataagttgggttcaaaagataaattacaggaaactaacatgggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctaataatcaatgtgattcatttgtctttacaaaaacaaaccattcttttgttttgtttttttttcttcaacttttactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttcatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaacccaacaaataagttataagaaagggagaagaggccgggagtggtggctcatgtttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggagattgcagtgagccaagattgtgccactgctctccagcctggtgaccgagtgagactctgtctcaaaaaaaaaaaaaaaaatggagaagaaaatgtgatcatgataaccattcccgccattactggagcctggaccagccggccagatttccacaggatgtctctgacctgcagaggggctggcaaggtgggaggcatccagaccatgttacagaactcagtaatcagagcctgtgctggagccaccagcatcccaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcagtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggggggggggggtctcactatattgcccaggctggtcttgaactcctgggctcaagcaattctcctgccttggcctcccatagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagaacatttataggatatcttttggtggtccaagaggacttgagtgtaccttgtaaatacaggattttgtttttaattagattgattcacagagaaccaaacctaaggaatcacatcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcttcaggtaattagctatcctttctttcttttattttccttccttccttccttccttccttccttccttccttccttccttccttccttccttcctccctccctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatcctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatcacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctccgtcgcccaaactggagtgccgtggtgcgatctcggttcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagggaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcctttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgtttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccctgctggccctcagttctctggatcagggttgaaaggctgaaattctttgggtgttagcttaggatgcctctgatccatcctaacccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcacgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctctaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtgcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttactgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaagggccaggtgttttacgactctttggagttagcagcttgttggctctgatttggtaaaagcaacggaaatgccttcagcacggtgaacattacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcgcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagtagtccccccttatccgtggtgtttcagtttttttttttttgagtcagagtattactctgttgcgcaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtactatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccagggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttgttttttttttttgtttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagtagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtgcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactagactctaagaggagatctgagacagagagatgggggcggggaggaaacctatttcagtgtctctactatttctacctaggtggaggataactagccagatgaacggagctaagccttttgtatgaagtttatttcatataaagaggaacaaaatcagaatcaaatttcttctgtagttgcacagaaactgaagttaaagctaatacaatgtttttcatttttacccttacctctacaatgtacttaattgttacagattcgtatttattgattatcatgttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgcggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaataagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactattggatatgtatcgattactaattgattgcttgcctcatgtgctatcatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggagaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgactttttttttttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgtagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgctgttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttataaatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaatgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcaaccctcataggatgtacttacaaatcctacgtggtataacccattatacacagaggctgtatgggatagcctgttgcttccaggctgcaaacttgtatagcatggtaccgaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgttacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtacacttgcctcagcctcccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacagtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctgttacgacttagccctgtagctctgggctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccgtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttattagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcagactgctagaacctccagactgcatgtcatgcgtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactatttttttttttgggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgatctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatccctatgcttttaaaaaattattgtgatacagtgaaacaaggaagaacgtgtagctggaaaaatagtatttgcttgtaatatacattcagattcataacaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattaaaattatttctcagattaagagccatgctatgatgcttgccaacggatatttaaaacatgtaactgatttgttttttataatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccatatcttttgaaagaagattttttaaattccttatttttcctttctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaaaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgagcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttctttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagatcaaggtcatcttcacgtctttagttcttgttttgcttcaggtcagtttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcacgctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatattaaccatctcagtaggcttcttcgtgttcacatagtctcctcaccgtgtgctgtgtccagatttccccttttcataaggacaccagtcctattggattagggctcccccattatgacctcatttatccttaattatgaccataaaggccccatctccagatgcagtcatgttgggggttagggcttcagtgtatgagtttgggatggcaggggagcagttcagctcgtgagaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggcaagccgtgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaagaactccttcccagctctcccttctgagtgtctgattttattcaagctcagatggcttctcagatagcgtaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttcgaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttttttttttttttttaaaaaaaaaaaaggtgcttgaattagaaaggtagcacattgtccacatggacagtgcaggatggggctggctttttcatttctgagagctggcaatggaatgaaggtctttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacgttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattggttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccgtctcaaaaaaaaaaaaaaaaaaaaaaaaaaaagtgccatgtatattttgattacaaaaaatttcatgcggtgttactttctttttattggtagagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttccggacagctgcttagtaggtttagcttaaattatacacatgccaagcatgtacacatatgagaagcctatatctcgtaatatccacagagaatagatggcaaatcccatgatttgtatttgactgacagtcaagaccctgtggggtgtgagcctggtgggggcattccaggctggtttctcctgcctccaggagctgcttctagtgtgtgctcttaaccctaaaggaaggaaacactgtgtcttcctcttctctcatacagagcccttcccatgacaaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctcccggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggcggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatgagaccccatgcctggccaatttcaaggattttaggagctctgtgccaggaacctggatgaagacccagtatgtatttcttattatatcacaatatcacaaatccacagtcacatggtgattgtggtagtgtggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaataccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcccatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattcctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaaatgtgatcattcaggtaatcaaagtaactacagaaacagaggtatggattagctagtcattgcagatgtggcattgagcatataggcgtggtgtacttcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatcgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagggttcccaccttcatgttttttgtgcctgaggattctgtgggcgactgtccccacctgtccaacctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacagagttgctccccaatccttgatctttttttttttttttttttttttttgccaagcaccctgcctttttgcttgtctgtttcgtctttatctctccttccagtaaagttcttggcccagaggttctgctgccactcagtgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacatagtagggtttgacatggtttaaataaaatctcaaccagatcagtgggagatgttctttgagattcggtgattgagttgtgaacgtatggactgagggtgttttgtggtaaggcttgagtcatgtctgtagcaaggatgtttcctgaataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcaccacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtataagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctcttacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcccaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaaatgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggtaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttctttgggttcataggatctgtagtccttttctttatttttcatttttaaaaacaactttattgaggtatgattgatgtacaaaaagccttacgtatttgatgtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattagtgacagtgagccccttttcatacacttggctatttgtatgttttctttggagaattgtctatttggttcctttgcttgtttttaaaatctgtggtttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcgaactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccattataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctgactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggatcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaaaatattttcactaggtatagaattctaagatgaaagttttattttttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatacaaacgtacatttctgcttgtagcttgcacatatatatatacacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcactttgtttgtcttatgaatgaaagcatgagcaagtccattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggaggctttaaccctatctctaatttcttacttttctctgtctatgtagaagttgatgttgatacgtgtctacataaatatttactaagggcttgccttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcattttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttacgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgcagtggactctcttttatttaacagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgagatctcaggacctctgcatgtaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattaccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgattagcatcggaaataatgactttaacattattttcagatagggagcactcagtaccaaccattatattaggctcatgggctcaacattttgctgtgcttttcatagatactgacacctgtgttttcattttgttgttgttgttgttttccctgccgggaaactgccgcatcctgtgttttcatggcatgatattaaggaacgatgggtaggatgctgaggagtaaattgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggggcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagagcgcatcctaaatcagccattagatttgttcctcatttctttgctttacaaattgtttttctgtatagtattggattttcaataaataaaggatgatataaacaagtctgcaaaccagcaagaactatataagccacttgctcaagtcaataagcgcatgctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctctttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtcagcaagagaaaaatgaggaagaagcaaaagcagaaactgcctgataaacccatcagatctcttgagacttattcactatcatgagaatagcatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttcttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaaaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataataataataataataagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgtcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggttactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggagtcaccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgctttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaacaaacagccgagagatgaaatgccacagggatgtctaggttcaaacagcaacagaggtgcgtaccatagggatgtggaagccttgcttgtcttgttcctcttggtataaccccagtgagtagcatagcgcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagcttaaaaggctgcacctgagagtagggggcatatgggtaaatccagctgtacccaagagttgggggcatatgttagccctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggtgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcataagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtggtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatatagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaacgtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaaatgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctggctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggatttttaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcagtctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgcctcatgcctgtaatgtcagcactttgggaggctgaggcaggtggatcacttgtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcggaatcttttctccaggtttcaggacccatgtctgttgtccttcctttaccttaacttcagcagggcaagaatggttcaagccacattagaaagcagttactttctcacccaattttaaaggagaaaggtagatgcggtgggttctagggatttcagtgacgtaacaggtgtttcccaggcattaagacctagtaaggtttccatttccattaggtattatggatgcattccaagaatttaattactataacatcacttcattcattgtaattccttactagagttatgagaacttgggattgtgtggtttcttattcaatcgattaaaaggtacttgctatagttttctaactagctatttatatgaaatttagtacttgtcaatatgtattaaatcaatacagttatatttatcaaagtggtgagaagagtttacatctgaacatagaatagattgcttgccttggccgggcgcgggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagctgggattgtgccactgcactccagcctgggtgacagagcgagactctgtctcaaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaataatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccactgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacaactgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgcttcaataccaagaagctggtcttatttagatctagtcttatatcattgaaatatcattagaattcttatggaaaatatgttttggctgtttaggggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctcttaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagtcctgccaagctgttccatccccagttccttggtgcctgctggtacttcaccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaagaaaaaaaaaagattgaacatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaaccacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcggttggtaagccatccagtctctgcaggcatctacgctccaggtctccagtctgaggagtctggctcctggggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactgatggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcgcatatgtcaatatgtaaacattttatatatatatatatgcattcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgactcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatataattaggcaaacttgttttagttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatgattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcggtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtggtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagatctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggcccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtggcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccatgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatcgctaaccaatggtctcatccgtcagccacactgcctgtctcagcatgggccctgtgtggaccattccatctcaatttgtttctgattcttgtcaattaaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgctagaggctgacacattcctctgctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggcgaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttatatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcatgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccgagcaagttttatttattcactttcagtcattactgaagtgaataacaaacatataacaatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaacgcgtatttcttcagggccaagggcccagctgtgcctcattaggggtgagagtttggctgtgacacgacttaatagaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtgacatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattttcctgcctcagcctcccaagtagctgggactacaggcacccgccaccaagcccagctaattttttgtaattttagtagagatggggtttcaccacgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacgtttcccccagccttccctacctgctgagggctgctcccagcctaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccaccatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatatgtcattgaagtttcatccttcttcatttcagagtctgctggaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctagcaatcctcccacctcggcctcccaaagtgttgggattacaggcgtgagctaccgtgcccgtgcccggccttacgtttcagcatctttcaatccatctaatacgcagtgccagggaaggtttgtgaaaacatttgaatcacagagtcacaaacagtgagaatagctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatggtatatattttccacacatttagattctccatgccactccttatctctttagtgcagaaaacggagaggaggttcagtattcttaagaaactcccatgattgctttgaggcaatggatttaacaggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttagttaatctgttcaataaactcctctgcagaatccaaatgcttaaattcagtttctttttgtctttatggtgtttttcattgttaacgtggcatcggagtagctcgacttttgcatcatgataaattcataacccaagagaaggcagaaaacataattattatcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggttcaagcaattctcctgcctcagcctcccaagttgctgggactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccacgtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttttgagatggagtcttgctcttttgcccaggctggagtgcactatcgcgatctcggctcattgcaagctccgcctcccgggttcatgccattcttctgcctcagcctcccgagtagctgggactacaggcgcctgccactacacctggctaatttttttgtagttttagtagggatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcagtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcttttttttttttgagtctggattttagaataaattcactgtgtacatagctattccatctttaaaaacctttgtgaatgttaatatacagcctttataaatttgaggtataatgttcaaaatgctctaatccctaaattttccagtctaggttattatacttttatgactattcattttgatgtaggccttttaaaatcaattcctccctgttattacaatgctgctttatggtatttgtgatatatcatatgaatatacttgagggtcatgagaagttcatatgtgtgtgtgtagtgtgggccccagactttcgccataccgctggctaaagtggccatgtttttgtacgtctctgcagagcttacaagttattcaacagccagatttctattctgatatgcccttttagttttcaaagcatcgaaaaagggtaatctttagaaccgaagtatttggaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggagaggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttgtcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacattaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgggaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaaccctatctctactaaaaatacaaaagttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatgtcattcagattaatgatggcactgaaaatgtgtaatggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcgttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaatagttcttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcctttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctcgccatgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacccacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcggcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctggccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggcttagcctgtggtggaaggtgtccaaggtggctggaacacctcctgctgggggtgtcagtcttggctctcctgttttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgtatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcactgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaaccttgttcaggtggcgtggggcggtgtgtttggtggggagtgatgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaaactcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtgggccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaaggggagaaggggcaccagaaggagaaatgggaggaaagggcgagtgagatagcaaagagaactcagaaagtaataaagccctgcagtaatcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttggcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcccctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttctgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttgtttttttttttttttttgtttgacacagggcctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacttggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaacccgggaggcagaggttgcagtgagcctagactgcaccattgtactccatcctgggcgacagagcaagactccatctcaaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaaatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcatattagccacttgtacaaaaacaaaccagtcatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattcccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcgacagttaaagagtattccagattcctccctccaaaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagttagaaatagagttttaaaaaactgtctgttcatatagttcatctgcttaataagtaagcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgactgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcccaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggcgttgccagagaacttacacaggagcgtttctgctggaatcagctcgatgcctcttgaggacagagactcccagaggaaggagcaggcagccatccttgctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcccacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtaccaaacatacaaaaattagctgggtgtggtggcgtgcctgtaatcccagctattggggaggctgaggcaggagaatcactcgaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtgtggtaaggtagatagatagatagatagatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttctaaaacatgttgtatgtgggcccatttgccatgtgtgtgtgtgtgtctgtctatctatctatctatgtatctatctatctatctatatatatatatatatatatatatatatacttataatgtggtgggttctcgaatcacagttgtaattcacatttttctccaccaattctgataacttgcattaagaaattgactgtgtaagttaaattttagatcaataatgcaaattgcaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatagagagcattctgttagatacagagaatctctggtagatataaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccacagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagaaagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttgtttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcccccaccgccagccctgcttaaattatcccctctttttaaacaaaatatcctaatcttggaagtggcatatcatgttccttcttttttaagagagaaggagaaattcctgcagatcatcagggactgaggctaactgaagctttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctccccttccctcccctcccctcccttcccttccctttctttctttctttctttttttttttttttttcagacagaatctcactccgtcgtccaggttggagtgcagtggcacgatctcagctcactccaacctctgcctgcctggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcatggtggtgcatgcctgtaatcccagctacttgggaggctgaggcaggagaattgcttgagtctgggaggcggaggttgcagtcagctgagattgtgccgttgcactccagcctgggcaacaagagcgaaactccatgtcaaaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagtctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcaggctgtttgaaaacacacacacacagttttccagtggctaatttgaaaaatgtcaccgtattagttttcatttacatctgtcaggaaacatatctatacataaggaagttttttttttttttttttactttcaccaggtatttttttgtggagtatgcatttaattcacatttacaaattggtttctgtttttaactaaagatactttttcagcagaaatgatgtgtatgatgtcatatctaacttttgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacagtgtgctgaggtttcacattgttacatcctacaagcgtgcttacctgcatcaccttgctgggctgtttcagcattggaatatcactgggaatctcaagttcccaggagccaaccacgagagcttcacagctcagaattttcaagatgtggatgtaggcagggagcctatgtagtaattcaagtaagcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttacgttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctgtaagttggggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttacccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttgtccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatcctctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcacagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaacttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcggccagtggtcactgcagtttaacagattccccccgggtgtgaaggaaagcgagataaatgcaggaaaaaggatacattttgaaatctggaaattttacataacaggcatcagatttgaagaatgtccaaaatattacgaatcatagcacaacctttgctaacaccgtggaaatttttgaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtccttctgtcctgggacccaggtgtgagtgcatagggaaaagggaggagaaatttaatcctgtaactatctccttatggaaaacaggaaaccacagatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaaatatttctgaacagaactaacatcagaatcatctgaatcatcagaattgtgtattttggaaaaatcggattcatcaaatgaatcttcagccaacaactgttcgagaattatgttaacatcacatgcaggaatgctacattttctcggatttgacattttcagtgatggagaactattatattttgtaaatggaaataccactactaaaaacagaaggctataaatagaacgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctccgccccagtgattcaaatacctcccattacggacatgtttcaacatgagatttgggcggggacaaatatccaaactatatcaggatcccagcagactgggtgggtggaggttcagggatatctgggaaggactaagaatagctttttcttttagtagatcaggagtttcctcttacacacaaaaagctccaaatttaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcgaaaacaggcataaacgacatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttaatcccttagttttgatgatcttttatgggttatattcttcaaagggaaaattctctccaaatggggctgccactggcagacgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacggagtctgagaggccccgttccctaatggtaaaatgaggtccaattttgcaaaaggaggcacctggggaaacattctggacacacaaatctatagcttctaccgtcaatctgctatgatccttttatggttctgacgttgcaattttatttttgcatgtttctagagacatcaggaggggatcttttcgggatgtggcttcaaaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaagtgagaagagtggcttagaacagggaaaatgtggccgggcgcagtggctcacgcctgtaatctcagcactttgggaggcctaggtgcgcagattacaaggtcaggagattgaggccaggctggccaatgtgatgtgagaccccatgtctactaaaaatacaaaaaattagccgggagtggtggtgttcgcctgtagtcccagttactcaggaggctgagccaggagaatcgcttgaacctcggaggtggaggttgcagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattgtacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcctaaacttacatgttaacataaacatggagctcagaggaaatgtgttgtttgagatgaaccatcgtttcaaatgtcacttacttcttgttttataaagtatcattactcttttcttggacacagtctcatctttgaggtgtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaactaaaaaaaaaattaagttagaagggagggattacgaccctcatgtgtatcaagaaacaagctccatgaagccccataggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcgcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctgtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccaatcccttgtattttagaagagcctgatacatttgcaaggtctctctttatattcctgaattttgcatccctagacatcatcctttttgagagagaaaattccgagtgtcagttttcctttatcggaacctccttttatttgaactaaccacaatgggtcataatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctacttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattcttggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacagtgcactttctctctctctttcttcttttggtttatgatgtttttcagtagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaacgtttcttgggattttcagaaaggattggcttggctttttatcaaagttacacaacggctgtaaaaaataaataaaaaaaaagcaaaattagcactttatcaagtttggggcatatttccaaggccaccagggagcagggaaagtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggcttatgagatgaggatgatttttaccttttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacgtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatcttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccatttcagtctgatccggtcaattctggtaggacttcatccaagcacaaagaaacctttgttttcattcaagacttccctaaaaggtggctgggtgcggtgcctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggatgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctctaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtaccgccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtcaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtatcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatatgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttctctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatctttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacatttatccatccatctacccacccatccatccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttaggattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtatttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagagacgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatttcgctagcattgggaaaatccccattttcctcactatccatttttcttcctctctttccttcctcttttcccttcttcctctttttttttcttttctttccttccctttttccttttctttccttctttccttgccatttaaaacatactgataacttggcagcacagggcagtgattaaactcaggcactcaccccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttccttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagccccagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtgaattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcataacccatttccaaccttctgggttttttccttcaacgtttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgtttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcagtagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatcccgacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcagtgtctgtcttgtggtcctgaagtctaactctaatcctggctccactacctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatcttcccttcctcctccttccccctccttccccctctctttttccttttctttctatcatcatccatagctctcttgccccattgttttaaacccatctgtttttgttgctggtaactgtatccaaaagtaatacagaattttccgtaagaacatttattgtgtttccttctacccacgaattttcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacttagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttaatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggcgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtgatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttatattgctagtgagtggccagctggagttgtaggtctaattctttttttttttttaagacggagttgtgctcttgtcacctaggctggagtgcaatggcatgatttctgctcactgcaacctccacctcctgtgttcaagcagttctgcctcagcctcctgagtagctgggattacaggtgcctgccaccatgcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatgttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcagcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaacccaggacgcagaggttgcagtgagccgagatcgagccactgcactccagcctgagcaacagagtgagactctgtctcaaaaaaaaaaaaaaaaaagtacaggacatacgtaggacccctgaacatttatccccctgctgccagtacgttacagcaaccaccaagtccacctctatcaggatggtgccaatttgtggggtttttttttttttttgagtcggagttttgctcttgtcgcccaggctggagtgtaatggcgtgatactggctcactgcaacctctacctcctgggttcaagcgattcttctgcctcagccccctgagtagctgggactacaggcacaccccaccctgcaggggttttttttttttgttttttttttttttttttttctgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtggtcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccgggaagcagaggttgtagtgagctgagatcatgccactgtactccagcctgggtgacagagcaagactgtctcaaaaaagaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaatttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaacatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatacgtatatatatacgtatatatatgcgtatatatatacgtatatatgcgtatatatatacgtatatatgcgtatatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcgccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaacccaggtagacctgaattaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaatgagtatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcccccgccaccatgcccggctaatttttttatttttagtagaaacggggtttcaccatgttagccaggatggtctcgatctcctgacctcatgatctgtcagcctcagcctcctaaagtgctgggattacaggcgtgagccactgcgcccggccggggatcttgtattaatagtagggagacagtaagcaagcaaggctcagttaatgataaattgttatcaggagacccagcagtttctgctttttctaccctcctctttgagctctatttaaactaataggttactgggtttgaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggtcaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtgtgcatatgctcagttgcagaaacctaaattgctaaattgcaaggctgtatatgatatgccaatttggcatattctgtctttttatattctgccacccctatcatacttaggaaaatgccaggttgtaatcattcactgggagaaacaaggggttgaacgttgttatcgcgcaaaggaagctgggcctagtaaaggaatgtaaatactaaaatgccagcatcactgttacttactgtgtttctctggatgtattacttaacctctctggctttatttctgcctgccctccccccgccccccccccccgcaatgcctcaatctgtggcagagttgttacattattgaaaaagaacataaagcatattttctggcatacagcatatgtttaatttataatttttgtttttatcattaaaagcaacagattgctgtattcttgcctgccactgacatggacttaattgtttcatttagacatttaagtgggcaatacacttaaaatgcagatataactttaattgtcaaaacatgcttattttaggaaatgtgtttctccagtaaagctcagtatctggggctttttcggttgtattctatatgaatcttgaatactgaagtttctcaccatggagatgacaaacacataaaatgtttactttgcaaactgaatttctcttgctgctttttctgaagttccccagaggctcatcatcatcaataccatcaattaatagtcatccttggcttcctcgatcctcagcactgcgctgggcactgccccccaggagcatccatgcacctcaaatcctgaccttgtgactttcaagtccctaagtgaccccacactgaagaatctggtgaaggccatccaagcccagagttcatttaagtggcagcgatgggaccaaattataggccaggtctgtcttatgaaagatgataaatggatgtgtcatatcgggaaagaaatcactctgtcatcatatgacaggctggcttgatttctttgcaccagtgtccctaaaagttgggatgggggtgtgaagcgtgccagctttcaaagccagttgtcactccattttgtgctgtacctccccagttatgaatctggggcatcttcactggactctccaagccccagtaccctcagtgtggaaggagaaagcatgacccactgggcaggacacagaaggcttctgtgagaatgaagctctatcatgcttgtagaacatggagcgctcagcaaatacaaatcacagcccatctcctccaatcatttggggtattaggattcccttcactccaactcccactggaaaacctctttgccatgacacagagattccacaatcttctatttttatttaaaaatttttttaaagagtgatctttggttttctcagtagatgctttcctctgaatagcaagcatatagatagtcttctccttcagacccccgaccatggctatattatttagtctacagtggttctttgtacaaagtgcttctgcaaagctcttagagcacccagagctggctttggaaagcaagacattaggaatgagctagcctgaatgagtcctgatttttttttttttttttttttttttttgagatgatcttcttctgttgcccaggctggagtacagttgtacaatcttggctcatggcaacctcaaacttctgggctcaagccagccgcccatctcagctacttagtagcttggattatgggtttgtaccaccttgcctggctaatttgtatttttagtagagatgacattttgccatgttggccaggctggtcttgaactcctggcctcatgtgattgccccaacctcagcctcccaaagtgttgggattataggtgtgagcctctgtacctgagttctgatttcttaaatttcacagtcccttacctgtaactcaaattcccgaaccttcaaaaaacaacaagtggcagcaaaacttgatttggaattgtcgtggtcttgtttataatcgtcatttttcttgtcatgtgatttgatgtttgggtatatgttaacacctcactagggatatttcatagcatatgattgatgtaagtcgtaaaaaatttagaatccttcaacacatacttggattttagatgaagaatcatagatttttatttctgtggctttggatgagctgtttaattttcatttcaagttgctggtaagatgatgatgataatagagataatcctgtaagaatgctgcaaagggttagtactttattcttgcaacaagtatttattgtaggcctgtattcaaaggagaataagataaataagatcgaatgtggaaattagatgaatccggagttagtgcaatgaaagttactaagagagaacagaaatactcttgataatgctgatgtgactggacttttgacaagcagtctgggacttctgctgaaaagtgctcttgaagccaagcaaaatcatttccacaccctcagcacctccagtttttcctggccttggtctcagggtggttgaccttttgccgatgtgtttttcttttttcttttcttttgttttcttttcttttctcttctcttcttttcttttctaacagtcttgctctgtcttccaggctggagtgcagtggtgcgatctcagctcactgcagcctctgccccctgggttgaagcgattctcctgcctcagcctcccgagtacctgggactacaggctcccatcaccatgacaggctgattttcttttttttcgtaggacgaggtttcagcatgttcgccaggctggtcttggattcctgatctcacatgattcaccaaccttggcctcccaaagtgctgggattacaggtgtgagctaccgcacccagcctgctgatatatttttaattatcataagaaacagttaaagtgaaattgcaaccccatggtatcggtggactgaacgtttggttctcatttccttgagatggtagtttcctcctctggctacttttgtccagccagttctcctctgtgggcatttggggaagggctctctgatagaaatatgaaatgatgagggatgcaaaaaacgtggtttgtttcttagaacaacctccaccacgaaggttccagacagagtgaaatttctgtatttgctgaccctgtcgccagtagcctggaataaacagcaaaaatagttcttgaggcttcgtggcaaatgtgacctacctttgtagttcttgggtaggtgtgtgactgtggcctatgaggccaagttgcaaggtctttggatgaactttgtggcatctggcaatgtccccagtgcaacctatgtaaaatatagcagtttcctgcacacgcttaagggaagaaaccgttgtggggaagcgtgctctgttattcttgccaatgtagccaacatatacatggggaggtctgttttatgttttatgtttgatggttttttctttttctttcttttttttttttttgagacagggccttgctttgtcaccctggctcaagtgcagtggtagaatcatagctcactgcagcctcaaactctttggctccagtgattctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtaaatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgataattttttttttttttcccctgagaaagtcttgctctgttgccaggctatagtgcactggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggatgctctcgatcttttgacctcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttacgacttcatttgtactttcaaacttcctcctggaaacagaagaaaataaaattagatttttgtaagctgagatgatatgcatgttcttattttcaatacagttagtctctccactttatttttaaacacaacctcataatacaaataatctagtcttttctggagcagtctatttattcagacaggtggaagttgatgctaaagattggcgttaaattgagtaaaccattcatgtagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttcttcatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacattctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagacgtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtattttacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctagctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcacgggacactcctccagcggagtagcctgtgatttgtatgggctgcatgaattcctgcactaacaaggtaaaagaaggatgttaaagaaaacccgagatcttttgggtacatgctataaggtgaaaggcttattccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttccgttgcttataatcttaactataataatcataaaccatgttctgttgctcagaacccttgtacttataatataaaacaatctttttaaccaagattcttcgcttgggtattctgagtagcatggaagagcattatacttttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacaggagcatactcccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggtgtgtgttacattttttaaaattttattttaatgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttgatacacatgaaataaaatttcaaatggttcctctgttcagcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctccccctcttcttctcttttagaaaccttgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcctaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattccgcagaaaaaagtactgattgtccagcagttgtgtcaggtagaaaactgggatgcccgactgcattggtttagccagaactatggccatgaaaccttgcctggcccccagggatggggtgaggggggatatcatatacgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcgtggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgtatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctatgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgggataatctgcctgtttgaaggtcagccaattagcaatcttaatgccatctacaaccttaattaccatttgctatgtaacatatttatagatatcagggattagttcatgaacatattggggtagagggcattccacatacagcagtacctataatgtatatgcttcttaaagaatgcatgagtcttaaatttattttatgtccttggagtgtatagcagagttagatagatccttctggattggcggttgattgaatattggctgtacaaagaaactggataggagtatagagaaaagatcaatcatagcactagcttatagtttattttattctttaatgattttttaaaaatatttctctcacttacttgaaaagcagtcttagaaattaactggaatgggtaatttattcgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattaggattaagggaaaatcaagtaaatcgagaggtaaagcactgtgcagaaatattggccagaagctatgaacagatgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaagtgaacatctgtctaattgttcacctccatcgctttcgtgctttcctcatgctttctctctttccagacaataaactttattttcttcataagaattcagtctacgcaagggtattaggcagcttgtttgcaccttttaattcctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccccccacccctgccagaaataaagggattaatctctttttgcttggcatagggagaagacagtgtctgctgatgtgcttaacttttttttttttttggtcaggtgtgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttagaaatatccagcaagccacttttaaaggctttttatcacattttattcttaagctttctgaattccttattatattttgcctgataaatagttggattttgttttttggttcaatgtaagaatattcttaaactaggtaaactgttttgtttgtcattatgttctctcattctgttaaattttgttttctatttttcatgtttttgggtttttctagatggcctgtctttaacacttcttgatatttttgattaaattttcatatatcatcaaaaacagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtgtctgtatataaaaaaaaagtatgtatacatatacgtatatgtatgtgtatagataaaaatgcgtgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacaacgtagaccagcagcaaactaccaacactgtggaggatcccctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttgcccctccactgagagttggctgaaacaaagaatttgtcctgtacggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgattgaacccgggaggtggaggttgcagtgagccaaggtcatgccactgcactccagcttgggcgacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaatactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggacagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaggcaggagaatttcttgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgagagtactccttatgaagggagtcatatgagttgctagctgggttctctggatggtggtgtcatgccaacatgggagccactagcacaaagaacatgctaggttctgttgagacctgactttgggaatagcataggtacttacctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccagtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgtttttgtaaaagcatcatgcactaggtaaaatgtttaataacacagagaaatctaattgtcaagtatcttctcaacacacattaatcaacaattctcctatcgaaagataacctcttgtatttacaaaaaaaagaagaaaaagtgctgtcatcagtaaattcattcatgtatgttatacactcacatacaaaacgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattagctgggtgtggtggcacatgcctgtaatcccagctactcaggaagctgaggactgagaatcgcttgaacctgggaagtggagtttgcagtgagccgagatagttctactgcactccagcctgagcaacagagcaagactccgtgtcaaaaaataaataatatgtgtgtgtgtgtgtgtgtgtgtatgtacatgaattatatacaaatgagggaaaatatacaaatgagttgaatatatacaaatgagggaaaaattgttccttgtgtcaggaacaattactgtgaattttgtgtagctctttctgactttttaaaattcaaatatatttcataaagttgaaatcacactgtggtcttttttttttttttttttaaccagacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctgggctaaataagaagtttaaatgcaaatagataatgcttgagaaagcttcttcccatatatactctttctgtagcagtgtctgagtgtctgtaccttcctataccttcaccatatcatgtatttgtcattttatagtgagttgtattacttgctaggtgagctggtatctcctctgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgttttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactattcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcacagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaagttgcagaaatagcaatatttcacagtacctctactttcttgtaattttagcagtttacctaatcatggtataataatcaaaactagaaaatagacaatggtgctaaatattaactatacttgttactcaaatttcaccactaaagcagtgtcatctttttattccaggatctagtccaggatgccacattatatttaattgttgtatctccttggtgcctttagtgctttttttttttgagacacggtctcactctgtcacccaggctggagcacagtggtacgatcatgggttactgcagcctccacctcctaggctcaagcgatcctcccacctcagtctcctgagtatctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacaggcatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtgtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcctgtcgcccaggctggagtgtaatggtgcgatatcggctccctgcaacctctgcctcctgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaagtgctgggattacaggtgtgagctacagcgcctggcccctcccccgtttatttctgattcaattactttatattagcgtagattcacaggtatttcctttttttttttttgatttattaatacctccatttattctgttgctgaaaccattccagctttttctggttggcttctatgaaggacgctattttaatggggtgatttttttcttctcactacattcttcctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagcctgtaatcccagcactttggaaggccaatgcgggtggatcacctgatgataggagttcaagaccagcctcaccaacatggtgaaaccctatccctattaaaaatacaaaaattaacaggcgtggtggcaggcatctgttgttccaggtactcgggaggctgaggcagcagaattgcctgaactcgggaggtggaggtagcagtgagctgagatggcaccactgcactccagcctgggcaatggagcaagactctatctaccccccaccctgcaaaaaaagaaaagaaaggaaaaaaaatcctggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactagtattttgcttgcaaagatgagggaagtgagtttccgaagttgctaaatgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgcagtgcagtggcgcgatgacagcccactccagccccaaactcccaagctccagtgattttcctttctcagaccccaaagtagctgggaccacaggtgcacaccaccacttccagctgattatttaaaaaaaaattttgtagtgacagtgtcttgctgtgtttcccaggctgtccttgaactcctgggctcaactgatcttcccagcttggcctcccaaagtgctgggaatacaggtgtgagccactgtcccaggccagttttaactcagaatgatttcataagaaatccacatctgagagtcccagaaggtaagatattcccctttcttctaaatatacttgaccaccaccattcaggttcttctattaaccttcctatatttgccaaccctcaacctgttagaaacaagaaatgggactctggagtagatgttagcaacatcatgagctcaaacccctccagcttacagcggagacagtgaggtcctgtaggatgaggttggagagcaggaacttgcccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttctgatttattaaccatttacttggctttggagaaggcagcatttttagtagtactgttgagcctgcatgtagcttttccaggagggcagggtgcccggaatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgctctttctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcgtgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacattatcagtgtgattgtctccaacgcatccatggaagtgaaaccgctggaggaagctaatgccgtgagccagctgttggttatgtttttgttttgtttttcttttttacttgctggatagtgggttctgtttattgagaaatatttacatccgtctaaatcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttgttttttgttcttttgttttttgtgtgtgcttctgcgtgcccctcctctatggctccccccaccaaatttctgtgtcttcatttgcaactctcttttctccagtaaagaggaaagtgtatagttctcctttccttacagaaacattattttgttattgttgttttggtttgggtttctgaagtataaatgcatatgaactggacagaagtattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacactcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttactatctggccctttagagaaaaggttttccaatctctgttctagaggattcgtggtcatttggaaagaaaagtatgttaagacaaaatgagcaggtggttggattagtattttctttctacacatatagaaactgttcctatcatacgtgactcagttttcaaacttgcttaatccaaagcctggggggtggatgtaggagagaagttgaaattagctggggttttttttttgtatcacaaaagttacattttttttttttttttttttttttttttaagacgtagtcttgctctgttgcccaggctggagtgcagtggtgtgatttcagctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctcctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccatttttttttcaactcatcagctatcattagggttagtgtattaatattttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagtggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttctgcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtgtgcactgacagaatggtacatcccaccactgctctgtgtctgtgtgcgactgtcagttgctctctactgctcctcatagacttcctgtctgcctttctctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggccgaggcgggaggatcacataaggccaggagtttgagaccagcctggccaacatggtgaaaccccatctctactaaaactacaaaaatagccaggtgtcctggtgcatgtctgtaatcccagctacctgggaggctgaagcatcagaatcgcttcagcttgggagctggagcttgcagccagccaagatcacaccactgctctctatcctgggagacagagcaagactgtctccaaaaaaaaaaaaaaaaaaaagggcatggatctagatgccagacaatctgggtgcatatctttgctccaaaagcaaagattgtaaactctctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgtttttttttttgatttttttatgtcattttaaatgtttctattcttctgttctgttcttaaagtatgcctgtaattattaggatataattatggattctgtcttatttattttttaatcttcttattgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggggcaatgcattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatttcttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttaagttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtgtccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttaggggaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgacattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgaccttgtggtccgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcggcctcccaaagtgctgggataacaggcgtgagccactgcgcctgtctacattttctgtctttactggtattatggtgggaacccataaaccactgcgaggcagataccattttaagcaggaaaccttatttttttccgaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattctgcataccaagcacatatccgtcacacgcagtgtggccaacttccgagaggccggcattcagccaaacagcctgaagaaccaggagaaatgcctgagtttccaaatggcttatggtaagttgttgctgccactatgagtagcctacttgcatttctatttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggatttttttttttttttttttgacggagtcttgctctgttgcccaggctcgagtgcagtggcatgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagacattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtctttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagacttagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcctaaaaaaaaggaaatccagggctttgctagggatcatttttggtgtggttctgtgttttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttccagtgaagatgcgatcacccattgccaccgttaccattacttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgacgacaggggaacagcccagtgtggcagtcatgtgacgacatgagcattggaaccagccacatctcagttggcaacacgtatctgtgtcttactagcttggccactgtcacgtcactcagcctctgttttctcatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgagtacatgaatttagtcctgtaaatgttttctcccttatttgggacatggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccgtatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagatccttccagtagctttcctgaagtcaagttgccagtgcattggacatactgggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatactagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtaggtagagtctgtatacataatttaaaatacattaacatttctgttttgcctgagataagcttgtactggtgtgatcagaaggaagaatgaagatttggggaaggaaaattttgagagccattttacagcatttcaagattcagtgatctcagaacctcttttggttaaacaagcatgggaggatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaaggaaatgtgagcagaagcaacaccagtcactattaagtggaagtctttgagatgccacgtgtaactcaccacattgccttccacatgccgtagaggctggcagtgttacagacaacagaggctccatccacctggtccctgagtggccacggtgagctgggcccactgacctacaatgagtgtgaagtgtgagcaagtcataattctgggttattctaattaatggagatttgggggttgttccttactgaagcacatcctgattgatgcagaggatcttgtgagccatgctaaggaattcagcccacgtcttactgaccactctgacgtactaaagggttggttttgccaatgaagagagcaggctctgactgaacgaggcctgaacttttcatgttctagatggcatgtgctaattctaacacttcttaatgaaagtcatggtttgcttggtggtgatggaacagttctatgtcttgaatgtggtgatggttatatgaatacatacacatgataaaatgtcttagaattatgcacaaaggtacagcaaagaaaataaacgcatctcaagttgtgttagttccttctcacactgctatataaacatacctgagactgtgtaatttataaagaaagcaggtttaattggctcattgttctgtgttcatgttctgcttctggataggccttaggaaacttccaatcatggcgaagaggaagcaggcaaatcttagcaggagcaggaggacgaatagggggaggtgatatgctcttgtaaacaagcagatcttaggcatactggatcacgagacagcactagggggatggcactaagctgtttttaaccagccccatgatccaatcacctcccaccaggccccacctccagtattggggattacaatttaatatgagatttgggtagggacacagagccaaaccacatcaggtgacatcccagtaatgactgtggtctagtaaattgtgttgtgttgatgttgattttcaggttttgccattgtattgtatgtatgtaagatgtatatatgggggaagctggatgatgggtatagggtgttctctgtaccagtttggccatgttttgtgaatctataattagtttcaaataaaagttaacaaccagaagatcatgagctaaaccaataaagtgaattatggtcagttgcagattcactgccagacctgggaggaaatctcaccttggcagatcgagtctcttgtcctcgcctaacaatcagcagttcacctctcgaaaaggggttccgtttgcaatctgtcagccactaccttcttatttagagcatgtcccactacaaacatttctataaagttactaagtttgttagacaattagaattgcaaacccccaacacacacataaacacatatgcacaccctaatttaaaggctgcattttccatcccctggacttactgtattgcctccagtttctctccatttctcaggattggtagcagaaatgggaaacctgatacctagggcaagagaattgcctgaataacagtgtgtggacttgaatcactatccccaggagcctagtaacccacagcttgtggattagtctgttgaactacttgatggcttgtgacccctttttcccttagagttatatgttctgattttcttcttattgatagtggcagctctgtgctttattttgaagggaagcaggggaaccaaaagaaaacttagcagttgtaagttacttacagagaagactgggctagttggctgtgctatcatttttgttgaaatactgctttggggtcgccatctgggaatgttcttcctgttttatgggggaaatacatacatgcgtttttataatatgtagcctgcatatcccttggggtttccactgggggcttggctgagcagagcaatttctttaccaccccctccacagcataatgaatggctgcctttcctcttgtgatacattcacatttctgtaagattctgcacgtggcagtgagtgtcatgctccaagtaaaacgaggcagggaccagaggacttaggatgaggatgaaaggtcactttgtttgctgactctgaatgtcaggtagttgtgtttatgaggcatcagcgtctctgtggggtattgaaacatttacactttgaaaatatttttaatcatcagataaatatcagttactcagacagcttatgagggttctgctcctcatctggaggtacacacctttcacggggtgtgacttcaccacatgccttcaatattcttggtggcagttgccctctttataggggggatgtggcgtcaccttatagcagaccctctagctctgttatttcctgaacgtaggaaactaacaacccacgtgtgggcgttttccccttttcctagatcaggttcatgtttctcctcctcgttccaaaatctgcacactttggcatctgccactgttacccaagaccaggaatttaaatctgtgtttgccagtttgcctccaccactgatgtgctgttggggtttggggacataatttcatcactttctaccacctttccttaaaactaggctttgtgccaggtgcggtggctcacgcctgtaatcctagcactttcggaggccggggtgggtggatcacaaggtcaagagattgagaccatcctggccaacatggtgaaaccccgtctgtactgaaaatacaaaaataagctgggtgtgttggcacgcacctgtagtcccagctagtcgggaggctgaggcaggagaatcgcttgagcccaggaagtggaggttgcagtgagccaagatggtgccactgcacttcagcctgggcgacagagtgagactccatctaaacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagctgcaattacgctgaacgtctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttgggttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgctaggcgggaacttgggcttctttatcagtgactggggtcagttcttgtactcaatttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcgtcttatattaaacaggggaattccgacatgttccataacacatttactgtaacttgataccatgaactacacttgctgttatttatcatttctttttattttctctcattgcagcataaagccaaggtagaagcaatgaccctggacctcgctctgctccgtagcgtgcagcattttgctgaagcattcaaggccaagaatgtgtgagtgttccagtggagggttatagatcataatttcttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgtgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgtaatcccagctacttgggaggctgaggcaggagaatggcttgaacccgggaggtggaggttgcagtgagctgagactgaaccagtgcactccagcccgggtgacaagagcaaaactctgtctcaaaaaaaaaaaaaaaaattgactcaggctcttgctggagtatgtcagtgtcccaagtcactgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccacccgttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtatgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctcttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgtgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacgtaaaacaagaaacatttcttttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggattgtctagttctaggaaaacaagctcagggctcccaccgattgtacattatggtgagttggataactatttcattatatattacaacgtaataataatagaaataaagtgcacaataaatgtcatctgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgattgccaaagccagttttcttcaggcccagcacgtcctgacctcctcactcctctgcccactctctgtttactcactcccattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctatattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaaggttaaaataacggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaatatgagaaatccatttttggtttgcctaacagaagatcatcttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccatagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatatatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcaacagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctagggtgacaagagccaagagaaattattgttactgtagtgatgttccactgaggatcataaagtactttattactctactgagtatggttttttgttttgttttttctttttctttttctttttcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgccctcacctcatcatttattcagcagtcacaacagtgccaagaacttggctagagattggaaataaagcttatgccttctctcatatctcctgtaccttatttctttcttacagtagttgtgatgcttagcagttttttgataactttttatgatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctctcatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttggacggtggcccagagaccctttaaatgaaattcattttactagcaccctttttcatcatgagaaatatattctgtttttcttagaaaatgggttatgttaggtctggtcaaggtaaataagtgttgagagtcgatgttgtgtgcatagttaatttcaattctttgaagaaactcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgactctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgttgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttcggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctctacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttcggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcaatctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaccctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagataaagagcaagggaagaattcctggagaaaggaagagtttcctgagtcacctttgggaggtaggaagggtttgacatgtaggctgggcatctgggaacgagtgagggattctgtgagccccatctcagtggaccactcaaggaaggtgggtaagccctgggtataagtgtgtaagcagggaacagaaagtactgtgatttaaaatatgttaatttttctactgtacagatgagagccagcttggagatgggctgtagctcaagcatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccagaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctactccataggcagagcagcaactttggctgttggactaaggatatttatagttaattattgattagctataatatattttaatataatatatataattataatacaatattatatataatatatattttatgtaactataaacaaggggtagattactcatgagttttcacggaaaggggtaggcagttcccggaagtgagggttcttcccctttttagaccatatagggtaacttcttgatgttgccatggcatgtgtacactgtcatggtgctggtgggagtgtctcttagcgtgctaatggattcatattagggtataatgagtagtaaggatgaccaaatgtcgttgccatctttgttttggtgggttttggccggcttctttactgcaacctattttatcagcaaggtctttatgacctgtatcttgtgctgacctcctatgttatcctgtaacttagaatgcctgacctcgtgggaatgcagcccagtaggtctcaatcttattttacccagcccctattcaaaatggagtcactctggtttgaatgcttctgacaaacctctgagactaaggacaagatggagtctgttaggttagttttaatttcctcagttattatttcacaaagggggtttcagaaagatagaaaatgctagaaagagacggggtagtcagtggtagggatcttgaggggttaaaaaagggaaggagctggtccctttgcagtaggaagtgccacctcactccactcttgccagaaagcctggctctgtcataaggaatcttggcccattgtcactctcattgatgacaacccccgcccccaccactaccaccttaactactgaggggatgtcctctggcccagaaggaatgcattggctctagttgaaggggttgctggtttgtaaatagcatccccacagtcagcagacacagagaatgccatggggccactcatcagaaaggtggaggggctttatctgtgggtagatgagagccatgtagaacctgcatgctgccttccattggaatctcaggctctaaacaaggaggacaaccttttctgcccttaatcacctctcacagatgagaatccacccaagaagaagaaaaaaaatcagccccttaaaatgctgactagtaacatcagtttttggaaggatactatttttgtttccattctgtctttatagtttgaacttttccttttcatagtctgtaaatattcatcatctcagagccttttgaattgcaatggcttttagtcaaaactgagcgcaatgtgccatttgaataataagaacctcattaaagtgaggcaaaagtaattcttttccttttgtacaagccaattaagtgtctttacaattaaaacaaagtcaagcactttatagtttcatattccacaagcctgtttttaattaatagaggtgacaagttttaggtacaggatacatattttgcctctggagttgtgcaattaacattaatgaagggtattaaaatttggtgagagaggaaagggttttcccaggtcctctgtgggttcttgcctccaggcctgtctttggtagcaagttccttggtttgctgaggtttgcattttcttgagagaatgtacaggcaagaataaaagtaactagaagagacattgttgttattgagaagtatgaagttaaaattcccaatgtccaggcctgtcttaaaattaggtaaacactgcagaaactatctttgaggaatttaattttgtcttgtggataaaagtgaaggataaagaggagaaataacaattatctaagctggcaggccagcaagatactggggctttacttctcacaaccatgggaggagtatatttagtttacaggggaggacacagattcacaggggtgaactaactggccatgagtcaggtaaggaaaataacatggctgagctacagtttctctaagaagttggttctgtccatttcagggagcttatgtaagacagaaggtattgtgcagtagccttgaagtcaggtgaccctttgggggtgtgtgtgtgtttgcttctttatattagcttttttttcattttgagacagggtgttgctcttcctcagttgcccaggctggagatcagtggggtgattacagctcactgcagccacaacctcccaggttcaagagatcctcccacctcagcttcccaagtagctgagactacaggtgcatgccactggctatttttatttttttctttttagttttgagtttttaattttttgtagagatgaggtcttgctatgttgtccaggttggtcttgaacccctgagtccaaaagatgctgctgtcttggcctcccactgtgctgagattacaggcatgagccaccatatctggcctatgttagctatttctgaaacttcatttctgtctgtaaatggcaatcataatatatgtcacgtagggttcttaaatacaaaaagctcttaaaaagtgcctaacccatagttagtactcaaaaaaggaaaaaaaagtattaatagccctggaaaagtgagcaaaatatttcagatgcaacctgaaaggagttcaaatgtaagtctctcttcactttgcccatctttccctcttccccgcaaggtttttagcagtggtcctgtcttactacaatatatgaattatccctgctacaaattagtagattctgctttgatttgaagcagagtctaatgagtgttacaggtaggctcggtgcttcaaaggatttctgcctatctcttcacagagtagctgggctattgagggactgtgtattgacaattgtagtgggcaccctatgtggaaaacaggtgttgtcaaataactgcaactgaccccaaccacaccatgacttttcaggttttaggtaggggatgggtgggaaaacagatgaggcaacagaatgaattattccttaataagatccagattaccgagtgataataagatttgcatgaatacttcaaacaacaacagtgattaaatacgtttttctagttaaaaaattaatgagtgctttccagcaagcgcttaaagaattaatactggccgggaacggtggctcacgcctgtaatcccaacactttgggaggctgaggtgggtggatcacgaggtcaggaggtcaagaccatcctggctaacatggtgaaaccccgtctctactaaaaatacaaaaacaagattagtggggcgtggtggcgggcacctgtaggcccagctacttgggaggctgaggcaggagaatggcgtgaacccgggaggtggagcttgcagtgagccgagattgcaccactgcactccagcctgggcaggagacagagtaagactccatctcagaaaaaaaaaaaaagaattaatatcaattttccacaaactcttttaaaaaaacagaagaggaggaaacactttccatctgacactgtgaagccactattactctgacaacagaggcagacaaagatatcacaagaaaaggaaactttaggtcactttcacttataaatagagatgcaacaattttgtacaaaatgctagcaagccaaatgcagccacatatacaaagaattgtatattatgactaagtggaatttatccaaacaattcacggttggttttatattaaaaaatcagtcaatataatataacataatagtagaataaaagatcctctcaatacatacataaaaacatgttttaaaaaggtccagcacgctttcttgatgaaaacttttagtaaacttggaacaaagtggcattttctcaactcaataaagggcatctgcaaaaaacccacaaatgacatcataattaatgctgaaagattgagtaccgtccccttaggatcaagaaataagacaaggatattcactctcatcactttaatattctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatctatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagaacttttacaattcaataatgaaaactcatttaaaaaatgagcataagatctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcatttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtagatagagggtggctagtgattgctaatttttttttttttttttgagttaaaaaagtgctataaaattagaatgtagttatggttgtacaattatttgagtatactaaaacagctgtacagtatacataggtagattttatggtatgtgcattatatttcagtaaagttctttaataaattagctaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttgaactcctgggctcaagtaatcctcctatctcagcctccgaagtagctgggactacagccacacaccaccacacctggctcactttcgggtggttgttgttgagatggggtcttgctgtgttgctcaggctggttttgaatactgggctcaagtgattatcctgccttagcctcccaaagtgctggaatttcagaggtgagccactgtgcccagcctcctgttttttttacatgtatatatatatatatatatatacacacacacacacacatatatatatacacacacacatatatatatacacacacatatatatacacatatatacacatatatatacacacatatatatatacacacacacatatatatacacacacatatatatacacacacatatatatatatacatatacacacacacacacacacacacacacacacacacacacacatatattttttttttcttttagatggagtgtctctctgttgcccaggctggggtgcagtgacatgatctctgctcactacaacctctgcctcctgggttcaagtgattctcctgccttagcctcccaagtagctgggattacaggcgtgtgccaccacgctgggctaacttttgtatttttagtagagatgggggtttcaccatgttggtcaggctggtcttgaacttctgacctcgtgatttgcctgcctcagcctcccaaagtgctgagattacaggcgtgagccgccatgcctgcccttatttttatatatcttccataacctttctatctctttctttctctttctctgtttctgtgtgtgtctgtgtctgataataaaatacattaaattttattttataacataaatgttttataaggtcggtagatttgtttatgattttaatggctgcatagtattctatcatatggatatattctaaatgtaataattcctcaatggtatatttagtttactttatatttgctgctttagtttgtcacaaacaccgtggatagccttgtatatatttattttgttgtatagttcttattggtacagtatgatttttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaaattaaatatatacaaaataagggagaatactatgacaggcttccacttacctatctttaggcttctttataaaatgttcatttaatctgatctctataagaaattctgtatccttaaacaacatgtgcccttctctttacacagagcgattacccccttgctatgttttattaacagctagcaagtgctgggtcctgtgtcagttgttttgttttttctttttctttgtttttcttttcttttcttttcttttttttttttgttttttttttttttggagatagagtcttgctctgttggtcaggctggagtgcagtggcatgatcttagctcactgcaacctctgcctcctgggttcaagtgattctccggcctcagcctcctgagtaactgggattacagacatataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagggtatcctatttctacatggtgggaatctagaagacggagaaagaatttctcattcccgaaggagcatggattatccttggttgtagtgtttatgtccacatcacgtggattcccgaaggagcatggattatccttggttgtagtgtttatgtccacatcacatgggatattttatttttcaggcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctctcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaataataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattccttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatcctttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcgg

SEQ ID NO: 1342 - DNA, 325222 bp, Homo sapiens
gctcttccagccagaagaagaggcttagaaccacactctgctccagaaagaaacttagggttcagcgtgccccgctgcatgagcacctgcttcctccagctcacctgaaacgctcttttcccacataaccaagtatcgtgtcgctccaggtcatgccaattctgtccgagggcagaaggggctctgggtggctttgcacgctgtgggcacctgggtttctgctgaagtctgtctggaggactccagagttgtcaacgctgccgctcctgtggggaggtacccagagctgccgaaaaatgcgttctgcctcccgcaaagcaggactccctgcagtgtcccctgtctactagagatgccagaaggacttcatatttaggcagaggagactctttccccaagtcctcatggcttcaaggggccagcctccaactcgcctgcagagattggtggtgcaggggagctggacagagcaggtttggttgtcactggccagagatcctggcagccaaagatcatctaccactggccggtctcagagcggtaacgtccaggcttacttgtccacagcacattcccctctctttccctacggggggactgctgcgctaatggatcagatgtactcagtgtgattcaaattccagaacttctggggagttgtttagaaagctgcttcctggggatcccaggttgttctgtgaatctgctgagaatactggtagcaactagagaatctctcaagaccccgtagaaccctgctattggctttctgtcacttacggaggaaatgaaggcataaaccagctcaggggtttctttatgaccctgtgcctgggagaaaggaaaaagccatctagactaggtcgatttcaagcccggcaagagccctaaacatcagaatactctgttgcatcaaactgtttcagccctttaagaaaaagatacatatgcatatatacaaataatatgcccaagaccggcacatttatgtatctcgatggatcaataaactttggatgtagttatatggtcatgcactcctctgttctgcataactcacagcaatttcataatctcagatcatctcagagttcgtgtggctttcagctctctctctctctctctggcatttaaaaaatcaatgtaatttcaaacacaaacgaagccatcaataatgagcaggtgccatgaggttagcggttagcaggggggagatgtgagcaaccacatcacagggattgttgttattttgaagagcggatgccctagacagcccagccgctgggaaaacagcattctgagttactggcccacattggcttcacaggttatcagtgagtgtcccaactgcctaagtaacatcacctgttctctccagccctccacttctgtaaaggctcaactaggacccagggccacgccttttaaaggcacatggatataaaaaaaggaagaagcagagcctgtcctgggttttaggcaggctaggcccagggcaattctggaggccctctcagtgggagtgaaatgacagctcctgcaggggtgggggcatatttggtggaagcatgcagcaacagtggtgtcaaggcaagtgaaaaggctgcagtggttgcatttggacagacagctctgacctgaagcaatgtgcatggaagcataggcctcgaagaaggcaggccttttggaatcaacgttgggggccactcgtgaacacaggctggagaggggcagagacgtggctgagacgctgaggatgatctgggcaagttggcagcaccaaactgaggcccccctttccttgagcccagggttcgttgaaaagaaaggagcgtagcacctcagcactacctcagctgcctaaggaaactcaccacgggcctccgcagtcccatgtccaaggtacaggccaccatggacctctgagtctcacgtctcttctagcaaccaaacagcaaatcaaatcaccttccctttctctcagtcctttcttccctctgaaaggaaaagaaaataactctcttctttccttaaaggctggcatcatacaatgattttcaaaataacaagtggcttctctctggttctaatacacagaggaagcccccactggcttctgaggatgttcttctgtggcagaaagatttctgaggattcagggggactgccctaggaatactgaaagggcattcctaaagctaaaaggctctgggagcatttccagaaagcttcgatttggggctggaattccaacctgcttagtgcagtaggtagtttggctctttgtagaaatttgtgaacctccagcacggcactgtacacatcatctgaatcctttgacgtgtgctacagtttagaatccagacttggttcactcagtatgtttgggaagggaagaactttttgcacatggaaaaatgaatgagacattttaaaaggctttgctttatgtgaggcagctaagaaattgaaaactcctcccaccaaaaaaataaaaaaaaaaatggcagtcgcatgttttgatttgttttcgagtaaagacccttgtctttggaagccaagactttccagcaaacaacagtataccagactctccaaggaaaccaatcaaccccaaatccccagctattccaggacagcataagtgaattgttctctgggtctgaagacagaggaaaaaggctatggcaaaactgaagctgagcctagaaggaataactgaaataatagaaccatatgtgctggtcacaaggaactttcactgctatttgccttcattttcccacaaaggaagcagaacaaccagtatttgtttgcttcccacaggagcattctctgatggaagccaaagaatttaaagcccttccttcttgtctaaatatttgagaaggaaaggagagtagcttttctggggcagaaagagaactcctttcttgacccacattgagacaactctgttattctgtcctcttggaatcttttaaaatatatccattaatcaaaagagagtggaggaactggatcatattcccttcctccactgcaccttgcacacagtagatgctcaattggtgtttagatttttaaacaggaagcaagcctgatcaccataatacttttatcttcaaagcgctttaccagccatgattacttaatcctcacaacacccctgtgaggtaggtcaaccatattcttcccattttacagaaagagaaattggccctaagagtgacttgacttaggtctgtagaaggatagtcctggattttttacttccaataacatgatctgttcttgagaatgtgcctctcctttctttagatattttctctgagccttttgtttaaaaaaaatgcttaagcacgtcactccgtaaaatcaatttcctctgtttgaaaagaatacgtttttctatttctgccccagagagtataggaaggaatgcctagatggccgctaatgttctcctcccgcatacttctggaagccttcctcttcgtcaccattcttcctacccatctactgagtcctgttgttccccgtggctccatgtgtccatcttcaaagttcttgttctcaaatttgggacagttcattcaccatccatcccagtcaaaagcgggtgctgatgagaacggagaatcaggtatgaggtctcatgtattctctccttttgttactatcagaaataccttgtggaaataaaccatcccagcaggacttgacctatccacagaacagtcagatgcacggtcaagcacaagtcattcgtgaattccagactatgatctcgtcccttgtgctgtcaaaacaataatattaacctcagagagcagggtcagagcaggagggaaaggagttctggtcagggctccgctaggaatgagcaggaggcgttggcagcagccaccgagacctgctcatgcgagctccatctcatttagggacagttccaggaggggcatttttttcttggtgagaatttctatatcaaaatacacctgaactccaaggaaaaggccagagccaggttgactgatgcagaacagttgaagcttctggaatttttctttccaagaaggttctcggagctgatagaaaatcagcctcacggctggcccccctggaaccccagtgcctcctgggctcccacctgccctcactccaggttaggtcctaagaaaagcagaggctctcaggacaggtctgtgttcttgctcagagtgtatcttggtatttgaattgataacagtcaaaccatagtcaaaagaaaaaaaaaaggaaagaaaaagaaattcaatgtgacatttccaattcgaattataagaaaaaaaataccttgttttagaaaaaaaaattagtgctattctccagccctgtttgtctctgaatccttgcctgcaggttccgctcaaagcacacaagggagggaagaaaacccaccattgggacccacattttggcagatggaacaattgtttaaaaagaaaaagattcggtgtttttctttttctgtactctgcagagagggaaagaggtgagtccatttgatgaggtgagcatcaagattgaaaaagattgtaaggaagaacaaaggtgagagagatttcctgaagagcttgcaaccaccttaaaaacagtctctaaatactctccattcactcctcttgtctgcccaaagcgcaatgaatatcagtgttcaaatgcatccttccatatattctctgataccttaggaagaattaacatcaggagatttggtgttagaattacaagtggccagctcaagataggtgaccaagggtcacctgaccagggtaccactgacctgggttcacagtgctatgaagtctctaagaactacaggtatgtgagactcctccctgtcccgctgtgctccctgttcatcctgtggcttccaggtgccactgcccctggaaaacactctctcctcctgtggttccatttcccaagaaatgaggtcaccactttttctcatatgacagctttgctataggcaacaatgacgaatcctccaagcatccctgagcaggagagaagaaagaggttggccttctttctctccactttacagatggagaaaccaaggcaccgagaggtgaagtgagttatccacgatcacagtggggaccgtgaatcagcctgtgacatttcctgatctttctgggtctaaaggaaagcccctaggaagtctgtagctaaaacaaatctcccgggcccactctagcccaaggatcccagagctatgttgaagatggacaaacagaccaggggagctcatctaacagatgatgggttgtctgtatccgccgtgacagatggccaaatgtgcttatagagggatgtgcactgggttaccaattggcactatactaaagggaaattatttctttgtcctcattggtttgagaatgatttttagcagtagttggggtcctaggatttgtgttagggattcacaagggcagcatctcctcctgggacctgcgcactgtgctgcatgtgatgggccagcctggggcaggtgtccctaggtcctgcctgctcatttccgatgtggtctattcttagcccttgacacaaggtgttggccaagagcagggggaactcccacagtggtccgtctgctgccctcgggagttgtcattaatagcactcacgacctttgtctccaggatatatcagccatggcctgccagccagtgcaaggaaagccacaggagtaaggagcagatggtgccagggagagctgaacaaggcagacaggaccaggcgagccaaggaaggagtctgcagcaggatcaaggcagcacctttgtcttctgatatttggccatcagcacaagatgcagtgtttcagcaagaagtgaaatgtttagaatagctaagaatgggtgagaaaggggcttgtgttgccactgcaagaattcagatcaagcatcatcctttttttccccagtgaagagggatagaaaaaaatctctgggagggtagagttgcctttttgcctttttacatgttttgaaattggaacagacgcacattgattgaggatgccgggggaagtcctcttgcaagctcatgggtttgtaacctgtgattggctggcccctgccatttccatgttctggaggttgaactgtgggtgagaatggaatgttgcttctacgacaatgggcagtttgggctgaggagaaagggacagaagtttaaagagtttcccattgtgctcatctcgttctcagccggatcttgataagaggaaccaacatcgatttatgttcacttcctaaggggtaactgtgttgtgcttgatgagcgggtctgcccaacagggtctagtgacgaataaatatttgagagagaaatgaatagaactgctccctgtaaggctggtccagcccctggggtgagcccacccctctgggtccttccatttcactcctgcagggtcttccccaggtctcctttaagctcctccagatttccccgatggtttcctagtcaacaaagatagtatcacatggattttggtgaaattaattgcaataagctctcttctttttacagtatccaaatttaaatctcaacctccccaaccaaatctgattgtgttaatatttttcagtttggcaaagaaaaaatagattttatcttcttggtaagaaaatcaaattaaaggtacacaaggagattcccctccttcaatcatgaagccaccatccagagcagctgtcatcacacatacaaggcctggaagggctcgttttgagtaaggagccacttttcttggcaaagaaaatgctaccatctgtgccaaacgaatgctaggtgacatccccaacccagctcatccgagcgagccaggagcatgagaatatggcctgcctcattctcttctgggagctgatatcctttgctccaagccaaaggctctgagcctgcacactgtcttgctcttcttgctctgtccctggatcatggagagaggaccctgtgctaaggtctgggggcatcaaagcttggggttggttctagccctcccatgagcaaggagcagaccagatgggagaaggaaggtggtgtttcctctatctagcttgcggagactgcgaaggggtttagatgtgcaagaacaagcaaggctgtggcccacccagtgcagcttcaaaccagatccacatcagagaccttcttttctgcccctatgactgtgcagtgggagggaataaaactggaagaagaatggagaaaatgatgtaatttggtgcttttctaaaacctgtaaattctttctgagaatcaggctcatatctggacagggtcagacatctgtggcatgagatgcccccgagccaggggaatcaccttcatgaccacgggccagacaggatcatgggactcagaggggccacggctggggagggactgggttagagccatgagaaccatcgggtcttgaatgattctgtgcctggggaggtgtggtgtgggggatccccaggccatggggaaatgtcgtcttccctgcccaaggctgtgttgtgacggcggcatgtctgggcaagggagatggcgcctctttcgttctggccgcagatctgcttgggtgagtgtcctaccagtatcctggtacccatgttgctgggacaagcccgaccctgcagaaccaggtgacaccttccagaggcagagtgcaggagagtgttagagacacgggaagctttagggtgagtgaggccagagggggttgatctgatggactgaagcctccctagcacccctcatcatggccttaagagacagggagctcccattccggatgtcacaggcttcaggcagtgaactcagggcacattatcctaatgtcatctgaggggactgaagtttccttttacacagaggctgggagaagaggcagacctgctgagcaagggagaagcagagtttgcagaaacgactctaacaccattagttatagtttagcgatactaccaaatttctgggaagaaaaagtaaaagccaaatgttctacgtggttagaggaataaaatacgggtcttagtgggcatacttgatgggggggtcattagggaatgaaaaggagatagtttttgtattctccatctctgggcaccaacgtgcttaccaggcctaaatactggaaatggattatttttcatcagggggtcctgggaaagaaatgggcccagagatttaaaatttttaaaaaacctaaaaacatcacaggcattcctctgggaagcaactgaagcagcagccctagagggttgtcaaggactgaggcaaatgaaaaatatgggacattgggcatttaatgtccaatgtgggacaaagagtgaccctgtcacggggcggccttaaggatccgggctttcaggaccaaagtcatctgggtctggagacacattccccaggtggtctcagcactgagtgtgtatggaatcctgcctggatgcccaggaccagtcactggaaggggaagggcctggggggaagagaagaccccaggggagatgaggccagagagttttacggtggctgggagtgtggggagctgctagaggctgatgacaagaggacactgaggacagctctggcctggtccttgccatcaggtctcccctgccccttccctgccttgctctctacttctttccttgcttttcttccttttcctgcatctctgcaaaaccagctttccctgctgctgctcacagatgcatattttcattttctttgtgaagaaagtactggcatgatggaggggttccagagaggggcgagggtgccttttcaagtgagaagtgtgaaattaaagattgctgaaatgtcccgtgatctcctcatttgttcctagtggctaagaccctggaggccctccctgatttggaagttgccatcccaactcctggtgctcccggtcagctcagcatccaccgttctctttgtaagttgcatgtaaacgtggcaggatgcacacacacggacacacacacactaagtgtgcaagagtgaaatagaggtggtgaattaaaacccgtgactgcgctgaaacaaaaagaaagaagaaagaaagaaatccaagaacagacacacaagcaaaagtggcagaagtcccgaggggatgcatgagggcatttcaaggaagatgcgcaaaggacagacatgggccagttccaggtgcacagagccccagacctgaagcagacaagaggtgggacccccccagctaaagcggatgccccaccctccaatggcctcaccttcccagcctagcagagtacactgtgcagctcaggcgtgaagcccttgcaaggcagcacgctggtgcggttcagaaaagtgcctctgactagattccaactcccaggtgactctccaggggcccacgggcgggtccctttaatgggcgcgccgagccctcctggctggttttcactgctgcctgcgtgtgctctgttcgtcctgcttcctagagttgggggctcctcctccacctgcccaccagtgaggcccgaggggacccccgagtcagggacggggagaggacagcaccacgatgcttagtaaggacgcatgaagtctaggaagtccagacaaagaagagagcatagagtttcacaactgatatttgaaacttgttcttaaaacaaaaaaggttttagataaacaatgaaggtggtgggaaggagaagcctcgctgaataataattgttttttatttaaaaaaaaacaaaactccacaaacatttaaaaaaccctcagttattgaacttctgttgagaatagttcaacgtgaggtcttgcaccctaaacaggtatatatttgggaaaaaaaatcgcagctacacacagcaaagactaacagtatttacttaaaaatattgtgtgtgtttatatatatatatatatatatacttattatatatcttttttgtgattttttttcttttcctttttttttgtgcccaagtagagatacgatgcgattgaaacgatgccctagaacagaaatattctttaaaggaacaatactttgaaaaataaaaaaaaatttaaatcgttgaacatacttgcaacacctgcagaaattcaacttgatacaatgagaaaataaacagtggaatcaaatcctcacccaaatggcatggcctctaaggcctgcagtccgctgctggtgtgagtcttgccacccaaaccagggctcgtgggcaggcagcatcacttccccaccactccagagcccccgcccccatgctctgctgaaccaagccgtgatccaagttcgtcttacatcagttttgtatatctctggcaagactttgcagcagggacacacacatatatacgtgtgctatgggcacacacacacatacacacacaaacacacacatactacacacacaaaatttcccattcaacccagatgcaccaggtgagctgaatgattttcagccaaccacaatggtgaaagacagaagcaccaaacagtctttgaaatgggtcagttattacaattttgactttttatatatatgtatatatatatatatattctagttttcctctttgtgttatttttttttttaaaaaagcacaaatgaaaaatgaagaattctttccagatcaatttaaggcttcccaccaaatggaaacagaagaggctttacacaatatcacatgtgataaatgtctaccattcacagccttaaaatgatggaactaatcgttgttgccagtcactgattaagtattgtgcctttaaactgatgtcgttctttttgctactatgctgagttttattattactgactatgtgtacagaaatctcctttaatttgctttagaatatcctgtccttaccgaattattgcggtggctttttgttttgttctggtttgcttttcactgggaaacgaatgtgattcttgctaggcaaatgctaaaatggcacataatcagccttcaagtagcttctccagccatttgagtttcaaacagcccttgagctcctagaaggctctgcaaagtggggagaaggtcaggagaggagggggagaaactgaaaagagggaggggtttatgcttttgcttttggtaaatttgttttcttcaatacaaataatcagataggaagaataattgctttgtgttgtatttgttggttggtttttgtttcacttttagatttgtttcatttaattgtttaattttccctcttctggtgcaaaaatcaccagagagttttgcatgagaaaacgtgacagtacttaatgaaactcagcacctaagggcataaggcagttgaaggttttttgtttgtttgtgtttgttttgttttgttttgttctttcaatcagcaccaatcccataaatgatctacacttggtgtaaggtaaaaaactttttttttttcttttggagtggagataactcctccttctccaccctatgaaccatagcgtgggatttttcaatactgtttcttatgtgtaaaaaacaaaagaaaggttttctttttgtttttacttacaaaacatagagaatatctttgtatacatacagcgactggaaagaaagcttatttgaaggggttgtgacttattaattcttttttttttgtagtggtggtgttggtgtggcggtgttggtggtggtggcggtggttctgtgtattgggggaagggagggttatatttcttgcaagtgctgtttgccgcaaaccaaacttaaggtccccttctcaacttggtcaagatgctcttagagtgaagactcatactgtagcaactcatagaggagtggtccgtctcgatatcgaatgcctactgcggtgggggtgacatattgtagaatgttaatagtccttctcagcctcctgtctacaaaatgagcatcccaagctgggtatcgctttcttggcatgtcaatcttaatgaggggcccttctgggaggtaaggacgccccaacggggtagggggccccatgggtctcacttggaaaacaggcaagcaagtgtcagccgtgagatcctcctgttgttccgttacggctctggtgggcgtaacctgggtcccccggtacccagggatctcaggcgccatgggctcaacatcggggggcaaagggatgccccagagcagctcggcacaacaggagctggcaaggatcttagctcgtggtcctgtgggatgcagcacgccatagtataagagcatcattgcgatcccagccacaaagctaataaagacacaacacagtgctggcaccgcataggagtcagtggtctccgggtctctgtaaaaataccaaaggaacgtcaaggcagcattctcggtcaagactatcgtataatatgcaaacattcgatatcgagtccgcccttccttgacgttaaaccagcagaaaatgtacacgatccctaccaccatgttgaagaggatctcctcccacttggacatgcagaagtctgttccgccatggatgatccagaaggccatggcgcaccagtgaaccaccacgaagatcccaaaatagagctggaagatggaagcaaagagggcaaaagagatcactcgggatgagatggtgaagaggcgccagaagacctggatgatggcccctctgtagctcatgctcttcttgtcgtccctggagtcccgcagcagcttgtgataggaggctagcacccaagccagggacatcagggaagtcacagaggagacacctgccggaaagacacaaacccacacagtcaaaaccttggacatcaaccgcagggcacagtgaagctgccggctgaggagacgcccacatacaccacgatctaaaggaggagggagaaagaaacacagaatcaggaaccgaacttggaggtcacagctgctccctacgctgacaacttgggagatggagcttttgtttcaacaaccccatttgccattttgggagctcagtagctcaagggtgatactgagccagtgtgttttgctagggggctgagaggtggggccacgtctgccatgggcagccctttgtgggttccgccttaaggaatcatgcgattcttgtggcacacagatgtgcggctggcattggcgtcgctgtcaccagcagcctgtgctctcagagaagcccacaggaggaatcgccaattgtgaagaccaagggtttacccaccgccctgaattccacactgttctcctctgaggtgctggaatcatgcttctgccttttcctcacctcactcaaagtcccaaaaggccctttcctgaaccttcttccagttagcttctccctgacctgccacccaaggccaacaagatccaggacactgggatatcccgcccatttcacagacttcctctctcacccactctggtcttttcggcctctccacaatccctgttgctttttccaaccgactgctgctcaatgtgctcttaagccttgacttttgaagctctgtccttctctggttgccctctgggttcaacatggtatcacttgggctttgggggtgcctcttccccttactggttttctgaggcttccaaggcctctgcactttactccctgcatttcctcccacaacgggcaaatattcacagagtttgagtgtgcctaatcccaagtcatactcatattgccatagaacaattttatatccaactctgactacttgatatttgcaagtaaaccaaatgaaacacaatccattgttactgaagtctccccaaatccacccatgaacaaccagtcattattcgagtgctgtcatacaatctccgtttaagcaagatttcccccatcaccaacccccaactccccgtgcatcagttccacagtccatctggggcctcttttgctggtcttttctcccaaaatttcacaactaaatgtaagtaaatgcaacaggaggccgaatgctgtcccactggcaacgacctccttaggaaagctttaccctcccacggagcacaattccccccacgacattcttccaggttgaaatcaaggttacccagtgattttctcccttaagctcaaagatcagatacagaagccccattcatcaagacactggttaaacttccccagaccaccaggcttctgctcgtctctccccgggacctgcccaactccccacaactctccgaagcccgatgaagaatccgagttctctgccacgtgacactctcccagcactggctctgcgtcacccgtctcacaaaggtcccctccttccatcatgtcacatgaagctcagagtcctagcttgcagaacagtatggtgcaataaaaaaacctgttaactgttacaatgggcatgtgtgactctttcatagtaataacaaccatggagatttgaaacaaacaggggcaacacgatcccaagttctccatggaaatctatctggaaaacatccaaagagcattcatggcaattttccttttcttttctagaaagttctgaacatgacacatgtcctgcctcacttgtggtacacacaagacatctcatgtgtgtctgcagtggctgcacatggttggtcagggaaccttttagtgctcacattgtctgttagggtgcagcagggagaactccccttaggagtaatgtgatgtaggttgcagatttctggagggcagaggatgtgcaattacctttttttttttttttgagacagggttttaccctgtcgctcaggctggagtgcagaggcataatcattgctcactgaagcctcaacctcctgtgctcaagtgatcctcccgtctcccatacatgggaccgcaggcatgctccagtgagcccagctaagatttttatttttattttttgtagagacagagtttctacttcttttttttttttttttttaagatggagtcccactctgtcacccaggctggagtgcagtggcatgatctccactcattgtgacctccacttgccaggttcaagtgattctcctgcctcagcctccagagtagctgggactacaggtgcacaccaccatgcctgggtaatttttgtatttttagtagagacaggatttcaccatgttggccaggctggtcttgaactcctgacctcaagtgatctgcccaccttggcctcccaatgtgctggaattacaggcatgagccactgtacccagcctagagacagagtttcaacacattgcccaggctgatctcgaactcttggctcaaacaatcctcccactttgacctcccaaagtgctgggattacaggcatgagtcaccacgccttgctgaaatcacatcttcatagtctggaccaggctattcccagcactgaagcaccctcaaaaaattccattaaacatcctcatgacatccttgctctccagctgaattcactgcttgatgttaatcatgaacatctggtaggtcctaccgacccatagtaatcagatgggagttctatgggagctgggtgggaagaaggcttgattgttgtgttccttctaataaagcaaactctattaccttctactcagaaaagcgtgagtgctgagctcataaagcaagaaggagcagcttagcttctgctggggcctggtcagatccagtccagttctaagcatgctttgagcagacttggggtgcagagttaggatcaccctcagacttcgctgttctgattttgttgttctctgtgctgtgacattggccccgttcacaccaataatgaataaatgggaattcaaatgctcatcagccaccagttgcaaagccaaatagaattcttctccattcttctgccttcagagttacctaccccatttccaggtgtgtcgctgtggttttgaaggcgggtgttctgttcctgcaactcccttcatggcagtggtgctgaaactactcttgtttcagccgaccaggcactgcagttgcggcttctagaatttcgcccaagggtactgcacagacattcctcagtgttgcaagacatcactgctaacttacaaggagggcttgggaaatggtcccatggaagactgtgattccaggcatctgactggggagtctgctggcgagctaatggccagcccagttttaagtctctgcttcatctgttcctgacttggtcaacttatgaatggccaaaccttctatctaggggagcttcccagaccatccacttcaacccacccattccacaggaagcagaggtgcaggggcttgggtggcttgctcaagactgtcctgagaaccaccggccatctctatgaggatggcatgcttcctgccatgtcgcgctgctcccactctccatcctttctccgtctggtccctctgtcagttcagctttccagatatccagcaggcaacacctttctcaagatcctttgtactaaaggtcatcagccttctccaatggtgggagcctgttctggtgcccagccattggctcttcagggttcgaacgccaggccatatccttgacactgtgaaatgctccaaatagtgaaaggagaaggtgaacttccaccaactgcccaagaccaagaagaacacctctgaccacacagagcaatggggagtgggtgtacaggcctcgtgcccctgatgtgcctgcccctctctctctgccagcaacaggggcgagaatgatcctgcaaggaggggacttgcctgggggaggtcaaaactcttacccccatcactttctaatctacctcatcaccaaagtattccccattctatccaaggctctgggcacattttttgggaccggagttggtacagctagtgggctgagtcaatccctgagaagagaccaggaaagccaggctcacttcaggaccccgtttgggaacaggtttctactggatgctcaacagagggtagcccttgccctggtgggactcaaaaacctgtgatggagtgcatcgatgaacatgtcttcagcctgccccccaggaactcatctggacctgtctgtgacattgtctacgtcgttatgtttggccaagggaccaaatgttcatggctcagccacttctgcatcttttccctgaacaagtcctgcagcccccacaggactgtcgctgcaattcttcctcagagggccatcagcgaagggtgccttgaggacagcctgtgaattctggggactcaacaggggcaggagatgggaagccaggacagaagatgcacttcttgctctgaaccctccccaactgtgcacctggttgtcccggagaacttggcaggattcactgagcatctacatgcattttcttattgagaagggcctggggaggtaggtgctaagttgtgtcccccccacaaaatccatatgctgaagctctaacccctaggacctcagaatgtggctgtgtttagagatagggcctttaaagaggtgattaaggtaaaacgaggccgttagggtgggccctaaccctgtgtgactgggtccttctaaggagtggaaattaggacacaggtacacacacagggggatgaccacatgaggacacagcaagaagacaggcgtctacaatccaaggagggaggcctcaggagagacttctcagaccagtagcaccttgatctgcagtgctctgtgaccgcagcctgagcagacgtacaccgtgcggacagaactgtgcacagccaccgccgagtgattcatcttcaaagcttgctgtgtgttctgttacagaaggagtgagtacaggttcttccttctctgcagtggctcacttggagaatttccgtcttgtctgaagtcaactcaaaagtcaatgcgttctcctaggtaacacccaagcacacaggaaccggccgtggaagcccccagtgaaattcctggacaggcctggcagcctccacggttcccttccgcttccagctccatcactgactgcattccgaagatcagactagaaattgttacacgcttcacgtttggctgtgacgagctctgagcagtgaccttcacagctccctttccctggtgcagaccaggaggcagcgctggcagcatgcccactgcgctgaccttagtgcagtgccactggctgggaagtctctgggccagagttcctgaggctggggggctggggaagggcaactccccagagaaaggcttggagaaagggcctttgggctctgatcaccagccctggggtctcaggttccagaaatggaacggccacatcttatgaccgatgacacagagccagaaaggcagtcatcagggaacgtcctgttttgtgttttcaattcccaggggtcatagccagttggggaacaaagcaacacgtgtggatatgggtgccctactgaatgagaagcacagtgacagggcgtcttgcaaaggatgagatcctagaacctggagggagcaggtgaggcaggagagcaaggaggtgccacggaaggggtcaggccaggaagggaggctgtgaccgggatgggccagggtggagctgcatcagggggccagcatatgggagccccgacacatctccaataagggaacctgaaggaggaaacaatgtccagagctccctgtaggctgaacacagcacctgggggaaggcatgctccagaaagccacaggagtgcctagagatggtcaccaactgcccctgagccagagctgggctcaactgcaggaatgtgttttgcagaatgggaggtgcaggcccagccctgcctcaccctctctctgaccgagagcgtcagctcagccccaccgctaagtcatgtgtcggaaacacacttgatgatgagggacctaagcatgaggcaggacagaagtggaaagagtcagctgtgtgcagctccccagatcccagcttcctgactctttcctccccagctccttcttcctggcttgttcccatcagcgggtagccagggtcaaggttctcccatttacacagcatggtccctggaccctgcatcctctcctgaagctgtccctcctctccttgtctcatcttctccaagcttcccgaaggcaggccacttgccctcctcactctcccaccacctgctttcctcccaaatctgccccagtggagagctgtcactcaggtcgtgcggcattcggaggactgcttccgtgcttctcctcctggctctgtgtgacagtcgggattgggatctgctctgtccttcttcacaccccacccttagctgttccccagttctcttcctgccatttcttgagctctttatggcagccttttcctgccaggtttcttatccccatattgtagatgaggagaccgaaacagcagtgaagagacgtggatgtggccacagccatatcctgacatttgcatgctcacctaacttgtatggcattgtaccccagtaggctgggcctctagagatgccccagacaggacacaggcttagctggttatctgtcagtctgcatatcaaggacaacatctccctctttcaaccctggccccctccctgcctccctccctcctggggaagctaacatttgggggatctccaccatctgcttttcaaattcctattttgtatttttcccacaatgagtccttttagacagcaattcttccccttccatctgtcaaacttccctctgtcttcccacattttaaaaaagtccagtctcttcttggaaatgttcccaggaaaggataaggcagctgtgtccaccgcctctctaagcataacccactgtctcccgtcctcgccttcccacaggagacatggcaagggagtgatgtgacaaaggtactttcctatttgggcaatgaagagggaagaaaacaagcatcctgatgacttctatgagccaggctcaaagccgttaaataacccacccaaggccacacagctagtaagcaagagagctcatactgaaacccgagactatttcactccccagaatctggatctgcatgtgctggagctggccaattcttaaactgtaggctgcctgatgtcatgttgcgggcttgaaattggcatggtgggagtatttacaccacagcaattggcaaatggtacaaaccagagctccaccaaatcctgctaaatgttggttgttaaacatttaccagcacaccaccggtcaggatcagccatccttcttgaaaagcttggtgggtgtctatgcaaattagaagggcctgtctccaaattcagtgcctactctacattcagtgctgtactcctagatgtggtcttcacatgcagggcactacctggttatcagtcagaattaaataccttagtgctaatgagaaagcaacaaaaaaagcaatcttcttttaaaacttttgctgaaaatatgtacacaggaaataatatgctggtgaaaagtaattgcggttttgccattgtaatggcaaataatttcaggtctaacaggttgctttgtgcacagtctttcataagcactgacatactcattttcattacatttctgtacttgaagagggtgtgatccagatgtgaggtttccacaaggagtcactttaatgcatctctgacatctccagatggacccttaagaagggtcaaagaggctgggcgtggtggctcacgcttgtaatcccagcactttgggaggctgaggcaggtggatcacaaggtcaggagattgagaccatcctatactggccaacatggtgaaaccatgtatttagtctccactaaaatacaaaaacacaattagctgagtgtggtggcaagtgcccatagtcctagctactctggaggctgagacaggggaatcgtttgaacctgggaggtggaggttgcagtgagcagggatcacaccactgcactccagcctggcaacagagcaagactccatctcagaaaaaaaaaagaaaaagaagaagaagaagggtcaaagagaagagacggcaatcacatttgtggccctagccctcaggactgacaaatatgtggccgaggagatcaggaaaaacccaagactgatcgaagtgatctggtgtaaacataagaaaggaggatttggatatctcaggaaagccaaaatctgagcgatcacaccatcctctggctggacaaaaagctctttaacgtaagtgagtgggccaagggagaaagaatatcaggtcttaccatggtttctatgaaagatctcttttttttgcctctgacttcatgcatatcatgtcatctgctagtttctagtaagttcaataacagtgatatcttccctctactgaacagccaccttgacccagactctatgctaggcactgcacataactcaattgttatgttaactcaattattcttccttaccatgctatcagcagcagcagactgatttcaagatgaagacactgaggcttacaggctaattaagtaacttttccacatgaagcagttaaaaagttgtagaactagaatttgaatataggcttgtctgaatccaaaactcagattattttctgaaccactgggaaagatctctctccatcctcaaccacaaattaaagaattatcattgaggcttatacatcagtttcttattaatttggttaacatatgtcagccctctgatcacctctgtgagcattgacaaagtcaaatttgtgggtctacacagccgaggacccaccccgcggaggccctgcctgagtgttcaagccactgcaaagctgatgacacttctgttccatctctcttgcctgaattgccggaatggcctcctaactggtctctctgcatctgccctcctcccaacactctatccacactacagcagccaacatgattaagctacaatgtttccctccgcgtggcttccagtgcctggtggaccatcaagagtcactgattttcaacgccttttgcgtgggaggatgtacacgcccacgctgctggattgaggtgtggctgagacttgctctggccaggcacgtgagcagaagggatgtgtggccctgccgggcagaagactgtgctcacccatgctccaggaagaggctgctccacagggacccttgactcacatgcaacgagcatgaaggaaatcgaaaatgctcaaggccactggaactgtgtaggtattgtaaactgcagcacggccagcctgtcctcactgatgtgctaagtcaccccaggtaaaagctacagtccttagaagggccggcagggctgccctgccataaacatatatatatatatatggagtcacccgtggaaccagcctgcttccccctcccaggaatctctgcctccaatgggtgagctgttcttaaatctaatctgtcaagtcccctttgccctccctggggtcctctcctgctggctcctcagacatgctccagccgcacttgctacttcctctgcctggaatgctcttcttccagtatcgctatgttgttacacaaatgtcaccttctcaccaagacctttatgcaacgatcagcttctcagccaggccctccccgaccaccacacttaaaactgcaactccctgccatggtttgaatgtgtcccccaaaaattcatatggtgggaacttaatcaccattacagcattgtgttaagaggtggggccttcaagaggtggttaggccatgagggctctgcctcctgaatggattggtgcagttaacacagaagtgggttgtttatccagggagtgggttcctgacttttaaaaagtagtttggactgggcacggtggctcacgcctgtaatcccagaactttgggaggccgaggtgggcagatcacttgaggtcaggagtttgagactagcctagccaacatggcgaaaccgcatctctactaaaaatacaaaaatttagccgggtgtggtggcacgcacctgtagtcccagctacttgggaggctgaggcaggagaattgtttgaactggggaggtggaggttgcagtgagctgagattgcgccactgcactccagcctggatgacagagcaagactctgtctcaaaaaaaaaaaaaaatagtttggcctgagctctgtctctctctctctctttccccgctcttgctatgttaagacacagcaaagaggctctcaccagatgcagcttctcaatcttcagcttctcagcttccaaaaccatgagccaaatacgcttctattcttcataaattacccagtctgttgtattatagcagcagaaaatggactaagatacccctcaagactgcctcatgccttcttgctttttttccaccatagcattttgcaccatcttgatcaacttttctcctgcttttggttttttatttctactatgttccatggtgaatgctagctccctaagggcagagcagggatttggtttggtacttctggaattacatgcaaaactgtgtgggtatttttctcatgaatgagtccacagctattcttggattcttaagtaggcaaacaagggaagggatcataatccccattgctagccgccatgatctcccacaatgctctccaaacacgggaaagggagttccttgggagcatttatgcctttgtcatttaggaagaaaaccttggggttaaacacagggaagaaaaggaattcacatttactgaatgtttcagtgcgtcagacattatgtatgccagactctgtgcatatgttatttcattgaatttaatgggacaataatcccatgagaatgcctgtcagtgtccctatttttcagaggaaggaattgaggctcagggaggtaaaagaatttgcctaagcttacagtattaagcaagtctttttattctgaggctttcacatctcggggggctggggggacctttttcagtttacaacacccagaatcacccatttaactaacagcaatgcaatgattcttaaccagggtgattttggcctctaggggacatttgtcgacatctggagacatttttgattgtcacaactcggggtgcaggtgctgctggcatctggcaggtagaggccagggatactgctaaatactgcaatgctctggaaagcccctcacaacaaagaatgacttggccccaaatataatcgcgctgaggttgaaactgtgatagggtatttcctcaatgttctaaatcaattaaaaaatagacaggaacttggctgtgcctaataactgaagatttagatcttccaaagaattccccctgagaagtggtgggtatcctaacgggcctggaggtacagatgcagggaccttcggaaggccatgaggactgcatctctccagctctgataaagagtggatgactggttcctaaagaacctatagttcctaaagaaagagccaccaccgcaatcttcagcactggtcccaaatgcatttcttctacagctgcaggaaagacgacatgtgagaaacaccactgtggctctcctggaccctgggctcttctgagcagctggctgggggctggcggccactctgggaatatggtggacaacagggaagtaccagacctcccctcaaggagttccaaggtcaaacaccagggtttaaagggcccaggaggaggaacgctaaatccagccccctgcttcacttgtctgttctttttaagattctgtcagggatctcaaaataccagcttcacagccagctgcataaaggcaaactttagagattctagaacaaatgtcagccacccagctggcatggcacaaggctcaagggtgcctggatcctggctggcctggagcaaactgtggagatggccgtctgctttccctggagagtgccaggaaatccattctcattgaggagcaacagcccaccaggcacaatgccctgttgctcccagaagtggctgtgttttgacagaggcagtgagatgctctggaaaggacacaggttccgtacaaacagctggcttgggtccagccatgtggacctgggcaaatgcactgactctctccaagcctcagtttactgtttgtgagccgtgggtaaaaacatggattttgagtatatatacatatagagagagggtgtgcgtgtgtgtgtgtgtgtgtgtgtgtgtgtgtgtgtgtgtatagagagagagagagagacagaatatgtatatatatagagagagggtgagattgtatatatatgtgtagagagagagggtgagtatatatatatatatatatgtgtgtgtgtgtgtgtatatatatatatatagacagagagggagaatatgtatataaatacagagaatgagattgtataaaaatatgtatatatagagggtaagtatacatatatagagagagaatatgtatgtgtatatatatatatagagagagagggtgagattgtatatatatatgtagaaagagagggggtgaatatatatatatagagagaatatctatatatatatagagagagagaggaagagagagggtgagattgcacatatatatgtagacagagagggggtgagtatatatatatagaatatatatatatctataaagagaaaaagagagggtgagtatatatatacacatgtagagagagagagagtgaggggtgtgtgtatatagagagggcaagtgtgtatatatatataaataaaaagagaggtgtgtatatatagagacaatgtatgtatatatacagagggtgagtatgtgtatatatagaaagggagggtgtgtgtatacgtgtttgtatatatagaaggtgtgtatatatatagagagaataggtatatatagagagggagggtgagactgtatacatatatgtagagagagaggttgagtttacacatatatatggagaaagagagagaatatatatatatatagagagagagagcaagagagggtgagtatatatacacacatatttatgcagagaaaggacgtgtatacatagagagggtaagtatatatatctgtgtgtgtgtatatatatagagagagagcgctagagagaggtgtatatatagagagagtatatgtatatatatagagggtatgtgtatatatagagtgggatggtgtgtgtgtgtatatatacagagagagagagggagagagagagggtgtgtgtgtatatatatacagagagaaatggtgtgtatatacatatataaagagagggtgtatatatatatatatatatatatatatatatatatatggagagagagagagagagggtgattatatatagagagaaggtgagtatacatatatatatataaagagagtgagcatatatatatgagagacgataggtgagtgtatatatatatatatatatagagagagagagagagagagagacagggtgtgtatgtgtgtgtatatacatagagagagtgagtatatatagagaaagagagagggtgtgtgtgtatgtatatatatgtgtgtgtgcatatatatatgtagagagagagaaagagggtgtgtgagtatatatatgtaaagagagaaagagggtgtctatatgtgtgtctatatatatagagagggtgagtgtatatatatatatatatatacacacatagagagaatgagtgtatatgcacatatatagagagagagagacggtgagtatatataaagagggtgtgtatgtgtgcatatatatagagagagaggcgagtatatatacatatatatatatagagagagaaagagatagggtgtgtgtatagatagagagaaagagggtgtgtgtgtttatatataaagagagggcgagtatatctatatgtagagagtgtatatatctatagagggcgagtacatctgtagagagaagatgagtgtatatacacatacatatatatatatatacagagagagaggagagaaagggtgtgtgtgcttgtatatatatatagtatatatctatatagagaaggtgagtatatctatatatagagagagagtatatatatagagggtgtgtatgtatgtcatcttttctgtgtatgtatatgtgtgtgtgtgtgtatatagtctctatatttatactcaatatatatttgaaattacattgttcatatacttgttcattgcctgcctccactaaaatgtaagccccaggacagagatccatctgcctttttcgcctctgtacccccagagtctggccagggtccccagcatcctctgtgaggagattaggcaggtagggttatttcaatttataaggtgaaaatgaggctcacagaggttaaccgttgccttgccccttagccaggtactcagccgtgagtgccctgggagacacagcctgccaggtgaaagcacttcactcagccaaagccttgataaggatggaggccatatgcaccccccagccatcgctgttgggtgcttcctttctgccaagagcagatgtcatcacttctgcctcctaacacccctctgcgatagaagagatcaccagtgtttacaaacacgatcactgcagctcagggatggggagggacctgccccggtgcactcagccgtcgatgcagatgcggaccaggtgtgcaaagccaggcccctttggcccccactagggacttcacgtggtgttcaagggaggcaccttttctcccaggtgacaggaaggctgcagaggttcccgataagcagagaaggacccaaagtccttggtgactgctagtgagggtgacgggtgtggaaaaggatggggtcccagcagcagcacgaggcaggaggacctgcgacgggggccccatgattatgttgcagataacaggtttcagaagccagcagcagggcttggcagcctggggtgcaagaggctgggaatgcagtcaggactctcctttggtcaggtccgggcccaaatcttgcctcgggatggcccttgggcaaattccagacccctggaactcctcttggcgttctgaccaacctaacacctcagactggttcaggattgaatgggtctatgggtgtaagcttcccagatgaaaaaggtgaggctcagagagtgccccccacccagcccactgccgtaatcactgtaaccgccgcaaccatgcttcccggtcttagcaaggcagggggtgggacagctcactgggagtcactctggtgtccctttcggagcctcttcctgagtatatacagtatatactggggatgagtagtgcatccccagtagtgagagggacataaacaagaagatagtattcgtgaaactcctgggctttccttgctgagattcgtaaagaatgggaaagatcttttggagatcatttagctgtagtctttcctgcagctggaagctcccacgaggtctcaggttcttgatggcctctgacgtgatgtctaataattaaggacccctgctgcctacaacttactgtgactcccccaatgctcctcctccttaggctacagctgaaatgggcttcaggaggctcttctgtctccttgcatgtttctgggacccagagaagatgagattggagagatctgagcagtctcccttgcagcatcctagctcagctgacttgtgaggggggctccttaacccaattccccatgtgggaaagtgggggaaatctcacagctccctggtaagaccctggggcaggccaggctgtggaagcagagggctccctgctggcctcctgggtagcccctggcgtccagtacagaggtccccctcctctctcctccctggctgccctcagacactgggagccctccctttgctcaaggcctttgtctgggccactcctctttctcaggacactgtcctccaggtgtctgtcagcctggccgcctcccctcctgcacatctcggccccaccctcacctcagtggcgccttcgtggtctccctgttgaagaccaatagagagctgcataatagctattcgctgcacatggctctgcctcccttcccttctctcttcccagctttcttgctctctgtgcactccattttctaaaagagaaaatatttgctttgtttattgcccatctctctacacaaagcagaagctccacaagggcagggttttctgttttttcattgctgtatctgtccccagctcctggaaccgtgctaggcacatagtaggtgattagggaagttattgaataagtgaatcaacgttccacctgcagtaaatgctcaggcttctaaacttgccgttgtcagagcccccatgaagctacctcgctcactttcactggctgaggaagcctgcgctcatgtctctctgttccagcatttcatgtgcaaacatttccaagtcccgagttgctacttcatctgcattcactgtcatgaaacccattgagtttgcctttctcctgtttctttttttttttctgctgctttaagaaccctccctctcgccattggtcggtagggcgacctcagtgcagggcctcaaaatggcatgcaggttcaagccagagtggtgcagtgcgagcgttcaagtctgttaaaaattcttgcaaactccatttaacagggtaatggtttaatgtattgcttaacaagaagccgtttggagctagagcaggacttgctatagacgccaagcagattccaaatggcatctcctcaaaatgagaggagaaacacagagctagagaaaggctatccctggggaagtaggagagaccaagcccatgttctagcgggaggaggcaggtaggtctgtgctgcgtctctctccatctcagctgtggatgaagatgcgagccagccagagaacggggtcaagagggagttggtcctctttcccttgatttaattgctcgaggccaaggcactgcaatgccatgagcgcccggaagtggagctcttgtgctggcagatgtatgtgccgctggggctgaaagcccagagtgttccttggagacacctgaccccaagatcagcactgtgagccatggagaaggaggggctctgctcaatttggggtccaccaggcagcgtggagcactggcaaggggccaggacataggaactctggaccaggtgagtcattatgcaatgtcgtttgacgtagtggattggttgttttgggaacaaattttacttctcattcctaaggaaatggaatggaaaattcatggctctggtgctgagctcagatccaataccttcacctcacacaacaaaatcaccacccctttctgggtggcagcttcaccctattttaaccaagatcccaaagtttgaagtaatcaccttttgtgtccttgatttagagacggtgacagctaatgtcccatatgaacaggactggaaagagacaagaaagtattttcacataagaaaaaagaaatctcccacaaagacagatgtggatgtctttcactggggagaggaaagagaggaggccattcaactgatcaaccgatccaactgatccaaccgctaagagtcgggcccctcggccctccctccacctggggacagaagcaggctttacccatagaagggatacttggccagggagacagagcagtggagctgatgcttcatgtgggatgcttttcatcctcaccagggaaaaaaagaagtaagtgcttgccgggttgcagccaaaaagaaaggcacagacatttctgcttaatgggagcagagaaaaccgaattgtccttctgagttgtttggacgcagtcagtctgagttctcgctggaaaaataggtcaatgtgaagctcaaacgcagccctctagaagggcttctgatataaaaggagcctgcaagtgaagttgagaaagaagaaaactagcaaggaagttagcactgaagagacacaaagatccctaattgtatctcagagctccaggtttgtttaacggaaaatcagtgtttatatgcagggtttataattttctcctgcttccctgtcttagcaaagatgctttttttttttttggcacaaatttggtgctggtatctgtggttatggatgtctaggtggggagcagggaaccctctgggagaggcatggcatttggaccatgtcttctaggtgctgtgtgacctgctcaactgcaggcccagggtggcaagaagtataggaggcttttctaattaccctccttgctgtgtgacttgggcaacttccttccctctctgtgcttcggcttccctgtgttaaatggggagaggggctggatggcctgatgggcagcatctcccccacctccactcccaggagatcctgccaagtgctgcatggtggagtgggaccgtgcgactttatgcaacatgtcgaggtctgcttttgatcatctctgagagaattccttgctctaggaagaagtatattcccaatgtgtgtcccttgagcaggaatggtctacatggcaccagctggccatgttctggggtcagaggtcactctaggttccagccccagcacaagtctgatcccacctggggatgcccagtcttgccccctgctgagttagagtctgaggggcacacaatggctcagaggatatctgagggcacctggggtttcctctgagggttcctggggtgccctgatttttcagggccagagagatctaaggagaccagagaaacatgcaccatattggaaatgtagggcactgagttttcatcgtgaacctctcactaactgagtccgtcaccttggactagtcccttgatctctctgggcttcaacttcctcatctgtaaaagaaaagggttgaactacacgttttctcaaatgcttgtttctagcacaaagattctgtgcttttatgtgtggggagacaggtaaacaggcagccttagaagatgctagaatcttgttatctatcaagaatctcagggtcttccaaggttttggggccaaaatgataatagtatcatcccacatccatctcctccagagccacccatcctgccctaaagtctttctctggataagcttttttgacctctgggtcaggatagaaatgatctccaaggaaaggctaggcaaagggcggtgagcccatatgtgtgtttctcactatcagggtcctggggagctggagggtccttgtcctagacccatccccttgcctcctggccaggccaagcttagcttcctagtaagacagtgaggcttccccctgagtgcttggaagaggctcacctaagaggctctggaagactcaggacatttgcaaaaagccaagttctgggcagagactttggggacaagaggcagaaacatcgctttctgaccatgtcagtgtgatggcatctggggcatgcacacatgtgtgtactggacttgacagtccacatccatgcccagcttggccatggcacaagccaccctccactccatcccgtcagcagtggctggtttctgcagaatccgcacagatttatctgtctcctccagactcagccacagccgtccttgcttatgggcacaggttttagagaaggactctccaggtagagatcccagctctaccacttccaagcttgaggcgttgtgcatggcacctatgtttgtgcagaaccatcggagaatccccaaaggaggaaggaggacagagccatcactcttcatccatcccccaatccctgcttccccaaagatcttcctcccaacacacccagtgagaaaccaccacctctctttctattaccacccccagtagccctattgcatcctgttggctcatgctccagaacagacctcaaatctgtccattgcatccttccccaaagactctccatcccataacctcacacctggcccaccacagcctccaacaggtgctcctagctcagcccttgcttccctccctgtgtgaaagaaaagggaccttcttcaaaagcaagcctggcggtgtgcttttcctctgcagcccctcccactgcccttggaataaatccaagctcctggggtcccctatgcttttcccaattggggccctgcctttctctccatcctctctcaccccaactgccaagctccagtcatgctgggtcctttcactttttggaacaagtcaggctttccttccctcagggcctttgtgcaagctactcccattgcccagaaggctgtctcttttcttcccaagttggttcctgctcatcatttgtactcagcttaactggcagctctctggaggggcttttcctgaccccctgcctaaagtgggctttctccaaccccaaccagttgtctgcttcaatactctaaccatcacgcgttgtctaattgtttttgtgctgtgtccccagacagaatgggaaattcatgacagcatggattatgcctgttatgctccccattgttcctccacacatagcatggctcctgggtaacacatctttgttgagtggcagagagtatcatgtacccagaatatgccaggtgatgcactgtggaggtgcatgtggagctcattagacctttgcaacaacccaaaaagtacttgttattcctaatttacagatgaggaaacttaggaaagtaacttgcctggtgccataaggtcaatacatggcagagctggaatctgcatgcagccctgtctgacttttcctactgcactggactgcttttccaaccctttcacaacccagaacaggagcggagccttagcagacacaagactcaccaccggcataaatgtgacatgtcagaattatgtgctcccgtcatttatttgttcttctgtttacttaaactttcaagacatcaggcttaaggaagaccctgcagaaatgtccaaatgactccagcataataattgtatgatatattactattatttcccttgagtctgtatttatagggaaattggattataagtgtgtcttgcaggctgaatattgttctcttagcccagtgattagagagaaacagagggtggagagatggcaagggagggagagactggcattggcaaatccatgcaaaactcacctattaaagtggtagtcatagtgatctttccaagcatctactagccctaatggtatacagtggacaagagtcattgtaaagcccaccaaagcaaggtcggtgagccacaggtctcaccagtaaagcctgaaggcgaattcagaaggtccatctacaataaaagaaccactacaaccaccaagaaaacagccagatatcttacaaggcacttcacatttgtcatgatgtttcatgctcataacaactctctatgataggtactagcattatccccattttagaaatgagaaaaatgaggaacagacatgctcagtaacttgcctaatgtcaaacaactgtcaagtaacaggtgggagtcaccccagctttctacgctgcgaccctccaggcacccatgtgactgggagaggccatgccaccaacaggtctgttccaagtccacacattttctctgccctcttccaatttctgatgactaaactgattttctttaaggcttgtacatttcctgcagcttaaaaagattggaatggcatctactggcataacaaaattgtctcgtgatgaggacacgactctagaagttaagtaagagagaaatgccaagccccttacaggcagcccgtgctcagtgatggctagtgtccttccttcccgtaaacccagctgatgctatagcctcattcttggcttagagatccacaatccaatgacaaggatggccactggcctttgtttagtccaacaggtcccaaatatatttaaccacaaaaggctgtattgagaaacacccattccacatcccaaacaaacctggggaaatgctcaccagacctcccagtttctagcacaaaaacaggggattgcagggaggaggacacaggaggggcttccctggggtgaaggcccaagagcagcatgacactgggtcactcccagctccttttccaaggggtctgctcttggcagcatgcccaagtggcccctgtccttgcacagaccctggccccagtgggctcccacatgagaggacatttaggaagcaacatccattgccccttgggaatccccactggcttttctctccagagatttggtgcccagccctttctgtttataatctgagaaactatcatagaaaggacaggcataacaaggaggctgggacacagatgatccagagggccagaaagggagagaaatctccctaggacctggcccatgccagcccataaactcctgaaggataggcgtctttgcaaacccatccccagcaggtctggcccatggcgggtggtaccatgaggatggggaggtgaccgtcagagccctataaaaggatgactccacctggccctggaaatgataaacacagccccttatgtgcccgtggagtttgaaagtttacaaagtgctctcttgtgcattatatcattgcatccccactgaaaattaggtattattcttctttcttccagtataccaaagagaaaacgggattgtgaaaagatgaaggtccaaaatcacaagagggtataagtggtgaccaggtccttggatttcaaatgccccatcaggagcccatctgtctaccaccctgctacctgccctatctgtttggggtgtcaagatctggccaaaggttggaagaggaaaagatgagaggaggcataacttggcagccctggtggtacagagtggggaagatttgaaattgaaacagcaaaaggcagtttaaataaacagagtctgctatggtttgaaggtgtcccctccaaagttcagatgttgccagtgtgataggattacgaggtgggacctttgagaggtgatcaggccataaggactcctctctagcgaatgggattgagggccttacaaaagaggcttcatacagcatgcagctagcttgtccttctgccctctgccatgtaagaacacagtgttcttcccttccaggggatgcagccctcattaggcagctgaacctgcaggcaccttgatcttggacttcccagcctccagaactgggagaaaataaatctctgctctttataaattattcactctcaggcattttgttatagtagcacaaatgggctaagctgaagtctcagacagcagctgagttcattttgagaaaaagaaggactcagatgggagagaaaggtgtccctctccagtgccagcaaatctgcccatgagagcactgttgccctgggctgtggggcagtagccctgggatctgagggcaggttggatatggaggcctcaccagggaaccggacattgccctgccagtcggcagcacatcctggcaccaggagctgctacccaggctcagtgctcacttccacagagctcctttatgggtaggtttctagagcaagaatgcgcatttcaaagacatccctatgatgctggtcttgctccagaatcaatcatcatgtgagtctcctggcactgagaacaaatgatgttgttcaaactgctgcatgttgtccatgctcacaccatgtgttttctcagcgatcctgtgaggcagggactcccatggccgcagctgtgggcagccaatcacaccagttcgttgccaagcatacagcctgggtcctcaggcatcctgaagatggagcatcaccaaggtttccctgtgttcccaagctcttctcagtgcccaggagagagtatgtgtgcatgtgggtgtgtccaagaaagaagggagggatcagatgagtggtcagccctgccatcctcctcgaggcctcctgcttagcttctgcatgtcccagctggagccggacatcaagttggctccttccagctctcctctctaggccacggttgctcatcctgtaggcaccagctgggctgtcactccaagaagctggagcccctgggccacctggggcctcttcctgacagtgaggactgcagatgcccaagggcagatgttggctggtgtcaccccactggcagcacctgctgaagatccccatacccctcctgcttctgtgggtgcccagaaaacagaggttgtggctgccttgagcatgcagcttatgcttcctgaagccttgtcaaagggcggaactggtccctcagctcagtgtgggtctcaggcctggctttccctgtgtccattccaagggtcacacggccccttttccttgcttctgtgatggaccagcaggactgcagccagcattttgtgggatggacagataccctggggcccctttttctaccagacagcctccattgagggctgttctggttcagtagatgggacatgaggcttcacctgagccgagtttgtataggacaggcgagcctgtcagcagcacatctgggttcataaccaggtccccaggctttgaatgccaccagcaagctactagcctgaacagctcagtcttccactggcttttgaagattaaatcccctttttgcctaagtacctagggggattggagcctacagagggccagcttggaaaaagtaaggaggcacatctgtttagagaaaggcctggggcagcgtggctgttcttgccagaccacattggtgaggaggtccgtgtgggtgtccatgaacgtggtgacacggagggcctcctggggcaccaagaggacctgcggggtctggaggtgagaatacaagagaccaggaggtactgctggccagggagagctggggtatggacggcagacccctcctcatggctgcctggctacccagattacacacgctcactgagcgctctgcagtcaggaacttctgggctgagtctcttcagcaacttcttgccttgaatactccagttgatgataaactccgtacctcccaagacagttcatgcatggctccatggactgtctctcacttgttgaatggataagcatctccctgcaacttctacactttgggatgatccttcttgcccatgacatcccttcaaatgtcaccccatgtgttgttgcttccagcccctcctcctcctgggccctctcccctgctggaacttgaacagagctacttaagctgctttacaaatggggcttacacatgagcttggtttgaagcaagagcaccacagtttaaagggtctgaaaccattagtgctgcccaatatgacggccccttgtggtcccacgctatctctggtctgtggcttcccctcccatagatgtgcaaatgcctggctcaggtcagcacccaaggacaggggccactgcccctgatggggagacccagagccctctacccggctggctctgctctgctcacatggacgaagtggcctggaggtgccaagccagcccacatacattcagaacatgcctgtgcagctcttgagtgtggtgtgggccccgtcagcactgcactgggggccgggcgtcctggggactcagggcaggatgggcaatgcccacagagcgtgccaggcacgaagtgtgtgggaggcggccgtggtccccaggtggagggcaggccggggtggcggggcgcggccggcgggcactcacagggcagggtctcggcgctgttcttctggagcatgatgtagagctgtagcaccagttggggcgcgctctccaggaaggtctccaggaggcgcagcatgttgacgtctgcatattcatacatcatagcccagtagaagcgtcgctggtgttccttccgccgctggctctgaatccccaggtacatggtgcggatatacctgcccagagagatggggagaacacagagagcatgggtgggtgcaggggctccagaggacccttgccatccccctaaaaccaagagactcagcatccccccaactccctatgctctgaagttcccagaggcttggacggggctctggggggctcccggcaaaaggacatgatgctgaggcatgggggaggggcggggcaggtcaggaaaggatttgacccctcgtggacccctaggcaggtcttcctcctcctggtctcccatttgctcatctggaagatgagactgtggggccagatgccctgccagggcctgcaggtaggcatctcaggtgagctccgggacaggggtgggctttcaggttcaggaccccggggggaaacaatccagcaaggttatcacctctgttgttctggaggaggaaaggaagggaagcgggtgaacatttctgaagctcctactacgtgccattcgctggctggccatgcccaggtggtaagtaggagggtatggttctcacatgatacagacaggaaacagcgtgggctcagaaaggtcacccccactgcacaggctcctgtcgccggatagtggaacaagtagggatcacatccaggccactggacaccctccctggacatcagggggacccagggcctgccatggagtctccgtcccagcagggcccaggacacaggagcagatccgctgcccgccctctcaggaccactcccgggctctgtgtgggagggctgaggggccaaggaagcaggtagggggaagagcaaggttcacaggtcaagcaggcctgactcatcacttgctaagtgggggatcttgaactagttattccagctctgtgtccttgtcactcatctttcatatggggacagaatgagagcatcgcagggtgcatgggaagattagtgagatgatatgcacagtcggcatctccccaggtcatataataaccccagcctcaatttcaccggaactctctggaactgtgtctccaaggcaagagaaggacttaaggcaccatccaaactcagccaacaggctccaagtctgggccagggtagaggttgtggacagggctcacccagaagcaagggccacagtgcacagctctgtgggcccagtcaggatcaaaaacaggaaccgtaaactgggtgccagcggcagtgggagagaaccacatgcctgtccttgactgtcctgtgggatggacattctaggacccactactgtgccctttgaaatgctgagcctgactcctaaagattcagtgcatggctgacaccctatccaggcccagctggcctcaggtattaccaagaacacactcagggctgccggatggtctgttctgtcactgccacaacaccagctggctcccagccactgccccttttgcctggagggatgctggagtctcctcactggtcctccactgtctactcttaccccagaacaacccattcttcacgccgctactaagccacaagggtgacctcaaacacacatgccaggtgcagtaagccccgctcaccaactgatgaggggtgcccggcttctctctagattcctaaggccctttgggggcctggatcctgaaggcacccagccagggaagctgcaatggatgcctcatttctctccagacccaccccctgtggtgagcagagatgcaatcttactgacaaccagagtgaggctggcattgcaatgatggccccatcagggagggatatgggaggaaggttggggcaccaggccccccaggccaggtccttccaggtatacagtctcttggggtccctggcccaccttgcgggtcaggtctggttatcaccattcaacacatggggaaactgaggctctagcatgaaataaaccaccaaattctggttctgttcaaggttctgccacctgctgactgtggcatttccactaggtgttgccttgctctgggcccctgcccgtgagttcacaaaatcaaggaaccagggaagaggctcaggaagaggaagggggaggttgcacctagtctcagagctcacagtcactaagagagggggagggagagacccagagagatagaggcagagacatagagatagacagtgagacagacacacacggagagacacagaagtaggagggagctgaaggggaaagcaaaggtgaagggagcagtgtcaaacttgggggtctgaggagaggactgcctggaagagatgatggcagcaagaaatgtgtgcagcgaggttcctggaagcagatgtcatcatcggtagtttgggaggggctgagggtgagcccctgatggagggtgatagaagggccaggctgatcaaccgtgatggcagtgcggggaggcagggcatcaggggacatgaatgctccagctgaagcaccgaggcagggctgcgtgcccagatctttggcacccatgtctaggagagctgtgtgctgagtggagcctcagtgccgtgtgtctcccagatcagagctgccccctgtgacccaaacccggctctctcaacaggtggcacctgcagcacacaagccatgagccacagatcactccaggccccagaccgcaaacctaatggtctcaggggtactcagactacagactctgcttcttccagcctcacaggtggcccagcagctggaggaacggttatatggcagcactaaccctatccatctgggtcccaggtcagtaatgccagtgctcaggttcacccaggtttgccctaccaggcaaagggagcaccagttctacccttccacgccacattctcccaaagccacaggcccctctgcccaccaaggccggggcaaaggaaaacaacaagcccagaatacaccaattcaactgggatgcctgccaggaggagccaatcttgatgctctcctgggtgtgagcaccccagggtgtgggaagagccagggtggatgtaggcaaagagggtgccactcctccctgagccaattagcaagcagacgttggggcctagagggcactagagtccaggcaaaaccgtttggacagcatggtgcctcctgggtcacccgcacaggcacctctgggactgtagtagggactgatcacagccctgcccaggagttcctgacagccaagcctcaatgcaaatgctcatcctttccaactgctcccggctcggtccctcctctgctactcttaagtccttgggtccacagtacacaaccgaggggtactggtttgcaatataattaggtctggaccctggaggtctagtccaacccccactttatagtggagggcccaggtgccagaacgcaagccactgccgcctcagtcactcagtgctgtggggcccggacgggaccagaatccaggcctgaccccatgaccttgcttgtccaccacaacacgtgcaaagcccttgcctctcatgcaggaggatcctggcagctcctgcgatcacgcggctgctgctgtcctcgaggctctaggattcttcctcctcctagctttacctggtgtctgtctccctcaagatctaaggagctgccaagaaacaacgaggcagatgggtggggtgggaggaaggcataagccatgtcccccctaaacccctgggccagcgctgctctccctcgggatctcagtttcctgtgtgtaaaatccggagctcctgggtgacctctgaggctgcgctgccagccgcctcctgcagagtctcccatcccctctgcagaagcggcctcgacccgcggccacacggtggcgccagaccctaagcgtcgcggaaacgccgctccaggcaagtgatctcatcccacaggcccgcgccctcttctgccagggcgcggagtgcaagcccagaggtgcgctccgaggggggaaccaaggcaggagactcaggattggctgccattcctccaagccccctccttctccaccttccaggcgggttccagaaagcttaccgcaccgttctccaggaaggtatctcttgggagagaagacaccaactcttctcccggacttgctcccaaagtcggtgtcacctcctgtcacgccatatctgccctaagagcctcggatcatgaaatacacgggggtgaaagcagcaacgccacgtgtcctcatggagcacagtctcaagaaagctgggcctggtctatggtctgcgggaatggccagtcttgagcaagtcacctcccatggctgggccccgctattcccatcacaggaggggcaggcaggagggatctccaagcctctgtcaacatcttataactttgtctttcttcaggtgagtgacctcacagagcacaaaggatggcctagcatctttataaacaataatgcctcatgtttgtgtgacattcacttgtgccaggctctattatgggcatttggcacatattacctcatttaatcctcacaacacccctatgaggtagctgcaatattacctactaattattcattttacaggtgcagtattacctaccaatattcattttacagacagcaaactgaagcactgaggttaaaacattcgccttgctcttcccagctaagtagctgagcagggcttcaagcccaggcagtctggctttggggccagtgctgttgactgctcctgcccacgcacctcccagaggtagaccatgtgtctccttacttctgaactcagtccaacttgcctgacagtggggaagaaaggagtttgcccaaaacacctgggctcccttccagctctgccacctggctgtgttaccttgagggacatttcctaacttctctgagccttagtttcctcatgtataaaatgcctagaccagagtagaacccaggacatgatggacgaatgaatgcataccatagtgccccctcagagggtcacaggggccttaaataagaccatgcctgtgagcacagacaggaggttagaagtcaccatgcagatggcagccattactgctccctgaggtgccctgttcctgtgttccctccagcccactctgcttatatctttctagttctatctcctttccttactttgtaagccatggaattgtttaaagctcctgttccctccagcagaagtatctagtcctctgagcacagctttctgagggagacacggttgtcatcttctttttcctgctggctcgtctgaggctcagaaagactaagtgacttccctgaagccacaccgtcagtcatggttcaggaaaatcagagaaggtctcgtccaaactatgttgcccctctgaggttggctatggctctgcccaagactggctggggtagaaaataagtgatttctacaaggggcagggggctaaacattcacctatctgggcccacagtctccagctgcttcttatgacactgtcagaaacagcactgaaatctctgattgtggataacaaaccaccttcaaagccccaaacaggggtaagctcatgttttgtggggtctgaggcttagagaacccttctttaaggaaaatggtaaattctaccaaacagagtagaaattgcaccaactgtacacaatcttttccagaaaataaaaaaggaagaaacacttccctattcattttatgaggccggcattactctgatacaaaagccagtcaaacacagtacaagcaaataaaactacagacaacatctcccataaacatagatgcaaaaatcttcaacaaaatattagcaaattaaatccagtaatatatggaaagaacaatgtaccagaaccaactggggtttatcctgggaatgaaaggctggtccaatattcaaaaatcaatcaatgtaatctatgacattaataaccacacatcataacaattgatacagaagtaaaaggtaacacaattcaacatccattaattttctcagcaaactagaaatagaagggaacttccttaaccttatgtagataaagggcatttatggaaactcccagttatcttccttaatgataaaagactgaatgcttttgtcttaagatcaagaacagggttatgatgtctacacacaccactcctattcaacatcatactagaagtcctgttcagtgcagtaagtcaagaaaaataaatacagaaagtatatgcagattgcaaaggaagaggtaaaactgtccctatttgtaaatgacatgattgtctagattgaaaatcctaagcaatcctaagcaagaagctcatataaataattagttaatttagcaaggtatcacaatacagggtcagcctgtaaaagtcaattgcgtttctataaatgattaatgaataattgaaaatttaaaaattaaaaatatataccacttaaattagctccgaaaatgaaattcttagagacaaatctactgaaacatgcaggatttgtatgccacagctgcaagatgctaataaaagaaatcaaagaaaacctaaatgatacagagacataccatgttcagggattggaagatgcaatatagtaagatgacaattgccctcaaattaatctacagatgtaacacagttccaataaaaacccaagtggaatttttttttaaatacagacaagccaattctaaaatttatatgaaactagaatagtcaaaacaattctaaaagtgaataaatttgaagaactcacactactcgattttaggatttactataaagctacagcacagtgtagcattggccaagagagaaacatagatcagcagaacagaagagtccggaagaagacccatataattatggccaattggttttttacaaagggataaagacaattcaatgttgatagtcttttcaacaaatgatgtagtaataataagtcattcatatgcaacaactaacttaaaatgtatcataggttaacgtgtaaaaccataaaactttaagaagaaactgcaggagtggttctgtaccttgtatcagacaaagagttcttaaatgacagcaaaggcatgatccataaaaaaaacaaaaaagataaactttatcaaaattaaaagcttttgctctgtgaatgacattgttaagagaatgaaaagacaagctacagattgggagaaaatatttgcaaatcacatatcagacaaagaacttgtagctagaataaacaaagaactcttaaagctcactagaaaaaaacaatccaattttttaaatgggcacaagatttgaacagatattttaccaaagaggatacacaatagcaaataaacatggggagaagggagctcaacgttacaagtaaatagggaaatgtatattaaaatcacagtgaaaaaaaccccacaatgagatagtacttcatatctgttaaaatggctaaataaaaacactgacactatcaagtgctgtcacgaatacagagcaactagaatgctcatatattgcagtgggaatgcaaatgcttctgacactctggaaaacagtggacagtctctcataaagttaaacatactctccacatatgacccatagttccctttctaggtattctagaaatgaagacttatgtccacacaaaaatgtgtgcacaaatgttttagcagttattttctttttcttttttttttttattatactttaaattttagggtacatgtgcacatcgtgcaggttagttacatatgtatacatgtgccatgccggtgcgctgcacccactaactcgtcatctagccttaggtatatctcccaatgctatccctcccccctccccccaccccaccacagtccccagagtgtgatattccccttcatgtgtccatgtgatctcactgttcaattcccacctatgagtgagaatatgcggtgtttggttttttgttctggcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatgcctgggtcaaatggtatttctagttctagatccctgaggaatccccacactgacttccacaacggttgaactagtttacagtcccaccaacagtgtaaaagtgttcctatttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatggggttgtttctttttttcttgtaaatttgtttgagttcattgtagattctggatattagccctttgtcagatgagtaggttgcgaaaattttctcccatgttgtaggttgcctgttcactctgatggtagtttcttctgctgtgcagaagctctttagtttaattagatcccatttgtcaattttggctttggttgccattgcttttggtgttttggacatgaagtccttgcccacgcctatgtcctgagtggtaatgcctaggttttcttctagggtttttatggttttaggtctaacgtttaaatctttaatccatcttgaattgatttttgtataaggtgtaaggaagggatccagtttcagctttctacatatggctagccagttttcctagcaccatttattaaatagggaatcctttccccattgcttgtttttctcaggtttgtcaaagatcagatagttgtaggtaagcggcgttatttctgagggctctattctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaacttcaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgcgccagttttcaaagggaatgcttccagtttttgcccattcagtatgatattggctgtgagtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattaggtttgccagtattttattgaggatttttgcatcaatgttcatcagggatattggtctaaaattctcttttttcgttgtgtctctgcccggctttggtatcagaatgacgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcacagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtcattcaattttgttgatcctttcaaaaaaccagctcctggattcattgattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcattttgttatgtacccagtagtcattcaggagcacgttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaactctcccattattaatgtgtgggagtctaagtctctttgtaggtcactcaggacttgctttatgaatctgggtgctcctgtgttgggtgcatatatatttaggatagttagctcctcttgttgaattgatccctttaccattatgtaatggccttctttgtctcttttgatctttgttggtttaaagtctgttttatcagagagtaggattgcaacccctgcctttttttgttttccatttgcttggtagatctttctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggtttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctctgcatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacatacttctaaatttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagagattactgctgtcttttcgtttgtctgtgccctgcccccagaggtggagcctacagaggcaggcaggcctccttgagctgtggtgggctccacccagttcgagcttcccggctgctttgtttacctaagcaagcctgagcaatggcgggcgcccctcccccagcctcgctgccgccttgcagtttgatctcagactgctgtgccagcaatcagcgagactccgtgggcgtaggaccctccgagccaagtgtgggatatagtctcgtgatgcgccgttttttaagccggtctgaaaagcgcaatattcgggtgggagtgacccgattttgcaggtgcgtctgtcacccctttctttgactcggaaagggaactccctgaccccttgcgcttcccaggtgagacaatgcctcgccctgcttcggctcgcgcacggtgcgcgcacccactggcctgcgcccactgtctggcactccctagtgagatgaacccggtacctcagatggaaatgcagaaatcccccgtcttctgcatcgctcacgctgggagctgtagagcggagctgttcctattcggccatcttggctcctccccccagcagttcttttcatacttgcctactatccttccgcaggtgaatatataaacaattatggtaatccatactgtggaatactactcaggaataaaaaggaacaaaccactgacacacacaacaacctggatgaatctccaaggcattatcctaaaggagtgaagtctgtctcgatagttatatacagtgtgattccacttatatgatattctgcaaggccagagggatggagaacagattggtagttcccagggagtgaaattaaggcatgatttgcttaaaagtgggcacatgggagagtgttctggggtggtggaactgtcctgtgagctgattatggtggtgactatgtgaatccgcgtatgcactgaaactcaaagacctctacaaacacacatacaagtcaattttactctatgtaaatgttaatttacaaaattgtccaaaaaagaatcttaaatttttaaaaaatgtaaagaaaaagaatacaaaattacttattcaaaattgagtacagggtcccattagaggcccataaaagtgaggggccctaaagcttaagcttcagtggggccgcaagaaatccatctgtccccgaacactatctgcaaggaccttttcctgcttctcccaggacctgcttctcccaggacctgcttctgcagccttctggaaggaatgagctcacaaaccctggatggaaaggcccaaaggaaacttcactcccagcacaagcaagtatgagggcttcagaacttccgctccccagtaaacagctgaccggcccaaccaggcaagaaggaaggaaggaagggcaggaagagccctggcagagaagaatccaggcccgcccaccacagttcctgcttctctccctcctaacgaatgtctctttgggcctggccccaaggaccagtgactgagaggaacactctactgatgacttcccaaggctacgctgacctgctcgaggaacaaatgggtggggatcaccaggatttaagggacagctgctcccacagtcctatcctagagacccaggcccctggggacaagccagctcctgagaggggtgacctcactgcctacttgggcacctgacctgcacccagtggccttagcaatctctagctctcacccctcaagcggcttattcagaaacctgattctatgagcgcttgtatcccacctgggagtggtggtcacgcagaaggggcctaagactccaggctggttcgtaaagcttcccctaagtcgctgggttcttgaaattcctgccctaatgcagagctctgctttcgaccagagaccaggggcctcgcccaccttcaggcctcctgggcactgtgagcaatgcagagctgtcctcagaagacattcccaaggccaggggctgggccctgctgcctaggaggttgtcaggcgtccttgggagaactgctcttcattgtgcatctccagcttctccctgggcttcgggggtccacagcagccagcctccccctcccccaggtgtgtcccctgagtgtgcacatcgtagcacaaggggtgtcaatcctggctgcacctgagaagcacctggagtgtttgcgagaaatcctgcgtcgacgtgtaatgcaatgtgcacctttccagggagggcctagtgggcaggaccatgtctgtgctggtcactggcatggcccctcatgtagcagagcgcctggcacatggtgtgccctggacccacattagtgaaagaaagaaatggaggaagggagagggagagacggggagggagggaagtgcctaagctgagaggtggcatcatgagcaggaacaaagcaggtctgggcaccacactcacaggactctcactgtaagttacttagctttcctccttggtcaacattcgagaatgccacatagctcatgccttcagggctccaggttcagggcccgcagtagtcactgtggacaacctacagcattccctccagagcccatgtgccaaaccaggagggctgcagccccaggaagccatgggaaactggctgggcagaggccatagtaggccccgattttcacctgtgtcccccaagtggcatagcaagccctagcagaaggctgagttccgcaggggaaacccctttttgatctctttgtcggcacctgcagacggctggtccgggagcagagctggttcaaagccacgcaacacaggtcccaccctcctcctggggctcccaagatctcaccagtggcttctccccactatcccaggagctgccttggccagcagcagtgtcacatattcaggacacaaacaacctgtacgcgacaaccagctgtaccccgagatgtcacacacatcccctttgcaataggccggcgggcccatcaccagcaaactgctttgttccatatgtggtaggtgctgtgacccactgattctttccaccagatatcgatcagaagggcagccccttcccttcagctgctccttgccatcagctccaggcttggttatgaacaggatgccaaggctggggtcacgcagggacatagctctggtccctgtagccacagtgactcggccaccgggccaggcttctcagacacccagggaggaggtgagggggctcctcgatgactcctggaggagactcagtggagaggagtctgaggaggccacctttcccactgccttatgacacggagacccctccaggccctgtccaacaggctccttctaccctctctcctgtccttcctccgggttcacagcctcctcccaccgacaccctccacctgtgcccccctccccaggcaacccttcagcccttgactgtctgcaggttggttccctgggggcaggaacagaggggacggtgtcacaaccacaaccacataaagtgataccgcttaggagcactcagcacttgcaaggcctcctgcttctgccctgaccccaggatgggcaccatgggccctgtggagatggagaaactgaggcaaaggaactggctgatggcatccagctgggtctgctgaccccatgcactgggctgttgccaagcacctgtgtgagctgaggttaagctcggccactcctgcaggaccttcagccccgcaggcagtctctgagcctgattttgccctgcactgggtccccagcccctaccagaggcctgctcctgggaagacccacagggcatgtgctgagggactgtgtggtagggctgggcttcagccccagcctcctgacctcagagcctacagtctgtgtggctacgtggcctgggggctcatgggtgctgagtgctgtggaggttgtgaggaggctggggagctgagaccccccaccctcgaccagcagggccttagaacatgtcaaatgcaacccttgggctcacaaagggagccctggaggccccaggcccaaagtcacagcagcacatagaaccccaacggcccttccacggctgcctctgccccagcagccaggcctgtgggctgcactccgacccctttgtggccaagaactgttcaagctctttccaaaaagactcagaaagccgaccttaaaggcagagcacagcttttctctgaagctgataatgacacagttatcccctctgagggatttttactcaaaccatctttactcttatcctgggaggatgcaggtgcactatctcacacatacacacaaccgcacccatacacacacctcccacatgaacacacacactcgaacataccacacacagttgcatacacacacggcattcacaatatgcatacactttacacacagcgtactcaacacaaagtacatccacccacatggtcacactccacacaggtgcattgtgtctgacagagcacacacgcatgcaaactaccaaatatccatacatgcaacacacagctcagcttccatctatacagatacgtgtggacacacagtcacatccgccacggccctgagtccacagccagcctggattgctgtgggcgaggtctcttgcctgtgcttcccctcctgctcccaggacttcctgctcccaggactgcctgctcccggtcactcgccatcactgtggcctccacagggaggcagagagaccgggcacacagagcaaaaagccaaactcacattcagctgttggactcacctcagagaggacagcaggagccctcaaattacgaagtaagcactatgtgagcagatccaggtgttccaaattcagcgccacgctgcccccattattgagaacagggctaagctagttgccgccaaagcactcgcgagctcactgatgccccaacttgccaatcacccctgccttccctccgccctgttcacgctacaaccccttcccttatcccatgcctagcttattttggagtcctgacttgcagccacagcaaagcttttgagacattgcaagatcgcattcttgcctgacgcatccttctgagggtggaacagttgcctccttgtttgtcctttccatgtctgaccacatcccagggctgcaaggatctagggccaggtggccacatgcagtggctgcaggagaaaatggctcaaaggaggggccaggaaggcttcaggaccataggctgcatggcccaggtaggcaccgtacccatctggggctcttctacctgcctgccattcactctgcccaggtcagagccttagtggctgcttcctgggatcatagctcaggagcaggctgcaggacagagcaaaaggccttggcacccttccataccattcgcagatctcaggagcatcactgtctgagttgtcacagacaggacagggtacagcctgtaagcctttgccaggcaaacaggcagttactatgatgagcagtcccatttgacagatgaggaagctgaggctaagctacattaactaacctgggtggcctccattgcctctgcaccctggatttcagtctcccatggttgactccgacctgccttctcgcctgttccccacacctgctcctgccctccagccacatccatggctctccatccccagaccttcctaagggtgcccctctctgtatctgctcctgctgtcccctctgcctggagatccatccctgtgtagggccaagctccccgccacatgcctgctccttgacctggtgaaattccacccctcgctcgtcctcccgtagctaccatttctgtaccaggcacaatggaagtgctctgcatctatcaactcatctaagcctccagaaagccttacgatcgtcctcagatgaagagaccaaagcaagaggttgtggatgccaggggttcatacccaggtggttgactcgagagggagtgcttttacgccagggcactatgctctcctgctctctttctcattccctccccttctcattcactcctgtccacatccctacgaatgagatcatctgcgagccccattttacagatgaggacaccttgaggatcagggagttcaatggccctgctaaagccaggcggaagtctccccctgcccggatgtggtgcttgcctctgtttcccacccctggaggcctctctcctccaatatccgagctctccttacccccgaccctgcacccagtcccttaggaagagagaagcctctccagctagattttaacctccaggaggggcatccatatacccagcgccccccagcccaccacggtaacatccaatcagagtgcactaaactgagtttggccctggctctgatgactctgatggaagctggtctccttcgaccaagagctgcctgtaaccctagcttcaaatacatgaactagatgttcccaaaggtagatgacaagggcagcagctaaattcaagcaggaaagatttaagttgaacacaagaaagaacttagtgaccagcacagctggctgaacccacaacgagacaggtttcctgccactccctggacggtttaagaaaacagaaacaagcctgtcagatgctcccagcacacagaaggcaagggttggacccactgacctttcgaaaatcctctccactccagccattcaccacacggcagggcagggtgccccacacccacacacaaatcccactttcagactccctcaggaccactcaaaggcaaggtctggcagctcaaagggcctgcagaaatagtgcacccatgtagtcgcgaccagggccacagacctctggttcataggctctgagtatgagaacagactctagaaccttccacagcctggctggctccgagaaacttctatgctcccctccaccctgcacacaccctgcccccaacataccctagagcagagatgccttctgtacaaggaaaaggtgggggcccagctgccaacccagcccctgagagcacatgaaatcagagctatttttagcccttctttccagcaactctgacatcagctgaacaatggtggtgggctcagggtgcgtgtctgagaacgcagggatgaaatggcatttctttccagggtcccaggggacatggcagaggaaagcaccctgaggcttctgggaacagaggcagaatgcggtagatgtcgccatgcagtctttctggatgtagggtcaagctcgagggtgacttctgtaaacatcccagggctcgggagagcattgcctgggtgaaactggctccaccccacgccacccagcctcatttccccaccagcaagtagggctcaggccaccagggccttctccaagacgttgcaaaaaacttgattaaaaaggccaaaatgctgttgcgcacggtggctcatacctgcagtcccagcactttgggaggccaaggcaggcggatcacacgaggtcgggagttcgacaccagcctggtcaacatggtgaaaccctgtctctactaaaactacaaaaattagctgggcatggtggtgcacacttacaatcccagctaactgggtggttgaggcaggataattgcttgaactcgggaggtggaagttggaatgagccgagatggcgccactgcactccagcctggacaacacagtgagactccatctctaaataaataaataaaaatgaaaagaccaaaatgccttggcaaacccatgtattggagaaatgtgggtttccctttgtttccccatctaagctcccagaaggacagagaccaaggttttggttttttgtttatctttatatctctgatatgaggcacacgacctggtacttacgggcatttgattttctctaatgaatgaatgaacacattgggcgacttcttaataaaatccttgaactctggaaagttcatatgtctctattccaagcccccagggcaagggtacgcatagcccttcccttctccaggctctggcctagcgccgcgtctctgctggggaacccgagagctgggtggtgtgcagagcagctcatgggaactcccagctctgctcctcccttccctctcctgtccccaagcctcactctccagcccagcctaagtccccagcccggagtgaatatggggactatatttgattcctctctagcccccacgcagtctttccaaccaagcaagacaagccccttgctggtggcgccctgtgcttttcagcgtggagttgtgaccgctgccatgcccgtgatgggaaggccactttgacctcactcaaattagagctaaagacctcctgaccacacacacctccctgtgtcactctgcctgcaggtttctcacaatctgccgggacccaagtagcctatttgcacacaggttgcccatggggaatgggggtgagatcagctctgcccacaggagggaaacacgaatagccgatccaagcacttcacagctatgagaaaggacccccgacccaaagtgaagtcacccacactccaccgggggctttgaatcgtgtaatggacacgtgcacttgagcaggccgcagagcccacccggggcagtgaacgtgcttgtacctttgtgtaagcctcgggtgcagggtgtggctgaaacactctagtgtcctttttcggcccatagtgggcttatcattaatgaatttatctaaaacactaaggaggttcttcatccacccctcccacccctgggggtggcgtgtcctgcggttttccctccccacgggctatgctgtcccacaatctgcccgaaacatgcccctttatgacattcctgagcactctactgcagtgatccaaacccctctcagtcgtattcaagcactcagcagacataattgagctcctactgcatgccaggcactggggtaggcacaggggacccagcatggtccctgccctcatgctgttcacagaccagtggaggagacacgcctcaggagctggcaaccaggttggaacagcaggaaaggcttctaattccattgctaggcatgagatatttctgtcagaggcactggagctgagtgctcaaggatgggggagagttcaccaagtagctaagggaaagagggtgctccaggtagacagttccagagggtcaaaatcccccaggtttgcgtggggacagagaggaaggaataaggggaggccaggctggacagaaagggccttgggagcacagatgcatgcaggaggcaggcatggtgaggatcggatgacatatcaggaggctcactctggctgcagctaaggagacgggttggagcggaagacacagtagtcccagtgactacgagtgaggagagcttgctccatggtggtaatgctggcaagggggaaatcatagctctcagtggcagaggaaaagagagaaaatgaagacacgtctgagatttggtttggttgaccagaagaatggtgttgccattcaccgggatgaaccgaaaaggagagcaaaggtttgggagtgagatacctggggaacgtccaggccaggagcccatgtgcgtgtctctatgaagcacaagatgacaatccaggctggagatgcagacagtggagttgaggaagcacagatggcaaatctgggggcatggttggggtcaccctgggggatcgagggagagcagcccaggatggagccctgaaaacaccattgcttagcttccatggaagaggaaggtcagaaaggaccgagagggccctggtgatcagggaagagaagcaccacttatccacacccaaagaaggaggagaaagacagcacagtgtagcccccggggccctggacccaagtattggcaaaggtgatctttcattcaccttctaagatgttttgcctgcatcttctcccaaccttcagtttttgaggctgaaaagtcccagtcttttcatccagtcccttgagaatagcccaccgccaggggaactgtggatccctttgctctgggctttgctcagttcttccctcattctgggagccaggagggctttggggatgtgatcacacaggtgtagggacccaagagccaagggaagagcattcctgggcgatcttttcagctctgggctcaaatgctccctaccttccaggacgaagtggctgtcaggcctggggttgggtaagcaatgcctttcaaagtcgtgtagcgaagtccagggtgcagggtgggttaggggagaggtgactgcagaacagccacctttccctcagagaaggggactcaggatataacagcggctgccatttgtatgccaggcaccaccaaaatatctcactggttcctcgcaacaaccctatgaggtaaaaccagtatcccagctacgggtgaagaggctgggcttcagagaggtttggaagctttcccaaagtcacacagcaaaagaactagagcactgggatttgggctcaggtccgtccccatccagcagatggaccctctccctcagcgtcctgctgtccctcatcccatgcagctgttggtcctgtggaagatgcccagcaccgcatctgctgtgtgtgctgagacttaggctcttgaaacctctgccagctgagaaggctgctatgttctgctgccccctgccctggctgagtggcctcaggaagctcttcccctctgtttccttatgagtgagatgagcggggaagaccaggtgagctctcaggccctggaagctgactctgcagaccttgtagggcctggtcggctgcccagagatctttccacctcagtagctaccctacaggacatggtctatccttgcaggacttggtctgtcccgtcctctagcacctcccaccccgcaggacccggtctgtcctctcctatagcaccccctgccagctggctgctttcccatggggaaggccccgcactcccaccccggcgtgtagctgtggcttatcaagccctccttgtatccgtgtccaccagccccattctggggagacgtgctcatctgtgttgcttcctggggcctccctgggaaacaggctcaaaatagaagatggcatttactggagcaggcacagcaccacccagggtggccagtgacatgtccacatgttagagcccaaatcttcaggtgatcgtcaattcccagccctgccctgggcggtgcagcctctcgggaggctcctcaaagtcagacccagggcagggcagcaaaggccacatctccactgagtgagcctcacactcacgctgtcctctcctgtcaatgactccacatgctgctggaaacaccctgggagtccggggtgagccctggctggaggagcctgggccccggggctgcctctgcaggggccggctctagggcctggagcaaatcacccccctactcccgcttccagcctctccctccataagataaagagcggaacaaccgtttctaagtcccttccatgccttgagtcttacgggccagcttagtggactctccataactgccctgcagggagaaggcctgcccttggtgacccagcatgggcccccttcatctggggtgcagcagcaccgtggatgaggatctgggaggcaggcaagccccttaaagacttgggcaggatgcagagcaggggccagccgcaccacagagccagggctggagctccccagggctctgagctctcgctctgtagccaggaaggcacacctgttcctagaacagtcacctgaaaagagggcagggaggcctccgatgtgccaggcacggagccagacactcgaggctagcggggtacaccgttagtgccctaacaggggaatgtgactgaaggcagtatgtctattgttatccccattttataatgggaaaacaggcgagcaccattaagtaactcatccaaggacacaaagtcaaggaccggtgcctacagactatgctgtgcccaaagcatgcggagctctgcgggcagaggagggaactcctagcccaagttgggtgggggagggtacgaggaagattccaggaggaggtgaatctcagcagcatctctgagctggagcaagagcccacttccacaggccaggagtccctttcccagcccggcctgtcttgactcaggggtctgcaggctgtgctcacagctcctccaacatggccctctcctggctcctctgcatgaaaaagaacccacagggctgtagctggaagctttctgaggtcagaaactgagcatccttgcccctccacccttcctggcccaggaatgcatgcacacgtgacacatggcaggatggatggaagcaggggtggctgagaccagaagaggtcacagcagagagggaggggcagcttcccaacaggtgggggtgggactccaccctgtcgcaggccagcagccctcacctcctgctgccattaccacctggccaatggatagtgcagggggctcctctgtgctcccagcccccggcctcctctaggtccctgctgaagccagtgtggtgcaggcccaagctcagaagggcctcatcttcccagggagcacaagctctttgtagacactgctagaagcagtgcacaccctccctgtgccagggctgggggagagtgactgtggcagagatcacgggtccaggcctttcctgtcattcccactgaccagccccgagatggcaagaaccacatcagcatcttgagcctcagtcacctcgttcataaagtgggaacaagggtctcttgttggattctctcttgacttccagcaggtgcaaatgaagaaagggatgtgtccccacaacagttttagactgaaaacccctgacaagaacagaaaacctagtctcctagacagagaatgcttaataattcattcgttcatacctcaacacattccgaaaagaacttgagatggcgagaacatacaatccagttggcaagcaccacaggcccttggcttgctggccaaaccttcgcctcccaaggtcatccaggagtaagtgtcgaacactttccaggtcaggcagcttgctagaagtttctcagatgccatcctatcaaagcctcacaattgcccattgcacaggtactgtcactacatttttctacacatgagaagcctgaggtgcagagacggcgagttacttgcccaaggccacacagcaaggatggggagtggggatttccatccaggactgactgtggccccagaacctcagcagcatgccctgacatcttcctgtgctttccaaattgtcaagcgccagacggagtcacccatccatccacgaccccagggctgctgttctgggccagtcccttgcagcaggtgcccaggaagtctggaggccacagcaccccaggtccctgcccttggaactcagtttccaggcagaggtagacagtgttcaaatgagcaaatagtgatggaaactcatgctggggggacaagggctgtggggaaaataaaacagagggatagaaaagtgtgtgtgtgtgtggggggggggggcccccacagtggtgacaggggaacgcacaccagaatgggacaaggtgctgagcgacgcatgggtaacagccaggctgcagctcagagaggggaatgggcttgcagtggaacagcgagaaggctgggaaggtgtgagtgaagacagaatcaccggcggctgcatcgggaagaacttggttttagtcccaaacagcagcagtggctaccagtctgtttcacactgcgtggcttctttctgatctcgccctcttacacaggccctgcacttccccggacttcagggtcttcacctgcagaatgggaaggctggtccatgacctaacggcccatcattctattctgctgcagagtctcatcttcccctgggagtggggatctgggaggcgctgcctcttctgagtaggctgcagcacagcaggtgtgaagcagggcaggcagaagccaccccagctgcatgtcagtggccttgggagagggagaaacgaggttttcctcctgacctggcctgagctgggagtggggagcccggaccaaggagggggcaggggtgggagctgttatggggatgccaggtcgggaagaggcccctgcagaagggctgggctgagtggggacgacaggagaaccaagaggccacagccagccccctgccctcctctagctggctgagaaaaagccaggatcagcaggggaaatcgtgggccagtgggtaggggagtgggaaggagaagggccagctataaagggcacatgcagcacaggtccacggcatgacctcctgcagccctcctgcccctctccaggctttttcaaagcccccatccccatcccaggcctcagcccacctgcctcagaggctgcctcaaagcccctgcccaggaaggggacccaagttcacccacaggcctccccgtgacgttcccgctctgaagtgattgggtaatggggtagtgacctgggaggcagccagtcagggtagaaagaggcccacttaccacccacatcatccatgagcttgctcattgtatgcacagtccataaacccccaacaaacactaatacagtcagtacgtcagaacctctcatatctttagcatcctgtgatgtgctgaactgttatttccttgcattattatatttgttttttcttttcttttgtttgagacagggtctcattctgttgccctggctgaagtgcaggggcaagatcacagctcactgcagcctcgaacttttgagctcaagcaatcctcccatctcagcctcccccgtacctgggaccacagacacgtgccaccatgcctggctaattttctttattttttgtagagacggttatacagtttgaatgtgtatccttgcccaaatctcatgttgaaatgtagtccccagtgctggaggtggggcctggtgggaggtgtttggatcacgggggcggatccttcatgaatgaacctgagcctcctcttagcacagggctcccaacccccgggccatggacaggtactggtctgtggcctgttaggaacccagctgcacagcaggaggtgagtggcaggcgaggaagcattaccacctgagctctgcctcctgccagatcagtggcggcattagattcccacaggactgtaaaccctgttgtgaactgtgcctgcgagggatctaggctgcgcgctccttatgagaatctaatgcatgatgatctgtcactgtctccatcacctccagatgggaccatctagttgtaggaaaacaagcccagggctcccactgattctgcactgtggtgagttgtatgactatttcattatacattacaatgtaataatagtagaaataaagtgtacaatcaatgtaatactcatcctgaaaccatcctccctcctagtctgtggaaaaattatcttccatgaaactggtccctggtgccaaaaaggttggggattgctggtttagcaccatcttccttggtgctctcctcgagagagtgagtgaattctctggagatctggttgtttaaaagtgtgtggcaccttctttctcttgctcctgctcccaccatctgagatgcctgctcccccttggccttccaccatgactgtaagcttctgaggcctccctagaagcaaatgcccatgttatgcctcctgtacagcctgtagaactgtgagccaattaaatctcttttcttaataaattacctagtctcaggtatttcatcatagcaatgcaagaatgacctaacacagacggggtcttgccatgttgcccagccctacattattatatttgaatctgcaacaattcagtggatctggcactattcatcttattttacaagtgtgggaagaatctagataatagctgtatttatttacccctttaagatgtataattcaccggtttcagtacttccacagagttgtgcaaccatcgccaccatctagtcccagaacatttgcattacccccaaaagaaatcctggactcacaagcagctgctacctgttcttccattccaccacagcctctggcaagtgctagtctactttctgtctctatggattagcctattctggacatttcatacaaatggaatcatgcaatatatggccttttgtggctggcttctttcacttagcatgtttcaagtttcagccacagtgtagcatgcatcagtacttcattcctttctattgttgagtaatgttccattatatgtatataccacattttgtttatcacattcatcagttgatagacatttgagttgtttccactttttggctattatgagtaatgctgctataaacattcatctacaaattttcatatggacatatgttttcaattctcttgggtatatacatggtagtggaactgctgggtcacatggtaactttatgtttaactttttggaggaaccagcaagttgtttttcatcgtggctgcaccattttgtattcccacaaacaatgcaatgagcgttccaatttctgcacatccttgtcaacacttgttattgtctttttgtttttagccatccaagtgggtgtgacgtggtatcacagtgtggttttgatttgtatttccctaaagattaatgatgttcagtgtcttttcatgtgcttagtggccatttatatatctcctttgaagaaatgtctattgaaatcttttgtccatttattaattgggttttctctttattattgagtaggagttctctgtttattctggatacaagtccttaatcaaacacatgatttacacatattttctctcattctatgggttgtcttttcactttcctgatggtgtcctctgaagcacagaaatttttaattttgatgaagtcttatctgtccatgttttcttttgtcatttgtgcttttggtgtcatatctaggaaggctttgcctaatccaaagtcatgaaggtttacgcctatgttttcttctaagagttgtatagttttagctttaacatttaggtctatgatgattttgacttgtttttttttgtatgatgtaaggtaagggtctaacttcattctcttttttttttttttttttttagacagagtttcactcttttctcccaggctgaagtgcagtggtgcaatcttggctcactgcaatctttgcctcctgggttcaagtgattctccagcctcagtctcccgagtagctaggattacaggcatgtgccaccatgcccagctaatttttgtatttttagtagagatggggtttcaccatgttggccaggttggtcttgaactcctgacctcaagtgatccgtcagccttggcctcccaaagtgctgggattacaggtgtgagccactgcacccagcccccggcttcattcttttgcatgtggatatctacttgtgattatggcaatgcaagaacagcctacaatgattgctgctcactgcagtcttgacctcccaggctcaagaaatcctcccacctcagcctcctgaataagtgggattataggtgtgtgccgacatgcccagctaattttcttatttttttattttttgtacagacaaagtgtcactatgttatccaggctagccttgaacttttgggctcttgtgatccccccatgtaggcctcccaaagtgctagaattgcaggggctcaccaccacatccagcctctctgccttttcaaggtaacatttctgcagtgaggactctaagtcagatatgggtctaagtgggtcgtatgtattaactcatgtaacattattcttcatagtcccattttacagatgaagaaactgaggcaagtagtttgcctaaggtcacacaagtagtagacagcagagctgggaggtgaacccaagctatgtggttctgttttccctgccagacacccacagagatgccagaaacatgggaatgagctagcctgagtctcccctttctagagaagaagttggtgtgtagagaaacttgtctgaggctcactgtaacagaggtaggatgagatccaggcccacactggacacttccttttcccatgcagccctgggtatttatttcaatgtcatgttgccttgacaaaatgctgagagggaagctgtggccatggggcgattccttgttgccctgggcttcagggccctgagtggctgctcggtgagagggtgagggcaagacaacagaaagatggagaagaatgggcaggaacccaggtcttccctttacaaaggaagaaggctgagccctgagagggatgtgcctgcccagtgctcctggctccctagccttcgtttctcctgccaccttgctgctccccttcacaggtcctctcctgggggccagtgctgccaggaggaagtaggcagaaaggagctgggaccctctcttcctcttacagttttctagggctgatcttcaaaagtgaatttgcggagccttcctctgtggcctccctcactccggttgtcatcacggtcatttcatttcctttactttctgcccatctgaaaggcgccccgggatgtggtgggggtggacactagtggcttgccaggcgtctatccctgggccctggagacccatctgcaggatctgcccaacaccccatacaaagcaggcactgcacctaccccttagagaggttccccaagaaggccaagagtttccctgaggctggagaggatgaagggcccaggcctcaacttgggagctcagccaattatcgacagagaggacagcgctaagcatggcactcagataccactggaaagacagctcagggccaaatccaggagtcaggagtctacagccctcatggggctttccgagagtgccagcatcatcattgcctttaggagaacagcggatgtcaaagggaagcatcgtgccaatggtttcaaagggctggagccaataatcacagcacagtgaccggctgcccctttgcacctctgctgtggccagtgaggacagaaggggattgaactagaaactgggattaatctgtcttcagcttctcagatacaggtaagacctctctcctcttctgggcttcaaaaccctaaaggtgagagcttccttaaaatgtgtaccctggcaccttgcttttcttaccctagtcctggccttgtccataactcagtatttttttcttttttttgagatggagtcttgctgtgtcacccaggcttgagtgcagtggtgtgatcttggattgctacaacctctgcctcctgggttcaagcaattctcaggcttcagcctcccgagtagctgggattacaggcacgtgccaccatgcccgtttaatttttgtatttttagtacagattgggtttcaccatgtgggccaggctggttttgaactcctgacctcagatcatccaccagcttcggcctcctgaaatgctgggattccaggcaggagccaccttgcccagccataactcagtcttcaacctgccccatccaagctgtgttccaatcaggaaagcacagaaaggccttttcctaggcaacggattcaggcacagcaggtggatgcaagtacagtctactccaggcgtgtcaccattggaacaccccattcccttccttcaggcccttctactccctggggtccacagagctcagggagcctcttgtggcccatggtgtgcccctctccccacctgctccctcagcaatgacaagatgcagtgactggggatgatacatcaatgtcttgcaggctcccaggagacagataggcagaccctgggatgctgatggcgcagtcaccaacaggaaggaaaatgagaggagactgcagggcagatggagcttccgcctgccaagagccgctgatgcccagtctcactctgggcagcatggccccatccctcctggccatccaggagtgaggaatggggctcaccaatgggggacctctcctcatcccaggataggcctctccatccctcctcagaacaagcgaaactggggagtggggaaatccacacagatcatgttggtttgggtccagaaacttgaactaaaccaagttaggatccaacaacaatatcgaatctaaaaatgatccccaatgtgattttttaaaaactgaatcaaagtgttaaaaaaaaaaacttggtgtactatagttagatttgtaattaaactttggtactttctaaatctactgaactgaaaggaaaaagaaacccacgtgatctggaaagtggcttggcctactttagtgttgtgtgatcttcagtaagtcacttgccctctctgggcctcagtttccctcacttgtgtcagactggaaaatctgaacagttctcattgctgtttacctaatccctgaatctcaaaatagtcttcaaatggactctgccagcccttccatgagatgcaagttcccgtttggatggcaaccaagccaagtcatctgcagaaggaacgttctctgtgtgccatctgtgaagagcctgggaaacagaggcctgagtgctggggcttggggagcatgtgagtctttagagccggcactaatgcgattatgggattagaatgttcatcttcgttttcactgtgcttcatttggtgaaatcaatagtgacaatgggctgcccagttggtgctgccattctcccaggagggcccacatccagctactcagggcaggggtcatcctgagagctggatatcactggcaaggctagtggtttgggaggctttcatcacccgagacatggcatgccagcacccatgagggaaagaagtcagaaaagacagggtagaaatgggtgtgatcaccatgggagccaatattccccttttacagaggaagacacaggcaggagcctggactcagcctgggccgcccgctgatggaggcagtggccatttttgcctgcagtttctcaactgtaaaatggagcaactcactcctccttctctgtcctacagagaaacgatgggctcatcactggatgagaaagtacaacttagcttccagaacttctgcagagaggaaacagaacagaagccttaggaactattattgtcatcacagtcattatccagctctgagggagcagcagcaaggcctggatgctttatggtgacagcgggtctcaccttttgtgcaaaagctacagctgcatttcaacaggaaggcatcaagcctgagaacatggcttaatctgcccacagaccgggggaaaccctgcagggcttctgtaaccagagtgtgacgctgacactctgagttgcgaccacctctcctgggtcactttgggtgttggctcgctttgggggtccctggactgagctcatgcacagataatgacagttcacgcggctttcactgaacaacttctcctggtcaccggatctctccagtgtccctccctccccactctatggtgaggcctggcctggagaccacaggagtgggagaggaactgagtcccctcggcttgccatgtagaaagggacactggttctctgtgacccacaggtggtcacagagaccacctctgggcataggagaaatgggtagatgttatagggagactggttttggccagtatcttaatcagctctggttgctataacaaaatacccctgggtggcttaaacactggatatttatttctcacaattctggagtctgggaagtctgagatgaaggtgccagtggatttggttcctggtgagggctctcttcctacttgcagacagccaccttcttgctgtgtcctcacgtggtggagagagggaacaagcttgctggtgtctcctcgtcttcttatatggacactaatccgttgctgaggccccaccttcatgacctcatgtaaacccttgatttcccaaaggccccacctaacaccatcccactgtgggttacccttcaatatatgaatttcacaggacacaaacattctgtccagagcatccagtattggaaaagacagaggaacaatcctctgagaacagacaccaccttgcgccctttcctctggtgttccaatggcaggaaccctctgggaggagtctgagaatgggtgggaagtggttctccttccaaacatgagtttctgtgaccagggctggaactacggtgaggcaatgaaatgcccagagtgcaggatttaaggcagcactcacactcaggggttgctcctgggattacaaaagcctgaaggtcaggggggggcctccttaaaatttgcacctggcaccttgtgtgtctcaccctaatcctggccctgtccatgactcagtcttcaaactgccccattaaagatctcttccaatcaggaaaacataaaaaggtcttttcctaggcagttagttcagacacagcaggtgagtgcaggtatagcaggcaggtgcaggtacagcaggtgggtgcaggtatagcaggtgggtacaggtatagcaggtaggtgcaggtatagcaggtgggtgcaggtatagcaggtgggtcaggaacagcagaggtacagtctacttcaggatgtcaagggaactctcaagcccgttaacccataaatatcaggcacggtcatagcgttaccctggcagatgactgccccagtctcctggtcaagatgcatgcttactctgaaggccgggggaggaaaatgattaaagtaagagagacggaagcctttcctttgatcagggaatattcacacgcctccacaagaaaggaagaaatgaaaactcatcgaatttccactctaggtcagctgtctgccacttctgcatagttatcttatttgatcctcaacacagcccagccacaggggcatcattctcaatttacagataaggaaactgaggctttgggacaaaggatttgtccagggtcacggagaatctgagaatcagaaccttaggtctgagaccaaggccagcgcctcacattcccaaggcaggaggtatcattccctctcactccctcatctaatcaccctttcactcctgcagcacacacagcgtaagggcctgtgaagaggcaggaacaattctaggagcttgggagatcgcttgcattccagtggggactgagagagttaaaagtcaacagcacacaagtaaacaaacaataagagccatgaatgaaacagggaagacagggaagaccgggctagactggctagatggggtagggccaggagcatttgtcctgaacactgagtgaggaggaaccagccaggcaaagatcgaggggcagagggcacgggtgctggggtacaaaaggtgagtatcggaggcatggcaggcagggacagagcatgaggcagagagagggtggaggggaaggctgtgagcggatgaatcccagcagaagaagttgcatttttttctaagtacaaagggaagccactgaaaagatttaaacagtgaagctgcaagatccaatttaccaattaagaagatccctccggctctagtgtgcccaccagccgggacgctggaggccatgtggcagccagttgctgactggcatcattccaggcaagaggaggtggcggcttgagtgacagtgggagctgtgagtccagagacactgacaacgctgcagaatgccttttgggcagagcttgggcctggcatcctcagaggctggctaggggcggctggggaaataggagtcggggtggaatcactgaaagccagaacccaggcccagccttggctcagagtgaacacacagtccacacttgatgagtacatgaagaaacccaaagagaaattcaggactatctttttgggcagaacctccttcatgtggtcccacccacatgggtggcaaacacagacccagcacacctccagcttcctggcaacactgtgcacggtctgagaggcaggcaactgcagcccagggagctggaaaaatgagattctgaactctggtttgctccttttagctttttaacatgcagcctccatcgcttcatttgcccacagttgtccagttcttatgccaggcaggagtgaacctgccttccgaggggaacgttgccaggaggaagggagcccggtgagagtggctggtccttccaccacctgagaggcccaagaatcattgtttcattgacaataacgtggggcatttagtattcatccaacacaaacgcatagctattatacaccacctttctgagagtaaaagctatcccttttatttgggggaagggcatgaaagcaccttctccacttaaaatgctgatcttactgtgcattattctttgaagtacaatgaaaagtgtcttggcctaatcatgactttccgcgggggcgacagagtgggaggaaatggcccctcctagaagcacacaggggacttattttcaatctttttaaagaagtaagaaaatgcaaaccataagtaggtttaaatgcttcccctaaaaccccaaaacataatattatcatacaatagaggtgctatcaagtcacatagtacaactctgttccctaaccagctttgggggacaccatcgtgccacatttctgaagcccctgactcgtagtccccatttgccatgctgggctgggagtcaggctgcagtgaaccccaagagggaggtcccctggtgctctgagaggtaggacttgacttccttcttcccggggctgcagcctagggaggatttccgccagaaggctcaaatgtatttttgtttatttacgatgtcttacatcttttggaacttgtaaggaagttccaacttttggaacttggttcaatgttgcttatcttctctgttccatgtttagtttcatattctggttcatctggtttttgttttgtttttttttgtttttgagacagagtctcactctgttgtccagcctggagtgcaatggcgtgatctcagctcattgcaacctctgtctcccgggttcaagcaattctcctgcctcagcctcccaagtagctgggattacaggcccccgccaccacacctggctaattttatttttagtagagatggggtctcaccatattggtcaggctggtctcgaactcctgacctcaggtaatccacccgcctcggcctcccaaagtgctgagattacaggcatgagccatcgcacctggactggttcatctgtttttgaagctggataggatcccagttgtggcccctttttgaatctctaaatagtgactatcttttgagcctgtccttcgatcatttctggttccctggctcctgcccggcacccctgcagtcagcagactgaacgcccaacagcgccagaccaagcacatcccgcttctcctctctcggcgcttccaggggcagccagttcagagtccaagccacagtcttgacacaggccccacttccccgctggccttctccaccacaaactcctgctcatgtggctgcagccacaccggcagctgtcggctctgactggctctgcctcagggccttggcactggcaatcccctctgttcaaacgtcagtgtgtcagcgaggcctttctcgaccaccctgtttaaaagagcagccctgctccaaatgttccacctccccttatctgctgtacttttttccatagccatttccatggatatccctagacacggctttgcttcgatacctgcctccagtcttcctgctgtcactgggatgaccagacaatccgggcaggaatttttgctcagagtgaatccacagtgcctcgaacagggcctgacacaaagaagacccttcctttttttttttttgagatcgagtctcactctgtcacccaggctggagtgccacggtatggtcatggagcactgcatcctcgacctcccaggctcaagcaatcctcccacctcagcctcccaacctgtagctgggaccacaggtaaatgccatcatgcctggctaattttaattgttttgtagagacaggctcttcctatgcttctcaggctggtcttgaacccctggattcaagcaatcctcccacctcagcctcccaaagtgctgagattccaggtacccagacaagaaggcccttcctaagtagttgctgaacgaatgaatgatgtgaacactgcatgaactggggtcagtcctggattcaaatcccagctcacagctgagtgccactaggcaagttaattcactgccctgagccttcatttctaagtctataaaatgggcaacataatccctaccgcagagggtggtggcagggactgcacatcagcctctcagccctgggccaccaacacagagtacctaccactcaagatcttgtgcctcaaatgggctgttcagctctgagaatcttctcctggggtcctgtcttgcatttactcccctgacctacctccccagggcaggggctgcctgagcttctcctgtatcctgggggaagaccttgattggactgtggttgtgggagaaatgaatggttggttctaaaaacccaatacccccacgcttccctggggcttctaggacaccttctaggacacctgtttgctcagttttgcaaaatggagcaggttgaacccctcggggctgtcctgatgacatggagccttctttgggctggagcttagacctggaggctccgaaccactcacaagtgacgttcctcagtggcaggaacccagatttcccacattcagcacttgaaacaaccatgacacacatcattctccaaggggagcccaattcacccagagcatattggggtcacttcagtcagcgaaaatggcatctcaaccttaatggggcatttggacaacatcctggtcttgaaaataaaaatgaagctgccccctgaggtcctcccaacaatcagcacctgcctgtccccgccgttcctggcagagttacatgacctcacccgcgggatcttgcctgcccaccctggagtcacctggtcagggcaggggcccctcatcccttgatttccccagcagctgcagctgggcccactcgcgctgccagacctgctctcactgcacacggaatgagtcctgggcttaaacctgcagcatcctctaaagccctttcccctgacatagcccacgtctgtgagaactgcattcggacttagtttccccggccagcgctccagggcgctgttaaacccagaatccacatccccgtgcaggtgtgtttacaggcttcctccactagggatccaaccctcctctttacatcgccttccctttcctctctcttaaagggacaggccaagggccaccaactggactggaccacaagcctgcttgttgggctctcagcttaggaaaccatattgccaaggccccagaacctgaacaccagcaagctctggcctcatggatggcgggtcccctgggtcctgtggacacacgtccttcttaagtccttccttgccagttctgagaaagcccatttccttcccagttcggctcatctgagctctggcaagcacatcagccctacgggcatggatgcaagcagggcacgtgccctcgatcctctcactacagagatgcgggagcaacggtggaaggctcctccgagcaccacggtcccccagggatctgggggccccacagactttcccactcaagacacagcctagaggcagctgtctgcctggtttgctgctgactgctgcacctagcatggcacctcgtgcgcagagaacattttgctgcataaatgcagggaggaggaacacaagaacattctcggtacatactcatcgtacatgagctgctaaggcacgcagggggcctgtgggacgggctcccgattcccctctttccagacagaaaaccaaggcaccaaacagctcgcttgagacttgggagaatgaaggcttggtgcccggaagcgccatctctctctttccggcagctgcagggtgttaccggggcaacagacggctgtctgacgggatttggcagtttaactcttactccgcacaaaatacgaaagtgagaacgattgaacagatgttcttgcttccgaccgttcacacaacggagaggagctcatgattcatctggcccgggccgagtccacatcattcctgtctcacacccagcaggtgtgggccacctggtcccctgggaaccaaaaaacggccttcaacctcccaaactctaggattcctcaagggcatcaaattcaccttccagcctgggctgagaagactgagctgggatccttctgaggtgcaaccatgccaggcctagagcagcggttctcaaacctcgggtacatccagataacttgggtggggaggaggattgctaaaacacagcaaccgtgccaggtgcacagcagcggttctcaaacctcgggtacatccggactacttgagtgggaggattgctgaaacactgactaagaaacacagagtttctcattcagtatgtcgagggtagggcccaggaatttccatttctaacaagttcccaagtgatgctgatgccgctggtccatggaccacccttgggagccactggtgtatacagccttcccactcagaacacagtgcctgtaccatcaccattagcatcaccgagaaatgtattaaaaacgcaagttaggccgggcatggtggctcacgcctgtaatcccagcactttgggaggccaaggcaggcgggcggatcacgaggtcaggagatcgagaccatcctagccaacatggtgaaaccccgtctctactaaaaatacaaaaaaattagcctggcgtggtggtgggcacctgtagtcccagctacacgggaggctgaggcagaagaatggcgtgaacccaggaggcggagcttgcagtgagctgagatcgcaccactacactccagcctggaccacagagtgagactctgtctcaaaaataaataaataaatacataaataaaaataaaaatgcaagttctcagaccctgccctcagacctctagaatagggtctctggggatggggcccaggaaaccaggttttaacaaaccctccaggggatcctggggcgcactgacgtctgagaagccgtggtctaaaccttggccacctgtgagaatcacctgacgagcccttccagtaaacaggtggcactctgatctctggggctaggtcttagcctcagtcatctttcaatctccccaggcaattacgaagcttgagaaccatgggtctagagcctcactactcaaagtgtggtctcggaagcagagataccagcatcttccgggagctggttagcaacgcagaggctgcacccctgcatctgctgagtcagcccgcattccaacaagatccctgcgtcataggtctgcatgacagtgcgtgatcctcggatatagagacccctcctgcccatactcactggcagtgcaatctatgagaaaagcattcatcttctctggggctcagtttactcatttgtgaaagcggttcactatgtaaactaggcaacaacacatccctcctatggcaactgtgggatccagtgagatgacacctgagttgcttcactgtaggggcgtgataagctgctgtgggaaactcccacacctcccagaaagcctcagtgccctctctctagcccttcttaactgcctggcccctgggtctgatgtttcttgggggctatgccaggaggtgggagctggaaaggctggggctgcccgaagaggctgtacaggagccaagaccaggtggacagtgcaggcagcactgaggcagaggtcggggggcgtggggtgcctggtctggggcaatggactgacaccagagtgcccagccctggagctggaggccaggctctgatcacaggaagtgggcaaggtaacaagaggtggggagggttgtcctggagcagcaaggaaacagggcagagggtctgcagcaacttgccggtgccagcctctgcattcagcagcaagaaagcagggcaaaggacctacagcgacgtgctggagctggtctctgcatttgttttccaggaggctcctgctcctggcgggtggggtgaggccttaggtggtgggtgcaggtgggacaagcccactgaagtcagagagctcaccctgaggatgcgctagagagcaggaggacagtttccaggctgcctcggctctgcactggacagaaccccagagccctaggagattccatcagagcccagatggatacctcggcccctcagccctcactcggcgccctccgggctcaggggccacctgtggacatgcagaggccctgcagcaccccccagcctttcctgtgagcgaggggcctgttgctgctccccctggtacccagggtctgtccccctggatcctggagctcaggcaggtgggagtcgcctctccattcctggccttgcatccggtctgtgctggtgtttgaaccggatctcccaccgctcctaggcctcccaggttcccctccgtcctccgtcagctgcccccacttctctctctaccaaagagaaaagtgcctctgcagattggactcggctcacccatttaaaaaattagagaacagagaagttagcatcttaataagttaaatgaatcagtagaatgtgtgtctctttcccttccctgtgggactggaatcttccatttccctccaggtgctctccccagctttgtgccctcagggctggcctatggcccccttcggttgagttgagacagtgtcgtgggctcctctgcagaactcattctggattgcagtgaccctccctcctcctgtcctccaggcctagggtgtttgttcctagctccaggggatgacaccagtcctcggtgtttgcccacactctgcccaccactgtattaccttctccccagttgtcagctcaggagcattccctctctcctacctgaccccatcggataaaaccaccaggaggagaaagagaaagagttggtggagtataaggaaaagaaaatacgggactttgaggaagaacagagaagaaagaggaaaatagaaggaggaaaatgagaaagatttctgggcacagggctcgggcagtccaggggctctgggactggggagccacctgcccgctctgaacagctgacagccgctccagcagtctgccctctcagtaacaggagtggctatccttttattcctaacttccaatttagtatgttcaatgaaggcctattttccacctaaaagttaaagttcaagaaagggcaaaataagaactaaaattgtcagaaatttccttaggaaactggagcagagggtcctaaacttgagtgcgccagaatcacagtcttgtgtgacaaaaatcctgattgtcaaaaaccgcccctagaaattcttatttcctgggtcagaggttgagcctgagaaccggtattttttacaagcactgcagggatcctgaagcaggtgctcttagctgccactttgagaaactccaacttagatgcatggttcctgaaactctccaccacacccataaactgccagcttgccacccaccgtgttgctttggaggctgtccagacttttagaaattatgctccaatagtctcagatcaagttagatctggttgaggatgtcacccagtggtatccaaaggaactccgggaaaaggactgtccaggaatagatttaattaaagatgatggatttgattctacatattagtagatacaagatctccctgtgagccaacaggacatgggaaatgtaggtacgtgtcctatgcaggcatccctggccagaacacacagcttaaggggaaatcaagagaatgcggagtaagcccaaaggaagacctaaaacagaatcacgggctggtgggacagtcatcctgaaaggccagaggaactgttggagcacagcctagagacaaacactgagtaacgttctttaacaaggactgaacgtgaaagatggaaacaggagccccccacccactggggctgagctggaggctgcagccctgcccctagccaggaggccacagtatatggaagaagctgatgtcccaagagagcttcctgccaagcctgacgctcacctgcctggggtggtttatttgcagtgcagcccgaagatgggatatgctgccgtcccgcctctcacccatgtgaggaacaggcaaatgctcctctaagctcccatgtggggtctctaccgaaaccccatgctgaccccagaggcccacagaccctgccaagttcaccctgctcaggtgataagtcggagccccaaatgctcgccacagatgggtggcacttgtgaacgatttcactgggctgtcacctctcgcaggagtgggctgttgggctctggtcagatgcctctggctgctctctgtgctccgggaccccataactcagtgcatcaccacacctttgcatgtgttctctggaggcgagggaagacagacccagttcttcaactgtacagacatatctgccatccaagaggacagggtaccaggtcttggcagagtggtggcctaggggatgggtactgaggtcgcgacagccctctgcatcatcacctgtccaatgagggcactggaccaaacattttcttggatcctttctgatcttaattctctgtgtctggaacctaacatatgatactgtgaatatttattctccaccatgtgactggcactgtcctaagcaccaagacacaaggtctcaataacacaacaagcactccttggaggatctgcacatgaaactgtcacagcccagaaatgccccagcctcattgagatgtctgatctcaatgaggaagacattgagatgtcttcctttgcaagacacagtgtctcaactgttcattcctgtgattctcagtgtttttcctcatcagggtggattgttaattcattaagcatttattgggcctcagttttgtctgtaacatacatagactaaattattttaactagagaactacctttactgggataaaatgtaatatttttgcccttagattttataaaggagcaaaatgaaaaggatccttaaaaaaaaaaaaaaaaacctctgtatcattaacaaaatttcagccagacattgttttttctgcctttgatatgaagactgtaatagattccagtgccaggaagaggtctctctcctaaggagaatctgaagcacccttttatcagaaaatataacatgtttccctttttgtctcagctgccaggaagctcagaaataaactgagtgttcaactgcagtcacattcaacttaggaacctggcgtgtctattctttgacctcttctgcttggggtttttaaaaattctgtattcttttcagtttcctgttcttgtgtgttttaaaattacaagcagcgccgggcacggtggctcacgcctgtaatcccagcactttgggaggccgaggtgggcggatcacgaggtcaggagatcaagatcatcctggctaacacggcgaaactccacctctactaaaaatacaaaaaattagccaggtgtggtggcgggcacctgtagtcccggctactcgggaggctgaggcaggagaatggcgtgaacccaggaggcggagcttgcagtgagccaagatcgcaccactgcactccagcctgggtgacagagcgagactccatctcgaaaagtaattaattaatttaatttaatttaatttaatttgaaataaaaaaataaaattacgagcagcctccatacactttggagttgagtagggatcaatattccagagggatcacagaacatgaaaactaaaggagaccaacccttcctctaggggaagaaacttaggcccagagaagttgagcaacttacctgaggccaatcagtggtttggccctgcccagcggtcctaactaccttcactttttgtaccattttctcaggaccatggaaatatcccctcttgccaatggggacactaaagtcccaaagagaggacggatgtgggctctgcacacaaaggaggcaggggacgctggccacccaccacctcgtcctcttgctcagatcttgggccaccatggagcccactgtgggaatgaggaactcacccattcagataatgtgtgttgcttgttgcagtaggtgtcatatacaataaaggaaatttttcttggggtcaaatttattgttgatttccaaaaatggattttttagtctcatctccttgccacagctctttccctccacctccgatcaatcccactggaccctagccccagaagtgacattcagttgaatgcatcagtatctcggacctgttgttaaatatttctgttgcgagtgccaatcgcctctggctggaacaccctgagtgccttccgaccccgactgcttgggggttcatccgggcccagctggggcctcggggtgacctcgttttttatttgactctaggttctattttgattatcagcccagcctaaacagaacagagctctctaggaaaaaaacaacatgaaattcggggtttgatgtcagaccagtgtttcagtgtctgctttgccaattactgaccatcggcaattaccaattctttcctgctgagctgattcaaaatggaaaggacagatatgtgcaagcattctgtaaactccaaaggctgctgcttatcagtgtatggtcttgggatgagtcagcaagccaggaacgaacaagcttgctaatgggcactcccgactgaagaatggatggctgagcaaaatccttatcatggaatcgtattgcacattaaaaggagggatttctgacatgagctacaacatgggtagaccttgagggcatcatgctgagtgaaataagccagtcacaaaaggacgaatactgtatgatcccacttatgtgagctattcagaggagtcacattcacagacaaagtagaacaggcttgccaggggctggggaaaagtggggactggggagtcattgtttagtgggtacagaatttcaattttgcaagataataagacatctggagatggatggtggtgatgattacacaacagtgtagatgtacttaatgccacagaaccgcacacttaaaatcggttaaaatggtcaattttatactgtgtatattttacgataatgaaaacatttttttaaagagctataccaagagtcctgtgcacaggttgtaagggaaagcctggcctgcctctgggaggaccattcatgaactgttcatggtgtttgggacatttagtttgcccattcagtaggactttgctgtttctggtttcttgatagacgaggcttacgattagcctcttcaagagtggagttattattgaagatgattcagaatgttccctgagaacacgcattataggactagagttttaattaagaggaattgatgaaacatctattttgaaagagtgagcttggcccatgttatgagctgagaatttaaaataacccatcactaatgggtcatatatgtcccagtgtcttagttggacagagagaaaatgccacactggccattcctccaaggtcagtcatcaaaatgcccactgccctgaaaacctgcaaggggttcccctaaatgggttccatgggttccctggcccctggaccccaacctgagaagtaaggagagagtgatattatctgagagctccgtgtgcaccagccagtctttcccatacattctttcattcaatcttcccaaccaccctctgaaacctattttatccccgttttatacataagaaaactgatgctcagggaaagcgtaaggctactgatctttctttctttctctctttctctctttctctctttctttttcttttttttaaaagtccctgttgcccaggccggagtgcagtggaaccgtctcagctcactgcacaacctccacctccggggctcaaaggatcctccacctcagtctcccaagtagctgggactacaggcgcatgccaccaggcccagctaattttttgtgttttttgttgtagaaacggggtttcaccatgttgcccaggctggtcgtgaactcatgagctcaagcaatccacccacttcaccctctcaaagtgttggaattacaggcgtgagccaccacacctgtccactattgctatttcttgagtgtctgcttcttgttagcacagtgcatagatactttctaaatgacttcatttttctggatgttattatcattccagtttttttttaagtgggaaattaaagtccagagaggctaagccatttgcttaagatcacacaggaaatgaatgataaagctagttcaaatatgtatttttccattggtccagtgatctcttgtcattctctctcagttggctctgtgaggagatggtgggggaggaagagtaagtaccccaggaggtacttggcagcttgctgggctcaggagatgctggtgggctcccacatgttagctgtaagcgaacagagcactgggcatttctggctttagtgaataagccgggaattagagtaaaatatgctgcacctgagagggcctgtgcctggtgggaagacaggtgaagagcaccttggccacagtcacagtgagaccattgccagctaattctctcctgagtttccttccaaaccaggtgagggcaacagagttgaaaccacccgctcagagggaggcagatgctccccagaaaggctaccatctccctgaccaatcctaagcctgggccacggaccctgccagactctagttcccaggcagctcagccacatactgagccatatctttttgcaggaaaagtaattttttatttcatccccactcccagcttggtgaggaagaggtgacagtgagaggctgggttaacaaacactcaggccacctggaaaactctctcatatttgtcttcattctcaccctctccctcctgccaagaaaagttaccccagtgaggttctccttcttctccaggaggtgcttccatagaaaaagatgccaatgtggcaagtagtgaaggaagcgcacagagctcgaggtgggaactcctgggctcctgggggatggcagttggtgttcagcaggtgcagatttcagccggggaaggtgaaaaggttctgtagacggatgatgatgatgcttgcatgacaacatggatgtgcttaatgccattgaattgtacacttacaaatggttaaaatgataaatctcatgtgatgtatattttaccaagcttttttttaaaaagaacatctggtttcaaatcccacctctgccccttgctggcaggtgaccttcgggagctgcctatctctcctagaggcctcggtttctctctccggaacacagtccttgctgccctgatgctcccagtacttgcaggacccagacaaagctctggcagttgtgctgatagcaatggggaacctgagaggaactagcaccctcctgcagccaacgatcccttggctgccccggcagggggagtgtgggtggcaccatcccaggctgctcccccatcacccagccttcaggaggcttcgagcgacttctccaagcaaagaacacagtgcattgaggccagctgctgcccaccaatcaaaacaagtccagtgtcctccccagcgcgcctaaaggcaggtgcaggtgcactgccctacaaagcaaacaacagccaagagccgcctttggtcctccgagctagccagagccacgtgcttgcccactgcgagagtttccatgccctcgcccaccacctgccctgggcacacggctgaaagaaggaaaattacacctctgctggggcccacgccactgcacaacgcgtgtggtctcgcggatttgtgtgactcctctctgggctggaggaaatggagacatctgtcccagtgagattttcaattaaaggggaaacaaagccccattacagcagcactggcagggggctgggaggccagaattcaaatcccagctcagcccagctgaccgcaaggccgagtcacactgtgtctgcttaggcctggccacttccaccacattctgtagggagacttgggttcagattctgctctgacacttggtcaattcactcaatctccaagcctccctcatgggaacacggaggtatcaaaagcgcccaccacgcagtggctcacgcctgtaatcccagcactttgggaggccgagacgggcagatcacgagatcaggagatcgagaccatactggctaacaaggtgaaaccctgtctctactaaaaatacaaaaaaaattagctgggcgcaatggcgggcgcctgtagtcccagctacttgggaggctgaggcaggagaatggcatgaacccgggaggtggagcttgcagtgagccgagatcgtgccactgcactccagcctgggtgacagagcaagactccatctcaagaaaaaaaaaaagtgcccccccccaacctcgccaccatgttgtgggagggtttagtggggtcattagcagaaaagtctatttgttgaatgagtgactgattgtaaacaagcccacccaagaccccagcagggtcctccttccttcccctgccatgggcatctgaccccatgtcatggtggaagctcaatgaagggaaagctgccaccgggaagaccagctcccagagacccggaggcatgcagacagcagctcatccagtccccatttgcaggacaggacctgagaaccagatacgcctgcaggtgcctgtccctctgcgccccccgggtggtgttagggctccctgtgcacggaggcctgcaatcatttggacaacacatggttaccaggtgtctgctatgtgccaaacgatggtcacaggagggtgagaaagacagtctccacgttcaagagtacaaagtccgtgatccaggaagacaatgaggcagccactgtgtctcatttctggatgaatggatgtcacaaagccatggaagtggttcagtggcttccatatcactaggctacctcgcctgtctctctctctctctctctctctctgtctctctctctctctcagagcaggctacctaggattttacttgcaatcctccaatagcgatgtggcctccctgaaagaaaacatctggctgcctgagccccagtgggctggggggctacactgaaccaaggccatctgtgtagatgcaggaggtggtccctgctgagcgtgcatgccatggatgcaggtcgtcttccccagcccatcccaccacaacaccgaggccaggaccagaaaaggatgaacagctgccaagggctaagcagatccaaaaaaggccaggtgacatgcccaagatcacacagctggtgaggttttctgactctgcatccccaagagacctcgtctcacaggcactccctttacaagcagcctcaagacctccccaggttggggtgcactgcagaggttgtccaggccagcaccctcattttactaagatggaacccaggaggggtggcctgcctgaaaccatggagattttcaatagcaaagaaagccctagaacccatgcctcaagggtccattggtctcccccatcccagggacaccctgccctctggtggccaactggagaatacatgtggagaatgacaaattccctaaccccctgcacaggttaagagatgagactctctaataagccaagcagtcagccagtgggtctagggaggcagtaagtcccccgccactggaggaatgtgggatgagactaaattacaaccctggatgcaacccaaaatatgtaacaacagaactatccaagccccagcccattagcatgagccatcttcaacagccaggacagctgaggctgggcaccccgactaattgctgttgctgtgaccgctctcagagacagatgagtgctaatgtccctctgcctcgaaaggtctatcacggaggtgggttcggggatagagacagtgcaggggtcatagaacgaggagaagttttggaatcaggcagtaacgtgggaaggttactggaccactgtcacaggagtaatagcacataccttccaagtgtgtggaaggatccagtgagctaatttttgaaaagttaacttttgaaaagctaatttttgaaaaagtgtggaccctcaataaatggcagccgttatcttggcaactggtggtgatacaggcgatgactccagaacgtaccattttggagcagaaactgtcacccacatgtctccagctttcaggtttttgctcttttgattaacattataaacctagtgggtctgccttatttagcctccttcccatttcatcagcaggaatgatggaaatggaaagcaactggcctctatttcccatgcacccactgaggtcctagtgacactcaatgagggcctagccccacccccattaccatcaccacctaagccctaactcgccatgattcagaacagattcatagcagagaatagatttattgcctgatatgcatatttaatgactttcaaggatagttcataactacaccatgcaatttattggtatttaatgttatgcattaatgaataatgtttaagccatccaacactggccaatttgagaaacttaatataacattcaataactcttgtcaagacttaataaatttccatggatttatacatcctgtgaaatgcactccatctcaaacaaattaaataatgcatgtgatgatgtgatgggggagggggaagacgatttgttgaaggctgatttgatgggaaacaggtgtattttatcacttgggctttttattagggtctcgtgcattctcctccagagaaagaaacaggcaccccaagacactcggcccaaggtagttaagccagatgcagatcattctctgcccttaacatagatggaaatgagcttcctccagctttgcttgaccctcttcacttctttgccttggttctttgctttgacaaagacgcccaccctctgcttcagccatagaccccagtctccctccctggccaggggcagccagacaactcctccccccgtgctgacgcacggccttgtcccatgtcattcttctcccttggaaacttcagtggccaccgtggcctgtgggcagggccacattgcttagctggacgttccaggcctcccagatgtcatcctgccactggcccagcttcagccctgtgtcatctcacagagaccgtaccctcgggcaaattactctgctgccatgcccagacccatctgtccaccccctgcctggaatgcctcctgatcatctaatttttcctatcaaagcctgcttgactttagggacccaatcccatcttcaatgtcacctcctccttgcagtcttccctgaatcccccaatgagaaagagctcactgtccctaggaggttctggggatctcacggcacatcctactctgcccctccctgtttcctcccactaggaagggctcctggaagggccaggcccactagcctactcccccaacccccaagggcccagcgaactcaataggaatttgttgaaagaacacataagttaaccgaataatgctcctttgtgtttgcagaaaaatgaggaagcaagcagaaggctcgggtcagcagctacaggggtcccagtggccccaggcagccagcacgttcctggttcctgggggacctgccgagaacccaggccaccttccaaggggataaggcagcaggacctccacaccagagccagtccctttcacagtctctcctccggtctggtcctttagaaagacccccgaccctctagcccctgaagcagccaagacagttggtcaagccacttcacctgcctaagccatttccttctctgtaaggtgggttgagtgcagcctggctcctccttgggggacacacgaaatcatatgtctgcaggtcccttgtggacaagtcaggctgcctgaaacggacaatggccacagcagctcctgaccctctgttccctgtggctacttggaccctccgtaggggttttctctcagctctgagtgaggaccctgtgctgcggggaggggagatccagggctgtgccgtcacgcacagactcccaggctgaggtctttccaagggcagagtggtctctggtcctcttggtgtttgggggacttataaggacatctattgtgaccccaagggaagagtcaacaggcagggaaggtttcttcgggttcacacaccacaacccaaccctgctgctgccccgtcctggctcatgccaaaccctgaggcagacatctctgtcccaaggaaaaccccatctgagatgaacagacaggggagcttggaatgagatgctctatgcaggcctggagcccagaaagggagtggcctcagagggagcttcaagaagggggaacgtctgagcttggtactaaggatgaggctgcagttccccactgagaggggccttccaggcagaggcaggaaggccaggttctggagtgcccaggaggtctggggagggctgcagcttgcggggctgcaggggaaggggccagatgggtaagaaaagccccctgtgttcagactgaggagggctctgaatacaaggcagagatgtccacaccagatcccatgggtgacagggagctatcaacagatattaaacaggggattgatctaacctggcttataagtaggaaaggccactcaggaatgtcagttccatgaggacagggatgctcattcattgtgttcactgctgtttccttaacagcaggaacgtgcctagcacattcctagcatgttgtatggattatgattgatggattttaatacctatctattatcgatctaccatggattaggactgatggataatggtatctatccatgttacacggatcatgattatggattatgatctctgtctatctgtctgtctatctctctatctattgacctacccaagttgtatggattatgactcgggattgtgatacctatctatcgtctatcacctatctatcatctatctatataccacggattatgactgatggataacaatatctattcctgttgcatggatcatgaataatggattatgatctctgtctgtctgtctatttctgtatctactgacctacccaagttgtatagatcatgactgatgggctgcaggctggagggattagagacagggacactggaggtggcagcagaactccataagctgtttcagaaaaaaaaaagagaagagcccaacattgttctttcgtgtgtttgaagggtcaaaataccaggtagctgtagatgctttttcccattttaaattcctacccccactatctcccaaagcctttgttgtcttctactctcccactgtcaaccaggcccagacaacagattaatgctagtgagcaaaggaacagctcttgcaatactgagagatgggcagctgtggccacttttccatggaaaaatgtgtgcttgtccccagagcatacgagggggtaaatagattttcgagagtgaagttatgaattgctcccatggcaggattaactctagcaatagtccatgtgttttcggatgcactgcacgttccaggtgaggcccatggaggcctcaccagaaggaagggccaagtagaggagatatttccaaggcagtcaacaaggcttggtgatgatcagattgcgggtgaggaggacgagctttggaaagagatgaagcgtttccagaaagttgccagatctctctgaattccactaacaaagacattggaaagaagtagttcaaaagcaaaagatattctgccattttctaaatgtaaaaattaataaatgtatagacccagggatctagaataagcctcccaaatttagcactgaccgcacttccaggtgaaaaaatataacagaacttctattaaagatgcccaggtagtgtcattgcccagcttcccctgaaaacttggtctaatgacttaagcaatttcttccttatagctaagtttaatccttcatattctagcttcagtcttttgccaattattccttctttctccagtggaggtgccaccattttgtggttaagtagagatgtcaaagtgatggctgataaatggaaagatgggcaaatccatgaattgtgctttcattccaaaggctaattgtttaggaaaagctcatggcttggattaaggctattcacaattccaatggctagttgcctatataaaacaaggctcatgccattcaaataaactttcatgcactaaaggctgtgatcaccgcagaagccttagttgctaccccaacttgaggcagctactagggtaagggctttaaaggtagaaaatgcaatcaatgaagtctacacacgtcaactcaacccttgtctgatgactttcttatcagctctgtttcaaaggcaaatggtaggtggcataatatgtggcagcaaagtaaaacaaaataaaagataagagaacggcactttctctttgatttctcccagttgaaaatcatttccaagaaagcaaatgaaagatacggtttctcaagaaagaaggaagtccgaagagatttcctatgtattctgttttttctgtctaagatgtcataggataatgcattcaaaaatgacaggcacatcagctctctgggcttcaggtcccacctctaaaaatgagaaagcacaatgctctttaacagcagcttcctccaacatgagtgcttctctacagtctgtacctgggccttgatgtatgtttaacccacctcccaggctgagaaggaacattagtagccctgttgtgactaagggaaaacgggagaaatgttctgtttgctgtcaagttcagtaatggtgagaagtccgggagatatcttcccggagtcagatcgttttatgagaaagtgatgtgggtgcaagtctacaaaagaatctgaagctgatttgtggccagcattagaggccctggcgtttctctaagattctagatgctgtgaccttaacctgctgtggttgtaggtgttgaagtgaccaaaggaaggtggagtttggtacaaggacaagaacgtattcagagagcgcagccccagggaggcatggcttggggtttgaggataggctgaaccaagggcaccagggacagctggctccactgggaccccatttccgctccttcctagctatatggccttgggcaagccatttaacttctctaagcctattttcttatttgtgaaatgaaggcccataccaattaacttacagggttgtaagcatcagatgaaagaatatatgaaaacatcttgcaatttgtaaataatactgaacaaaaatattctcagagtggatcttgagaaaaaaataatgcaacaagataacccaaggaaaataaaagagcaaaattaaaattatttaaaaattaataaaattaaaaagtaatgaatcaaaaatgttttaaatgtagaagtgataaattcaagacctgctttttttgggaaaaaataaaataaatcattagttaacatcatcaagaaaaaaggaagaaaggacaaacatacaaattaagaaacagtgatcgggaaacaaccacagactgtgaagaccttaaaggaagcctgcaaggcctatttgctccattctgtaaagatcaatttgtaaacctgaatgaaattaattatcttatagaaaaatataaattaccaaaaccaacctctggaaagatagaaaaggtaaagagaacaattatcacagaaaaaaatagtcatcacagagcagaacacactgaaagaacttggcccactaggttttacagaaaaattctacctaatccttaagaacagacaacagcaacactatttaaactgttcaagactatagaaaaagaaaagcttacatattcttttttttgtttttttttttgagatggagtctcactctgtcacccaggctggagtgcagtggcctgatctcagctcactgcaagctccgcctcccaggttcacacaattctcctgtgtcagcctcccaagtagctgggactacaggtgcccgccaccatgcccggctaattttttgtatttttcgttgagttggggtttcaccgtgttagccaggatggtcttgatctcctgacctcgtgattcgcctgccttggcctcccaaagtgctgggattacaggtgtgagccactgcgcccggccttacatattctttttataaaactagcatcacattgacatcaaactccccaaaataaaaaataaaactatggaccaatcttacttggaatattattgcaaaactcttaaataaaacattagcaaacaaaatctaccagcacagcaagagaatgacataccttagacaaacgaggcatgtattgcacaaatacagggatgtattagaaaacctattaccataactttacatattaatagatcaaaagggaaaaattatacaaccgtctccatagctactgaaaaagcattttctaaaattcaacatccattctcaatcaaaataaaactctttattgtaaaacataataaaattcttacatggatacacaatcacacacacccctcaactcaaaaggctgtaccacgcttatttgggaaacactacaagtttcctaggaacgtctattatcaatacagatttttagcattggcctgagggcactattcaacttaattagaaagacagatctataggcagcaagtggtgggaaaaagaaagaaagaattataaaaattaagaaagaagaggtaaaattatcattgttttcaggggaaagagtccagaaactcagctgataaatgattaaaatagtaaaggaatatgactagattgcagagtacagaattaataagcaaaaatccatcagctttccaaatgaaaacaacattttttaaaagtaacacaaaagataaaatacatggctctctctctctctctctctctctctctctctctctctatatatatatatatatatatatatttgaagaaatgtgcatgaagaaaacattaaaactctactaagcaaataacagacttcaagaatggaaagccatctgatgttcttaggaagtcccaacattgtaaagttgttgattcttcttaaggtaattcataaatttaatatgatcccaataaaaaccaatggattgtgggtttttgttgtggttttttgttttttttgaaacggggtcctgctctgtaccccaggctgcagtgcagtagtgcaatctcagctcacagtaacctccacctcccaggctcaagcaatcctcccacttcagcctccagagtagctgggattacaggcacacaccaccatgccaggctaaatttctttttctattttttgtggagagggggtgatacggttttgctgtgtccccacccaaatctcatcttgaattgtagctcccataattcccacatgtcacgggagggacctggtgggaggtaattgaatcatgggggcaggtctttcctgtgtggttctcatgattgagaataagtatcatgagatctgatggttttataaaggagagttctcctgcacccactttcttgccagcaggccaccatgtaagacacccctttgctctttcttcctgaacttcttctgccatgattgtaagattaaaaggaacattgtctagatcactcagctgatatatttgatagaataacaatttaaatctaggtgtgtctaattctaaagcttgttcccttaaccgtgacactctactgcctcccacacacttctttcttgctcaaaaattaccaaaacttactcttgctgatgacagaattctaccatcttttggttaaaaaaaaaaaaaaagcaaaagcaaaaaaacaaaacaaaaaacaacaaaaacaaacaaacaaaaaaacctctcataaaactttcccacagccttgagatcatgaattgtaaccactaaacctctttccttttttcctttataaattacgcagtctctggtatgtctttattagaagcatgagaacagactaatacatggggttgtgtcatgttgctcaggctggtcttgaactcccgagctcaagcgatccacctgccttggactcccagagcgctgggattacaggcatgagccactgcacctggccagaaccagtggatttttaactagataagctgattttcaaattcacatgggaaaatgaacaagcaagaatatttagaaaatttctgaaaaatataggagagaaggagactactaatagatgataaaaatattacaaagatacagaatagtggaaacaatatagtacttgcataaaagatgtagacagatctactggagatattacaaagaccagaaacagactgaagatcacactggaatatgataaatgacaaaggtggtgcttcaaatcagaggagtagattatttaataagtgatggtggcccagatgattcgacatctggagaaaataaaagtggataccaacttcacaacgtatgtattctaaataaatttcagatggatcaattatgtaaacataaaatgaaatgacagaattagaaaataaatagaagaatatctttataatctcatcatgtagacagcctttctaaatataacatgatgcccagaataaaaggatctacaaatatggtttttaaaatttgtaacaactatgaaagataaaagcgacaccattatctttatacttcacgatctcaaggctgtggaaaagtttaatgagaatttttttcttacaaaagatggtggaattctgtgatcagcaatagtagattttggtagtttttgagcaagaaaaaagtgtgtgggaggcagtagaatgtcatagttgagggaacaagctttagaattatacatacctgggtttaaattgttgttctatcaaatatatcagctgaatgatctagacaatattccttttaatctcattcaacttcggtttccttatctatgaagtaagaatattaagatctttttcataggtttttattgttgttgtttcttttttttttttaagagatagggttgacactgccacccaggctggagtgcaaacatagctcactgcagcatagaactccagggctcaagccttctgcctcagcccctaagtagatgggactataggtgtgcactaccatgcctggccaattttttttttttaacatttaaatagttttctcttagagatgggggtctcactacgttgcacaggctggtcttgaactcttagattcaagtgatcctcccacttcagcctcccaagtcataagtttgtttaaggattaaagggcatgtaactccttagccaagtgcatgatatgtagtaatctataaatattacccatgtagtaagaaagtaatgtttaagcagcttcaagtcttaaagaaactacagaacatggttaacagatgcatctatgtgtgggttgaacaactggatcccacaattctttgtcctgaagaggcacttacagtcctggaaatgtaaagtggtactactagttgatcagttcactcaaaacctctcaatagtccactggataagagcagaatcattatcaatttacagttgagaaaaatgggaagctattctttctgctgttcaggcaccaaaccacagagtcaactttgaattctctctcacacaccccatatccaatgtattatcacatactgttggccacaaatatatgtttagattccagccacttctcatcatcccttgtgtgactatgcacaaaccaacccctatctctcacctggattactgctgtgcagtggacactaactggcttccattcctccccacattcccacagtgtattctggacacagtgagagggaccacgttaaactgtaatcataccctgtctcttctctgctcaaagccctaccatgacttcccacttcacctagattaagaccccaagcatttactatggccccaagatttccataatatgggcccagttttctccaggacattctgtctaccacttctgtcatctctagtctttcccaaatggcctcctttctggtcctccaatgtttcaggcaagctcctgccatggctcttagcagaatcctgggctactgtctcacagcacctgcagggctcactctgcacctctctcaggtctttactcaagaaccacttttttgagagtacccaggggttaatgatgctgtccttcctactttggacaggcccagggctgtccccttgttttccactgaaaaacaaaaaacaaaaaacattatttaaatcaacttaatgggctgttcccgggccatcccctctaaagtttcaccctccccttcaaccacctgccaacttcatatccccatcccctgctttgttttttgccccttacccccacttaacattttccttattgattttatctattatctgactcccttctagaatgtaagctccatgggggtatggattcttaatctgttttgtttgttactgtttcccctgcacctaccacagcatgtggcacaaagtaggtgttccattaattttcttcaatgaatgagtaggtgaattaactcagtcgctctctctgaaatactcagtcattttgtttcgtatatcctggtctcctttgcaaccttttgttttttgttctgtggaaatccctggcgtgccttacagagcacacacagacactacctccatatgcaggagaactgagaacccccactgtcacgtagatgcaactgaagatcagaaaggcaaggaatgctaggcacagttccattccatgcaaggtccacacagaaacgagagctactgaggaccaggactgagtccatgatctactgctgacaagggcacacccctgggcctgtctgggacatgtcacctgctcagagccaaggagaatgaaggtatcacagtcacagaaatcggcaccaacttggggcaccaaaggaagaaaagagatcaaagagagttaatggtcccaatttgtcacagaacataacctcaaaacatgtgaaccatgattctacaaagtcaacgtctggattctatcagaggcctgctgcggagttaaggtgcagattccctttgctgtccggtggcttgtggaacgtttcttgatgacccaaagtcacagtgtcttaggcaactcacagcaaaaggcagaggacagtatcctggacacataaaatacttgcttgacacgagcaatagattccgttccaacaatcactgaatatgcccataggcaagctacatgcttatgttgactcaccatgaccacctgggttaggggccaagaaggagacagtggagtgatgtctgcagcctaggaagggcatgagctctgtggaggttatacaaggagctgggtgatgcctcacaggggcaatattcaggtaagtctagtcagagcccagtggttgaataaaagacctatttgcttggattaacagaaatgagtagtgagataaaatgaaggctgacagaattttacatgggctaatacttttcttataattcctttcgttgaattgtctgtaagaaaacaagacagccagaagggccattccatggtgatttaccataggacctcatagttaactaaaacttaactagcccgaaatcacaaaccatatgagacccgagatgattgatatctacgttacgtttaatttaaaaaagcaaatccatttcgggaattgaaagaagtcccagggaagaagagaaaaggataaaatgatggctttcaccatatagcagagtggttggaagaagaggtttaaatctgggtttcaactgatgaacaggtaacattctgtaagttccttagcctcttttaatttcagatatatcaataacactggaccaatatcagtatctacctcacagaagttgtgaatgttaaacaatacatgcaaagcatttagtatagtgcctatcacatagcactgttcagaagtattattaataacattttggtgacatgggaggcaaatattctgtctgggtcacagactattaggaagaagtgccaccttatgaatgggaagtagtctcacagatgtcatgtaaaaatgatctagccatactaatctgtcacttctggtatcttttgactgagctctgtttgccacgtgtaacaggatcagacgaagtgtgtcatgcttcattctgtatctagggaatcagaggtctgcagagcagatgccaaactgggagtcgggttatggacactgcttctgcgtgtgatctacaataggtggtcattatctcccagacagcagtggtgcaccttgtaaatgctgattgagactgcagtgtccccaccactatattaaaacaagcaaacaaaaacttttgtgacagtcaggtatttgaatgagtagaggtttatacctgcatgtgattttcagtgcagtggcagcaaagacgtgctctagtacaaacgcgtctctatccaggagctcttagagaaggaggctgctgtggaggtcttactgttactcttagaccagcaggtgggaagttggggctggggtactggccgtggtgctgaaaagcctgctctggtcccaaagggagctgtccatggtcacaacccatcgtggctgggagattttaagactgtggaactgctggggagcatgtctgttatttccacaccggcagtagttggagaagaaatactgcccatggtgctgaaaagcctgttctggccctggtgggagctgtccatggacacaacacactgtggctggaagatactaagagtgtggagctgctggggaatgtttgttgttgttgttgttgttgctgttattgctgagacagggtctcactctgtcacccaactgtgcaatcatggcttactgtaacctcaacttctcagcttcaagcgatcctcccacctaagcctgcagagtagctgggaccacaggcatgcaccaccatgcccagttaatgtttaaatttttttttgtagagacgagattttgtcctgcttcccaggctggtctcgaacttctgggctcaagcgatccacctgcctcagcctcccaaagtggtaggattacaggtgttcatcaccatgcccggccactggggaatgtcttttttttttttttttttttttttcgagacagagtctcacttggtcacccaggctggagtgcaatggcacgatctcagctcactgccacctccacctcccggagttcaagcgattctcctgcctcagcctcctgagtaactgggattacaggcacccaccaacatgcccagctgatttttgtatttttagtagagacggggtttcaccatgttggtcagtctagtgttgaactcctgacctcaggtgatccacctgtctcagcctcccaaagtgctgggattacaggcgtgagccaccccagctgggaatgtcttactgtttttttcacatccgcagtaggtgagagtaggggggaaatgctggtcatggtgcagaaaagtctgctctggtgctgatgggagctgtccagggtcacaatccactgtgactcagcccagttctcagcgttcaaagctttcctgtagttgcaactgcctctttcactttggattccagttagctcttccttgcttacttggttaactgactggcctgaggatagttatgattcagaagctatccaaagaaataggttctatttcaagattaatttggatgttaaggccggaacacgatgagtctatcttttctgggtcctcggggttgccataggtcttaacttgaggcaaaacaacagctcaaatcaatataaaagcatactctatggaatcttccaggcgaagtgtaacccaggtttaagcagggttttctgtggacttgagtgggcaatcagtggttaacctctggatccaaatcagaccagaatcatgatttctaaatttatttaaaggtagagttgcagaattccttcaatgtttttctcccattgcctctcaattttcttgccccattctgtgtaaaacagcatttttctttttacacctgaccatgtatctaaattggaattgtctcaaacactgttcttccctgtttttgcttccaaatacaggaaatgggtaaagcctactataaaaacaaaagtagaaaaataaacctggataattctattccccacttagattctgtatccacattctaacttcctgtctatatacaggtggccaacaacagatgtcatgagacagccatgtgatagtacagcaggaaacagacctggccgtgagtcctgccgccaggcctccacagtctaaataccaaggtctgcactattcaggggatggaaatctataaatagcagcctgatgatatcatcatcaccctgcctgttgctgttcagctgtcaaatgtttttaaaggaggttacaacaaattaatagatggtggtaaattctacagccccattaaccataaactaactctctctctctgtctctctgtctctctctctctctcacacacacacacacacacattcacacaccagagaccaacagattttagtggctgcttattagaatgaagactccatctatctgaaagcccatccctctgactgtgccagatctctgtgtctaactggtccctaattccctctccgtgtggaggggcagatgtgcttctttcatcagctcactggcactgcttctaaacaaggtctctattccttcagacagtgagaaactcagggctcaaccttgaatgagcagcagcctgcaaaccttgcagacagatccgcttgttaaagggaactctaatccctcttgttcttatcatgaaggaagacctagattggacatcaagagaaagaacctagagcagatccccctctcaccattgaccttgaacaattccctgacctcttccctcctgttagccaagcagtgactgtgcaccaagtcaattctgcatctagagagaaagtctccaagagacaagtgatgctgcaactgacgcaggagatgggaagaggagatggtccttgaggcacgtccacagcccctgggacaacgccaccaaatggatgtctccatgatctcacgaagttcccgaatggtgctaaccaaccaccacgccgagctgaggtggcaaactacctgagaaggtcatagaatgtcacctttcccaatgactggattcttcacatgtcttttaaaaatgggtgtctggtctgtagcaaacaacacggagaaagagaagtgggaggtgggaaagagaggcaagattatttttaaaagtgtatatgtgtgtgtatctacatttatataaatagcaaccagaatggaacacggagggcttttactattttaaggacaagctccagtagtaaagtaatcttctgagtgacgccactttttggctggtagctctcgcgcccaggcgaggctgggatgctttttattcaagtcacattgaatgcctcttaccaatccatccatcttaatcagcacctaccacttgcagcagcggccctgcagtcaggaagccaaggggacgggggtgtgagggcagtggcgagaggtgacatcatagaaggaagaaaggaaagaaagcgggtgggaagagctggtgaggagggaggaggcggggacccagctgtcccacacctctgcatgcctccttcaactggatgatgctctcagccaggtggcaggctgaacactgagcgggcccagggcctgtgtcttcagggtggacacgctgcagtgctcagccgttccaaaagcaggtggccctgcacctgcggctactgaggccgggtgcagaggagctggtactaagcaggggagaggctgggggctgtcccttgaatctcccttctgccctgctcctagctcacccgacactgggagcccctttgtcttccagcaacatgcccccagcccacttgacttctgacccactcatgccactcctgctcctcctctgtggtcctttagaatatttctgttgtggcttcagttgcccccaaagcccagttattcaaagaggggctggggttccctacctcactcagccttagctatatagccctatacctgcagcctcagcccaccccatggcaatcagggtagggcctggagtgaattctgcagctgcagacctgaactcagcaaacctctgtgcccaccaagccttgctctgccctatcatgaggcctatatcctgtttggtgtttcagttaccttcagtagctgggatccactagaaactgcagtccccttggctgggcccctgaaagtcttgccaccccctgaacatggttccccaacctctaactgatagctgaagtcctccctgcaaagaacccaccatgcaattgggtttcccactgtcatcctgccagggggctcctaagaactaaaccctggagaaattgccaccaatctgaatccaccctgagcttttcgtgcaccttcagaccctctcattttgagttgctgcactgtcttcagagtcagcctcggctaagccagctcccccagcctggctctaggcccctctcctggggatggcactcagctgcatcctctggatgtgacaccccccatgcagcgctggagggcttgggcttaggtctgtggagttccagcttctcaaaatgcagggtgagtggcagaccagcagcaagattctttgccagaggaagggcagaggtgggctctgcaaggcgcctgtcctcatgcctggtccccacatggtcacatctgctctaagaatcaaatctgggaaccagagtccatgatcagagttgggagtaacctgtgtgttatttccacactcaggtgtctccgagccttaagaaactaatgtgcattgagtgtgtactctccacttatctgcttcttactccatttaatcagcagaacagctatggaagaaaaaaaatacccattttatcgatgaggaaactaactcgggactttagcaatttgtctgagttatggaactaattaacaatacagccagaatgcaaataaaaatcaaattccaaagctcatgaggcctccccctaaattttagcccagaaaaaggacagcagtgggtgggacagcaaaaacatgtggatgggggaagagaagacggggatacacagaaaacacacttccagtgtcacaagtcccatcttagccaaggccacacaaagagagatgagctcaagccctgtgtcacattcacccgtctatggtggggcctccttgtacgaacagcattgtctgagaaggccctgcagctagcgagactcaggctaggtcaacattgcaaaaagccttaatgattcatgatcacacaggatgtatagacgagagcatttttgcctttactatctatcagtgtatgccggtaagaggcaggagataggaaaaatccatttgtgagctgttaaatttggggtgtcggctgggcatggtggctcacacctataatcccagtgctttaggagactgaagcaggtggatcacttgaacccaggagttcaggaccagcctggactgcatgatgaaaccctatatcacatatatatatatgttatatatgatatatgtatatgatatatatagtagatatatatatctactatatttactatatctactataaccctatatctaatatatatattatatataatacatataaaaccctatatcatatatatatatatacacacacacatatacacacacacacatatatatataaattagccaggcatggtggcacacgcctgtggtcccagctacttgggaagctgaggtaggagaatcacttgagcctgggaggttgaggctgcagtaaactgtgatcatgccactgcactccagtctgggtgacagagtgagaccctatctccccaccaaaaaaaaaaaaaaaaattgagggcattaattttcaaggctgaactagaaatcaggaaagctgcctacgatgaaggctgcacctggccagagggtgaagtaaatggaggaaaaggagactcttccaggccagaggctgcaaatgtgagagggcaatccttcctctttggtgaagaccatcatggtgagatgaggcctgagcacctgtagttgaatcagacgaatggcttgcaacttatactggcccatgaccttgggcaagccacctcttgttgggcctccatttccttgtttacatgatataaagggatttaaatagatcctctctataacgcctttcacaaccaaggatctggaattctacactacagattcatatagatataaatggagagagggattttaaagacagcaatgcttataaaatgaaatacttttcttcagtaatcattatctgttaccaacttctcaggtcaataatctttctcatagaaattgaccaaaatattgcactgtaacccactgtgatttttttacttctactaagaggtgctcctgggggtgtgtggaacagtgggccccctcagctgcatgtgagctggtgtcaaaagctctggcgggccctctcctccttgttcagtaatttctgccgctgctgacaatatcttgttactgctcccaggtaatttgagggaaagctttcagttgcttttatatgttctgctttttttcttaccttctttggatgcagcagaagttaagtgagaaggaccagagcacatctctatactgctaagagcaagaaagaaaattttcccaattacaggttttctctgcaattttcctctttgaagaacagaacaccatacacccccagctccaatctcttaggtttttgtctgctgtatctacaagtggcgtaaatgggaatatatgtgaggggcaggggtaagggatgggtgtgttgggtgaagactgttctggtccataaaaaaggggctggctttagggaaagaagacactaacaagaaaagtctgggctcggcatggtggttcatgcctgtaatcctagcactttgaggggccaaggtgggaggatcactggaggctaagagtttgagacctacctaagcaacatagtggcacatgcctatagtcccagcagctcaggagggtgaggcaggaggatggctttgagcccaggagtctagggctgcagtgagctatgatggctccactgcactccagcctgggcaatagagagagaccctgcgtttatttaaaaaataaaataaaataacaacaaatgtctgcttttaactctgcccctctcccacatcaacaaacacacacacatgtacgccacaacctttctcatcgtctgcaccttctttccaacaaggtcattcagtgtcctcattatttcttttctcaaactccatcatcagtacaaccttcgtagcttttatgtatgctttattataaatgaccccacctagcaaagacacacagagcaccaagttcatgccagccaccatgctcagcccaacaacacaccttatacatacctgtttttttctgtgctccaagaacttgacctgttttaactcctttaatcctcagaacaacctcttgaggtgaccactgttactatttccattgtacagattggggagatggggtacaaatgctgtccaaggctacatagccaacaaatagggcagccaggatgtaaacccagagagcaggggtggcggtctgagctcagccccctcagagcattccacagaccctgccttattctagctggtgagatagccataggaaaaaatgattaagatgcatgtacagagtttctccttacaaatgagatgagggttatggagaggaggccattccaggggagagaatgtgccagggcacagcctagagtcatgagcctctgcaggaggcgtgtggaaatgcaatgagggtgtggaaatgcaatgaggctaaagtgggaggtgctggcaactaaaactactagggggattgggtccagataatgaagaatgatgaagacaaggaaggagcaggagctaaacaaagctgtctcccatccctcccagagactccacgttcacaagcagcgctgcctggaactgtggactagaatgtcaggcacaaccggggtcagagggggaaggcaagaaagcaacttgaccttaaaatagcatgctgagagacacctgcagtctcaatcacaggatgcttcccatagctgaagaggaatttacaaagattctaaccccactctgtattttacagaagagaaggctgaagccacagaggagaggcaacaggtctgaagagacacctatgcgtgcagcaggacaacaggggattgggggtcaccagctcaccccagagagggtccagcactcacttctaagattcgccagcttcccccgccagagagcgtccagcactcacttctaagatcaccccttctcccactgagacagctagccttgcacaaggcattcccaagcaagctccccaacaatataaggagaagaaagagaaggagtggctacacacacacacacacatacacacacacacacacctcttagttgtcattttgaacctaattgttttaacaccagctgtcacatctgcagaattcttctctggtactagtgacctgcaagccctagaataacgagtctgcgtttaaaaatagcccaaattcctagaattcacctctccttctcactctcccttctccatcttactgacaggcctggtaagagctccacttcaaatttatgagtataatgtcaagaaaatttgattcagatttattaggagtggtagagcaaagcgtggacaagagcagcagctgatgaggcagagacctgggttctgtctccagcagagcaggctgcaaaccttggctgacagccttgagccccaggggattggctctctccaggtcacccagctaggacactcactgcctccacttctcccagccagctccatttccgctgggctctctgcagagaagcacccctacccctgaaacctgaccacccccttttggtggtggactcactagctccctacaaccagtcccagatcccacagattctgttccttctgcctccaagcagcatggcagcaagggagaagaaaattacgcagcccaatatacccaggatggaatcctgaaacagctgtcgaccaactgtgtagcctgagaatcaaacccctgaatctctccaagtctcagattcccatcaggaaaacctagctccagtgattgttctgagggtcaacataaaggaccaagtaccctcctctcaatgcttggaagaaaacagaaattcttacaaaaacgtttgttttcttctccctcctaggtctagctgccttattctttcaaatccatcaagcatgcattaatatcaggacagggatttcagtcctaaggacccactatgtgtgtgaagggctcaatcgtgggattatttatgcccattgagaaagtggcaacaagttgtatatccaacattaaggaaatgactgttatgattcacctcttgcatgaaaatactgcacaggcattccaattctattctgttggctaaggagatgcacataatatggtgttgaaagaaaaattcaggatacaaattgtatttagaatatgttctcattaatgtgaatgaaaatgctacaataaaatgaggcaaaatgttgacagacggtttctggatagtggacttactagtgagagttttctttttatatatacttctttatcttcagaagaaattttttcaagaaataaatcactgatcaccagattctagtttcagaaaagaagggtttggtcaatgctatggtgaagggagtatcctctcctcccatatattggttttatagaaccaaaataaaagttctaaaaaaggatgttctgcagatgtgaccaagctaccaaaataaaagttccaacaaaggatgttctgcagatgtgaccaaacaaggaggtagcataaaaagaatcaggaaatgagccttattctgtatgccgttgggttgatgcaggtgactcgggacagcatgagatgctcagctccaggccatgatgcaaatcatggggcagggtcaagaaggcatctccccacatgccaagagttaagaccaactaggagagcaccagtgtttcttataaactaacaaaggattaagagaaatatgggcaaggaaggtatttgatttcacggtctccatatgacttcccagactgtgggtttggctaatggcattccatctgtgaagacaacttcaaaactccactttgaggagggctgaagaacacctaagccaacacactcatgttaaagacaaagaaacagacccatgggatgaattctctcagaggcaccaagactattaaagaaatactgaataagaaccaagacttcctcacccctggtcctgtcttccttctactcattctaggtggtgaacctagaagctccttcaaagctagaaggcaacaggacaggagagccaaagagccccttactggtgtcctctagtgaggaaacagtttgcaaggctgaaatggtgtgcaaaggagaaacaagtagcaatgcatcataatatgttgttttcttcctcgtggagcacataattccacttcagtagacacatattaggccaggtgtggtagctcatgcctgaaatccaagctctttgggaaactgaggtggatgcatcacttgacgtcaagagctcgaaaccagcctagccagcatggtgaaacccccgtctactaaaaatgcaaaaattagccaggcacagtggcacacgcctgtagtcccagctactcgggaggctgaggtgggagaattgcttcaacccaggaggcagagattgcagtgagccaagatcgcaccactgcactccagtctgggcaagagagccagactctatctcaaaaataaataaataaaaataaaggcacatattacatgttttggggtctcatgattctacacgagagctctctctgctagttcatcttctcatggtggagaaggctgtttttaactggatgtgaagggccggaatggaagtaagatgcatagccgggaaaggaaattcccagatgagattccacgaacactttctggacacgtggtccagagagtatatccctccagccatcaaccaatgcctacaccccttccttggctcagcctttgcttttctggcagccaagtgtcccctgcccccttcctctgattcagaaggtggacaccacccccaactgaaacaaacctcaagtatgaactctggatttaggagcgaaaatgcagaacaattgctggcctcattggatgactttgcacatggggagtgagaaaccaaatcctaaaattggttgaacacgtgctatgtgttaggtgccatacacaaattttctcctcctactcaaccacaactcagtgaaggaagaactccccttccgatggagaaacagaggctcagaaagctaaaaactaacttgtttagggccagctagtgaataaatggcctcttcataatgttgtttagggccagctagtgaataaatggcctcttcataatgttgtttagggccagctagtgaagaaatggcctctttataatgcactgctctgaggcaccctcaaatagaagctgaagttgacagtgaggaagggaccacagctagactctcgaatattcaaactattacctctgcaaagataggagtttatcccaattgagcagaaacatgtctaacatgtaaagaaaaactcctctctacccctatagccagtccttggatcccaattctgggccaggcaggcctctccttaccctgcctctggactacccaagagtcagcagggccccccattcctggagatgagggttgtagccgttgctgcaccgcaaaagctcaggcagagttagaacagaggggcagagagagccccatgtgttaatgagaagctggctgaagtccacaaggacttcctgcctggctccttcagaacctaccagcctcccagtgggcagagcagcccaggccagcagctcactgccggtcaggggcaagcggcactgtgctgtgggtctggtctcactgtggcctggagagaccttggagagccctggtccctctgctgttcagcctctccagccccaccatacccgttgctccccacagcacttccttccagcagacctcagttttctaaccaggccaatgggattatagagataagtcttctcttctcctttaggaaatgccctaagaagacaaatccatgtcgttaccatgtgagttaaaaaaaaaaaaaaaacacacaaaaaacctccttccaggtccctgccaagaaagtgcaaatgcttccgcctctgtgcactttgtcaaaggcatcaccctgctgtgaatgcctcaccctccccaatcctgagagggccagcaccattcctccacaaagccactcccctctgacttccacaagcatcccatggcacactttccttgtattgtaaagactgtgttcatctttaatcagatgtgaagagctggaatggaagtaagatgcatagcctggaaaggctggaccatgacctttgcaggggaaggctcagccagcactcacccagcagttctgttggcctgggggaggcccgcgtgcagcagtacacagtgtttgcagttctcttcatctccaggagaaggcaggagaaaaagactcaagaatcaaagccaaccgatacactgagcaagcaggaatggggaaggtgtggtgcatacccagagccctgtggctgggcggggctttgccatctggtcaccctcccagccagcacaggaaggcctttggtaatatgcctgatgggggacacagacgtgacaagtcatcattctcaccacgccaaccatgggatggcccaggcccagggggtggtgcgagttcaacggccccaagcattgtcttcttccaccaccatcatagacaaggtgcgggctcagtgctaaggatggtactgcagaaaggagatagaagggaaataaacacagtctccctcctcaggtgctgatgtttattccagatgggatataaaagtcaccggtggaaataatctgggtatggttacagagcaaggcacttctgaatgaaaatcatgatgttgaatcagatgttggataggaggcccttgttggggcaccaaagcccagagaaggggggtcactggctaaggggaccactgaaaaaaaaaaacctccaatctaacaattccaagtcagggacactccctgcttcagctcacaaaatttgcaactggggaggactcagaaggaaggttcagccaaccaggttaattcaggaagcatcaacccaccacctgccaaagcaggtgagccttgaaataatagagtacgtactctatgtcagacaccaaggaggcacagatgaagctgcacaccacctggcattgtagtgatcaggttctaacagaagaacaagtacaacatcattgtcaacaccatcatcatcaccaccacctcatcatcaccaccatcaccaccaccaccatcattatcatcacagccattctcaccatcatcactaccatcatcgtcattacatcactaacaatgtcatcattatcaccattatcataattatcatcaacatcatcaccatcaccacaatcatagtcactatcatcaccatcaaccaccaccatcaccatcttcaccagtgtcagtcatcactgtcatagctaccagactgatactaatactattatacctaatctgtgtaagtactggggaatacattgtctttaatcctcaaataatccttttaaagtaggaattattatcttcattttacaaatgcaaagtgaggctcagagaagccatgcagcctgctcaaagtcaaactgtaagaactgggattctggagcaggtcttttggactacagactctgccctctttctgtcattccaagctgtctccatcaacaaataattatgctaacacataataaatgctctaacaggcatatgtatggaggacagagaagggtgtggttaattctgcctgtgatgagagcaaaaggttcccaagggagaaaagagtccaggtgaaccgtccagagggctttcaagttctcctggtgggaagagggatggccatatacttcaaggagaggagacagcaggtgcaaaagcagagagtggcgaaggaagggcgggtggctgtggagtagtgggtcctggggcatcacaagagtgagtgagcagagcagcgacagcaggactagaacatgaggaccttgtccactgagccctgagctgcagagatggagcgaagtctgggagttatgaggagccctgggagtcttgggctggggcagtgaaatgctcaagtctatgttaaaaagctcctgtggggccgggcgtggtggctcacgcctgtaatcccagcactttgggaggctgaggcaggtggatcatgaggtcaggagttcgagaccagcctgacaaacatggtgaaacctcatctctactaaaaatacaaaaattaaccgggcatgttggcgcacacctgcaataccagctacttaagaggctgaggcagaagaatcacttgaacccaggaggcggaggttgcagtgagccgagatcatgacgccactgcacttcagcctaggcgacacagtgagagtccatctcaaaaataaataaataaataaataaaaaataaagctccggtgggacaaagatatattgaccaggtggtttattatcctgatgtttacaaaaagtagcaactgcctaccaggccagcaacagggagctggttaaacaaaacttgttgctcatccacagtggaaccctctgcagttattaaaaattatatctatgagccagcaattcctcttctgaagctatatcccaaataattaaaagcagggactcaaacagataattgtatatccatgttcacaacaacattattcacaatagccaaaaggtggagacaacccaagtgtccatcaaacaatgaatggataaacgtgtagtttacacacatgatgaaacattattcagccttaaaaaggaaagaaattctggcccatgctacaacatggatgaaccttgcagaccttatgctaaatgaaatcagccaatcacataaagacagaaattgtatgattctacttaaatgacgtaccaagagtagtcaaattcataggaacagaaagtagaacagaatgtggtacagtccctctgcaaccttatccatgggagatacgtttcagtggatgcctgaaaccacagatggtacagaactctatatatactaagtttttttctcatacagtcacattgtatagggcaggtagtgtgtccagcatacatacgtggaacaaagggatgattcacatcccaagcagaatgacgcaagatttcatcatgctgctcaacatggcacacaactcaaaactcatatattgtttattttcagaatttcccatttaatatttttggactatggttgaccttgggtaactaaaaccacataaggtgaaatcttggataagaagtgactgtagtagatatagatatatatatatatacatatctccaatggaagggctggagggaagtgggatggggagcagttatttaatgggcatggagtttccatttgggaagatgaaaatgttctggaaatggacggtggtaatggttgtacaacaccatggatgtactcaatgccactgaactgtacacttaaaaattgttaaaatgggaagttttctgttatttataatttcccacaatgaaatatgatgatacgagtgtgtattaacatgcaaatatggtacgatgtgttcgttaaggaaaaatacatcacattgtaatcccattttatatatgaatttgctagcaaaaatattataagataggaatcaaatttaaacagtggctatctctgaatgctgagattatattttattttcctctttttcatatctacagttttcaaggtttgtatgatagacatatataataaaaatattttttctttctttctttttttttttttttttttgagatggagtctccctcttttgcccaggctagagcatagtggcacattctcagctcactgcacagtctgccttctgggtgcaaactattctcgtgcctcagcctcccgagtagctgggattacagatgcccgctaccacgcctggataatttttgtactttcagtagagacggggtttcaccatggtggccaggctggtctcgaactcctgacctcaagtgatccgcccgcctcggcctcccaaagtgctgcgattacaggcgtgaaccactgtgactgactaaaaatttttcaattaaagaggagagaaagaaaaataagagattaattggtgattgattcactagagagtagggtgagaaatgagctggggagagaacaaatggaagcagaagagccagttagtggcctagtaggacactgattccttcattcagcgcctactgtggacaatgtggcactgagaggaggccttctgcctgggtattattagggtggagggaacagtgtgctgcccctatggtcacaattgtcactatccatcccttatcgtatgttgcatgtctgagacatgccagtcattggagacatcaatgaccaacatactttttctgtcctgtgaggatgtatattctattgatgagagacagaaaagtaaaccaccaagtggaatagagtaaggcatctgtagatgaacagggttgtgggtacacacagagtgaagacaatgtccctgcattgctggtgtctgcagacatgcaggctgggcccagggcagtgaggcttggtgttccaagcagagggaatagcatgtgcaaaggctcagaggacccagagagctaagtgggccattacaaacagaatttgtaggatttctgtccttggagaccttacagaccaagccagatggctctctctagctggatatggagttccctgtggctgccgctgcaggttaccctaccagctaccagctgcctcctctctctttgtttatagaagcccatctctattctagctgcaacacagagtgtagattctttccctagcctcagggcgtgaatatgattggtccaagtcaagcagttcatcctgtttccctttactaatgattagcgtagggacagacataagaccaaattctgggtaatggaccccaagaggaaccctaccagttggcttctgatcaggatttaattcctgaataagaggaaagagctgctacaaaaaaaagtcttgttgtatctgtcttcttgcctccagcctgggatgctgttctgatgcttggagctgtggcagccaatgtatgaccatgagggataggtcaggagagtcatagagataggaattcaacatccaaacactttggaatggctagaccattcttggcattgtccatctccagtgtcttgtcatgtatgatagttaaatgcctttgtttttgagcctctcttcagcattcagttccttgcagccaagtgcatcttaagcaatatccctgcctcaagactaggggctaatgtgcaagcttctgtcgctcagcagcaaagcctgggtctcaaggatcatctgatgcctaaaagccaaaatcatgcctacagcaacagacctccactgcggcctctcgcatggacgaagaaacacagccagtaatgtcgtttccattcatctctcctcatcatcgccatcaatactgatgagtcacgtgcagcacagattatgcctgacccacagaggaaggcagactggaggagtcagctcttccctctcaaaacaaagcacactcggtggaagaggcaggaaacaaacaaacaaacaaaaaagcaaaaggaaatctacccagatcttacctactcctggttgctgtaagggttgggggtggaggaacagaggcagcagggcaaggtgcctgcagtctatctctggtgtcccctggcttcctgcagctccccttctcctctctgggcttgtatcttttcctagcggtaggagaggtaaaattcgggagtgcacaacaagcaggcagggagcttgagcccttggaagcagatggcaggggcagagtggggggagggcagggcagagcagagcagagcaaagcagcatggggcgagacctggatgtgtgggtgctccctgggagagaagacagggaagcaggcgtttgcttttttttgactgtagcattcaggcgttcacacaggggcaaggcagtgaaggacctcacctgtgcacctgggggaaggctgccacgtttactctttccttttactctcacgatgccctgtcctgctcaaataccctcggtggcttctgctgtctacagaatgaagcccaatctctctagcttgtcttccccaatccatcccaccccaccagcctcactggccacttggctccaacatgatgcaaaaaggcccaagggtggcctgagcacccggacactgaggcaggtaggcagtgcatgaaaagtccacagactacagccaggccttctttccttctttgttcccctcttcctcaggctggacgcatcccctaaagggggctccccaggcttttttttttttttttttttttgacagggtctcgctttgtcacccagcctggaacgcagaggcacaatctttgctcactgcaacctgcaactcctgggcttaagccatcctcccatttcaggctcctaagtagctgggaccacaggtgcatgccaccatgcctggctaattttttctttttttagtacatacgaccccattacccaggttgggctcaaactcttgggttcaaatgatccacctgcctcgccctcccaaagtgctgggattacaggtgtgaaccaccaccccggcctccccagactttccaaagggttcaccggtggacacatgtctgggctgagtgcttccaggagccctgatggagccacggtcaagcgctcatatcactgaatgccattggttgcaggcccccccgcccaaggagcatgaggccctgcaaccactgtagcttgctagggctcttacagcctgggtcccatcaccctctaccaaggctgagggaaatctcttgacatgcacaaaggtcttccaactcagaaagagcaaggacctgaaggatcctttccttttagattgttgtctaaagtggcatataggggtgttgttaccacagacaaaaagccaggccccaaattacacctctcctgggtagtcagcagctgtgtggggaggggggtgggaggtcctgttctggagcttcttgatctttagctaatcattccatagtcaatcaatcaatcaatcaagttccgtgtgtgtaagtggtgcatgtctctttcgccctctcattgaaaaggtatagggtttggccgggcatggtgactcacacctgtaatcccagcaatttgggaggccaaggtgagcagattgcttgagcccaggagttcaagaccggcctgggtaacatggagagaccctgtctttacaaaaaatacaaaaattagtcagacatggtggtgtgtgcctgtagtcccagctacttgggaggctgaggtggcaggatcacctgagcctggggaagttgaggctgcagagaagagatcataccattgtactccagccttggtgagagagtgagatcctgtctcaaaaaaaggcaaaacacaaccaaaaaatagttataggtttgatggagatagcatgagcttagaactaagacaaatttgggttcaaaactggtcccagatcttctgtaaaatgtctaaccagcactcaaaactgtcaagcttatcaaaaacaagaaaagtctgagaaactaccagaatctagaggagtctgtggagacatgatggcatcctggaaggtgttctggcacagaagaaaggacatcagggaaaactaaggaaatctgaataaagcatggactttaattaacactaatgtatcaatattacttcattaatcattgacaaatgttccccactaatgtgaagtattaagagtggaaatggtatggagtgtaggggaactctctgtaacacctttgtaacaattctataaatctaaaactgttctaaattaaagtgtttatcaaaaataaaataattgtattagtctgttctcacattgctataaagaactacctgagaatgggtaatttataaagaagagaggtttaattggctcttggttctgcagactgtacaggaagcaaggctgaggagccctcaggaagcttacaatcatggtggaaggtgaaaggtgaaaggaagtagtcatctcttatatggccacaacaggaggaagagagagaagcaggaggtgctacacactttcaaacaaccagatttcatgagaactcacttgctatcacaagactggcaagggggaagtccacccccatgatccaataacctcccaccgggcccctcttccaacattgggaattacaatttgacatgagaattgggcaggaacacaaatccaaaccataccaataataatagtaatagtaaaaactggtcccaggcacttattagtggtatgactttgggcaaatgacttcccttctctaagcctcattttcttgtttataaaatgagacaacagtacctgcctcatgggttggtgtgactactgagtaatgcaacacaggcacaatgccctagcacaatgcctagcacacaactgacactcatcagacatttgtttttaaaatcccaaccaagaaatctatctttgatttattataataacaaataacaaccagtcaatattcaacatttcgtaattttccacaaaatgatttttatagctttaaaacaacttttcccccagttccaagattcgtgctttccatttcattgacagtcttctttactacctttttttctaaaacagtggcccctccccaccttttttttttttcctgtcatgacattgacacaaagttaaaccaggaagtcacaagaggcaaagaacggagctccccaccacagtcgtggtatgagtggggctgaagactggcttgagtgatgtgtctccttttcactcatgtgaccgctggttatgtcaactgtgcccagggccaggaccgccttctctatgccaggtattttgctgagcacactgtatacattgtctccgcatctctcagcaacccaatcagtcaagattattattatccctgtttaacagatgagaaagctgaggcttgggccagctcagtaacttgcctgaagtcctacagcagtcatcagcagagctgggatttgaacttggctccaaactcatgctcctttccctacatcactgtccctgcttcaaggagtccccacctacaggaatggactagcacagaaacaagcatttcaacaatacagtgacatcagtgccatcacacagcacgcaggagaggcacaggaaccaccagaaaggaagcccttcttggggtggccagcaaggcttcccgggggaggtggcatcctgctctgcagtgacagagtggataggctgtcaccagaagggtacaggtacacagcggacgaggctggaaagcaggtgagcaccaggctgaggagggtcctgaacattttccttcattttttatttgttcattcattcattcaacaaatatttacagagtttcttctaagtgccacgtctattccagacactaagaaaacagcagagaagaaacaggacaaaaacctctggctatgtggaacttaatctaacacgaaagagacagcaaacaaataggtaagtaatagagatggcaataagtgttgcagagaaggatagagcagggaaagggacagggaatgcctggggacagaggctgcgatgcgggaaggcctcaaaagatgtttgagtaaagagctgaaggaggaagggaactggttgtgggagtgacaggagaagaatatttcaggcagaagccattgagctaagagctgggacttgcttctgggtccactgcagggcagcacatggcactggggagggggatagcatgagggagggaggccagtgcagtgtggcagctcaggtgtgcacctgctggaagccacaagcttggagatggtgcaggaggtggcagggaacaaatgagccaaaatgcttccacaggtggggtgtccacatgtctgtgacaggagccctgagctattctcagccccactaaggactctgaagaggagaatttgggacacaacaggcagggcctcgcagtccccatctaagcagatggaggagtccgcctacctcaactgtgcccagggccagcactgcagaagctaccactcatctgtcattcaggtcacaggaccccaccccactccccagccctgacagccagcatggggacagaaggggcagtaatgaacccccaagcccctttgggacctcagctgctagggaactgctatgcagataaatttaacctggcaagttacctaacctttctggctctccatttcttatttgtaaaatggggataatgacagcacctatatcttaagaaaaactgaatgagttaatacatgtaaagtgttcataacaccatttgcatgtggcaggagttcaataactgttagtatctatcattgtgagtgtagttgttacggctgctattatcatcaccatcaccatcaccatcgacagcagtccctggctacatccctagtctacccagacatttccagtaccatgggggaggaaaagagctgggaaatgtaaactatagaaaaagtgcccccctcacctccccctagcttgcaggccccctccactgtcctctccttttcctccaatctgcatcccctccttttttctgggctaatcttgttttaatcttttctttggattcatcctggccccgatgtaacacatccagaagtacactaacagctcattaactgccacaaactaatacattttatcccatgtcaggccatgtctaatcaatggccataataaatgcaactccattctaacaagcttctgcactttcaggacacttttcgtccaatgccttgctgacatcccagataccccaaggaaaaaggtggtgtcttgccaagttgtagtatcttggcatgtaagagtcatgagagctctaacaagatatttgcctgtagacatgccttatccttcggcttgaagatgaaacgaggcccagggaggggaagtgaatttcccaaggtcacacagcaggttgggtgccaagctcagatgagaacaggagtttccaagctaacatgtattaagcccttaacaccatgaggcatttaatcctcatagtgaccctaagagcagataccatctatatcttcattgtacagacaagggcaccatggcttggacaggttgaaggacttgcccatggtctctaagatgaggctgaggaggctgaccttcaccaccatgtggttttctaaaggtttctcctttaaggagaggagaggagagacaggaggaaggtttactttagcccatcacaaagtgagatctaagaacatgaaccctgagggccacagaggtgaagcttcaggatgccggctctcatgtttatttgagatatgtgttaggtttccccagctgcctctagggactctgtctgggtcagcctggcagaggtgggttccagatggcaaaggacttaactgtctttgtaccagcaatttgttgccacaaattcattgagacacataatataatacgccccctttttaaaaattgcagtgcctagatctggccccggatctgtgttgctggtgggaatgtccccatccattaattgagtgctcctagaattagcggggatgggagggcctcccctagctggtttggaaaccagcaccttcatgtttataccaattccccacccatgtttggcagaatgaattaaacaaaagtcaaaacctacttcagcagggttccttacacagaaggaatttgctgtgtgaagtcctgggacctcttgagtcatcctgaccacggccctgccttccagcccacctgtaccggagcccctcatgggagggtccctgtgaagccaccaacatccaggcccgcaggacagacccaaatccattcccagtcactgcgttaaaaagtcagctttgtccaaacgtgcctttactcgcacggcagacaggcctaacgggccagaagggatttgttaggctctctagatccatcataatctgtgtttaaaggtccccaaatgcccatttagacaatccacattttttaacagccagtaaatactctggtaccgggtcagcatttttaaaggtccttaaatagctcatttgcataatccatattttcagagcccctaagcattcatcctccctatgtaatctcaatctttattaagtgtgaggaagaaaagactccaaaggagtgtagcggcccttagcgccccttctggaaaaactgttttaaaaatgaccagattttcaaaagcaggcacaggaccaaccacaaaaggaaagtttctaaaggaaaactattaacctgtgctggcctgtgaatgatccttccgtaaaggcaggaaaaccccctgcgggctccccaaggacactaattacacaacaggccctgcaaacacttccagtaaggttggagcctcccctttcctatgggttccctcctggaggccaggaggtgcaggcaggttcccccaacagcttttcagcagcaccttcccaggtttagtctcagctcaaagtcttccctgggggaaaggaaaggcaatttgctaacaaaatgtaggtcccatgattgaggatcactcaacacagatatggggcaaagcctttgcctcatgggtagcagcgtggatcctctgttagtcataagacccagaagaccgtgagaaaaagcccttttgggacctccgggtccccaaacctcagcatcccgcaacatacccatgtaacaaacctgcacgcgtaccccctgaatccaaaattaataatgaaaaacatgaatccaagacaagatggacccacactgctgcccctccactgtctcagagagaaaagctatgtcttcatcagaaggttatccaaattccaaatcatcttcagccacaggcaaaacgcagatggaacttgccaacaagatgctgagccgaagaagcagacgtgagaggacagggactgatgattctgttccctcagattcccagaacagacaaaactcatctacgatcagggaagccgggacctgggttgggaggaggcgcttgggggcgcctctgatcgcgtgatatgggtgccctgcatctggccgtgttcactcgggaaatgctgtgagctgcactttttttttttttttaagtaacccaaattcttttagttccaatttcaacttccttagcattgctctgaaatcctctcatgctgcacttttatttttactcttctgagcacatccgggatgcccaactctctggaaagagggattaattttttttttcggtccagatttttgagattatttaggaaaggtttaggggaaggagaatatttatagcaacaaggacgtgtctaaacgcactggaggcttctttgcccggaactcccacatctgctagaaaccaccccccacccccacctcggggagggactctgaagagagttaggggaagagggaggagagggggacgctggcagagaaagccggccaggtctgaccgaggggatgagtgtctgaagccagggggctctgggcttctccggcctcaggcaagaagcggggctggctgcgttcgggacccagcgccccccaggccctccaaagactggttgagctcagaaccagaaggagcgagggagcagagaaagccgggggcgggctcggggtaagacaggaagggagtgagattaaggtgagaagtgggaggggaaggagggaaaccgagaggaattgagggtgggctcggcgtatctagagcagtccgcggaggacgctgaggctcgccggggaagtgctgtgcccgaggcgccccaaaggtgggcggcggtgccagctcagacccacgcctctgtccaagtcccgactcctgcggactcggctgcaggcgggctccatgagggcgggcagcagggctcagacgatccggctcggtttggtcagcagacccccggtaacgccccgcaccgtcggcgatccctgcccccttccactgcgcccccacaagccccgagctcgccagtccttccccgcggcgctccgctctgtggccccctcgcatcccaccgtgggggtgcagctcccctggcacagcccgacggtgggagagggcggccagctggactaaaagccccgtccccgggcgggaccttcctccccgcaccctgacgcggaggttggccgggggcctctgcgtccctctgccccgcgccctggatggggagggtctgggctccgcgccgcgaggcagcgcgacggctgcgggcgacttggcgtgcggtgctgaggaccctgggggagtgtgcgccgcggggacgccggggactcggggtcctagtgccaccggacgcagcgggagtagcgcaggtctgggggcggggtctctcgaggcgcagacaacaagctagatcctgagccctctgcttcaaagcgggtagcgccttcgcccacgccttccctcccaccatccctgcctggctgccacccggaagtccccgtccgcgccccgacagcgccgccctccggctggctgcagcgcgggccctcggtagggggcgttccaaggccccgcctcctcgtcactgccacggatgacgacgccccaggcccccggccccgcctccgcctctgcctccgcggccagcactggggagcgtcctggcctgcgcttgctccccaacccctccttgccccgctctgagccggcgcgtccttgctcccccaccactcttctctctcgggccagccgagcccaaaaggcctctcctcttctgtttttccagttccctcctcaatttcacctcctcggagaccctccaccacccagatcttcagcgagcaagtcacctttcctttagatagacagacaggttagagatagattagagagattagatagagattagacggatagattagatagactgataagatgaaagatgtagatggtagagatttgcatacatatggatagatacatatggatagatcatagacagatggatgattgatacgatgtggatgatagatggttggataaagatgatagttatagatgataaaaaggcatagatgatagatacatatagatgacagagatagatagagatgatatataacattgtaacacgtatagataggccacagataggtaggcagtgggtagataggaggtagatggatggatatgcgtatagatataggtatatgtcctgaagggacaacccggaccccaggctggccaggacagtacccaggctttggcaacctcctcaatagacacgaagctgcaggttttcagctgcttacgccgggcaaactgtaaagtgctttaaatccctggaactaaccacaacggcagcttagcctggaaactcaagtgctggctgcaggcagtttgagcgcagctccagggctgcaaggttgcctgcaagtaacacgacatttgttcattctttcaagcatctgctgagcctgttgcagctgcctgtggctgggttccggcactcagagaccctgggcctgctcgagaggggctgacattatggtgggcatcagagacacccacacagagcctcacttgatccatgtggcagtgccctgggagagggcagggaggggtgctgggaaacacgagaggggcaggcatttgacctgggtcctgaggacgggctgaggttcccagaagaagaaaaaccacatcagtcagaggcaccagtaggtgcccataggaatagagggcctggttcctcctgggccaggaagcagttttgtggggctggatccccggatcctgagatgacagtgggtgctggggtgtagcttgtgctcagagaggaggaaagctggctgaggccaggttgagagggattctgagagcccatctatttctcctgttcccatctcctctgttatacctgtccccaggcacctgaaatgacaaaggtgcacaaccccggtcctctgggcgtggacttcaaacctatacacatgtgacaatccccgagttagacagccctccttcaggagcagctctggatgtcaaagggttacgctgctgtcagcagcccctccctctgtctgacctgaatcccccccacccacccagggacagcctccccctcagggtgactcagcccctgactcccaactccctccctgccatcagctaagactgtaactggttaccatagcgacctcaagaagcccggttcatacccctccttcctgatgagacctggaggtctaaattgctcctgagatgaatgctgtgcacagctcctcacctgcagagatatttgacaggcagcatcccagcgccttcctcccctgcacaaactcaggaagggagcgatggcaagagagggaggccagatgacagatacctccaccaccgggcctccaggctagcacttccctccataatatgggggtccccagggagaggaggacaaaggacatgaaggcaagagctgaaaactaccaaagaagtttttggtgtccccaggagaaactacaggtaataccaagattttccattcttctaggccatctttgagaatgcacttgggagggatggatccttatttgtgaaatgttgtctttctcagcaaagttttacacacacacatgaacacacagaacaccaaaagattcttcctgaaacatggtccattaagctcctgccccaaaccatcaatagctccccattgccaaaaaagaagacccaaactcctttccctggcctcagcctcctttctacctagcgacctgccttgctgcccctaagaactcctgtcccactctgcatgccataccctcagcagaccacttcctgcttcccaaaggtgctctgtctctcctgccaccatgctcatctggagatgaccctctgcctgggccaccctagctccgtgttcacttcctcaagctcagccttcatcctcaggccccctcacccactcccccagttaaaatttcactccttcttcctggtggcacttttggagtcctgttagagaatagagtctgccatgcatcactgagatctaagtgtggctgtcatctccatggcctggggcccgtaaaagaccaacatgtttcactcactttcctatcccttcacccctcagagggtctagcatggggccaaaagccaatgtgaattgcttggcactgacccaccctccctctcctctctgacttgctttctaagatcttcaccaaagatgagtgaggagactgtgaatgggcagacacttcacattcacccagggaagcctccatcccctggtaaagacacaagaacaggggagctgaacccttcgcctctggacttcgggaccacccattgtaactattcttcctccatcccacctcttcagagctgtgactggctggagggaggtgggctgctgggctgcctcctctggggatggagacagggcagcctggccacaggcacaggaggcaggactcaggaacaggctgctagaacgcgcaggtgacattccagctgtacccaggcccaggtctgggccccagtttccacctagaggtggtgtgagcagtgtggcagctggctctgaccgccaagacatggtgagctgaggctgcagggccgtaaccctggcaggccccagccacacctgcagacacagccctcagaggcagaggctaacacggttaattggttccaaccttcagctaaaagtaggagcattgatcaggcacccgtgaggctcagaagctgtggcctctgaggatgctgtacttccgtgtaagctcaaacccagaaaagagaaatccgatcagaggttgtggtgctcacttcccagccgggccagagtggggcagagaggcggcaggctataaatagtggaggaaccgccactgataatccactggagagaagggatagggcactcttcccccaggaaggaatggcaggcctctccaaggaacagcgggacctgtcagagcagaggacaggagatggtggcctcatccccacccacccaaggcccagtcccctttccctgtctgtgaagtgcttgcttctgccctgactccgtggagcatggggacttacagggcaggcataggatgaggggacttcaaataatggtcttgggagttgagttcaggctctcagtggagccagggcttggccagagttcatatgatttcagtgtaggaagccgacaccgtctgtgcatcccgacacggaagcacaagtccactctcctgtcactcagccatccctccagaaatgcatccatccatccatccatccaaatatctagtcattcagtaattcatttgacaaataagaattgagtcccaatgatgtggcaagccctgtgctaagttccttgtgacctcacctgtaaacggtgctgcttctccccgtccttcttagggtgcttgtaagaacccatcgaggaaagaaatgtgcttgcagcctgggaagtatcacacatgtatcggtgagttggggctttgacagagagaagcctttgggtgcttccaagaagggaacaccccagcccctaagagcttcctttccctcctttggtcctcaaaatctcagccaaggaggccttgattggcattcatgggctatggcttttcaggtcaactttgaactcttacgcctttttcctaatatgagggtctagaatgtaaattttgagatccttactgaagtatgcttccccctaaacttgctgtgtgcacttgggcaggccaggtgacctctctgtgcaacagtttcatccactgtaaaatggcagtgacatgagtaactatctcttagggctgttgtgatgatcagagagtcagtatatgtgaattgcttagcatagtggctggcacagagtaggtactatctaagggtgagctacttgtggagatgatgcaatctggccctgggaaatgggggttcaggctcaccttttacaaagggaccctagggggtcctatgaggcaaatgcttctggctttaagatacgtcaagccttagtctcctcagattttaaaccatctccataaaacagctgtcctaggaaggaatcttgggcttctctcagagtctcagaccagaaactctgtgtcctaagacactgcagcctcttacaggaaggcactgcaggtctcacagggagaggaagagttatacagaaccctgtcttccctcttcctacactcatgtgggtaaaaagcttagatttttcttgcacttggagtagaacaaggggtacagctaaagtgatggactgctgagagtttctagctgctgctggattccataagttccatcggattaaggatgagcttaatgtataatgtataaacccatggacagagacactgccttgtttaagcaatggtttacattcataacacaaatataaatggatagtcatttctttcttcagggcccagcacaattcattagtagcttctagccttttgtccctttcaagcagaaaacagacccagctcagagagcagtggctgggtctgctcaggacccaggagcccaaagcacacaggatcccaaacgctccagagtccatagagactttgttgtcaagcacatcagagatcatgactgctatatattcttggtgcttcttttcatccattcagagtctcaaatgttctctcttcactttcctgcttcattcaactatgctaagactgacagcctcctgagatactaacgtgataagacacaatccctgccctcaaggaactttagggtaagcctgtctccctgaccttggcttcctgaacttagccttgttccatataaacctttttcctccttcctactttcctcccaccatcattgctggctggtaccagctgcttactttgtgtttctagttgcatttccttagcctctgtctccagctgagcactggactgcacactgcagaaaacaaaggggaagaaacaaaggcactggcctgaaggagttcatggcccactggggagctttttcagaaatataaccaaagaagcccctgccctggagagctttcagtccacagacagtgcatcctagatagaaaggggccctctcttaaagaggtccaacccttctcattcatgtaactatggcacaaaacagtaggtgccagtagcacaaacagttcagagaaagatgctgcagagtgctgttgccttagcatccctgggaaaggtgcatgggctgtaaccaagccccattgttccacctgggtgatcatggccattgctaggggagagcagatttacatgtggacacaggtacttatgctctacctgcagcgacccaaaactctcttgctgttcaaacatgtccaagcagtccccctgggtccaaggcagagggcccactccaagtgggagaccacaaaatgaccttatacaaacaccagaaattaggtcttagacacatgaatgggacaaagactaagtgtcaaaatcccaaactcagtcagcagccaatgggtgaagcgggcggcaggagcagaggagaatgcatgcgcttcctccagtgtcatctttttccatccctacgacccacagaagggtgacattattccccttttacagatgcaaacactgaggcccagagaggttatcttgcgcaaggccctgcaattagtaagtggtagaaccaagacccaagctttttatttttaaagctgggtcttttcaactataccattcagactacaaaagcagagaaatattttccacttttttatttgttataaatatttcattgatcaacatttagttcctcaggcacctgtgtaaggtcctccacgtcccagggcaggaggcccggggctctaactcaaggccgtgacccacagacacacaggaaaggcagtcccctccctcccttcctggccacagcagggctggtgctgcggtgtcagcgctccaaggtatctgtcgaggcaatttcagctccagtttgctcaaactccagaccaaaggctcagtcgcagactctgatgtgccgaacaaaaccagagacaggaactcgtctcaatcactgagtcagctggcggtgagaaaatgggcaggtggaaagctggggagggccctccctccatgtccccatttcctagactgagctggccctgcattttctgcacccagggctgctcccagagcaggcactagaaccctctgcagatcccagaccctgttctgccctggaagcagtgaggcacctcacaggcccccgaagtcatctgaggctggtggctggagtgcagtggcatgatcacagcaagaaatcctctaacctcagccttctgagtagctggaactctaggcagtgccaccacacccgactaattttattttttgtagagatggggtctggctgcattgcccaggctggtctcaaactcctgggctcaagggatcctccttcctcaacttcccaaagtgctggcattacaggtgtgagccactgtgccacctgggactgctttctaaagagattttctatcttagaatctgtgggggccacttgaggaggagctggtgagaggtggcataaaggtctggcctgttcccctttatttagggttgaggaaccccacagcgagggactgctaactctgccttcagcatgtctgggagcagagtctttcccctggctccatgaaggcctcctgcggatcatttctcacctgctgcggagccacctgcggtgctgactgtcccctcctgaaccctgtgcctctctatgcctgtcttcattaccagggtacgatgtccttctccagctaggtggattggttcccaaagactccggaatgaggaacatttgcagacagcaaacttaaaaccctacgagaagaatagggtgggggaattgtggctgcagatgagcttaggaaggtccttggatgtatttcttcacatgcgtcacaacaccacgcagccctataccaaagacatggcacatcccgaagtcttcctcaaaggtaaatgacaatcaatttccaatttccattatttgctccagagaggtggttcaggaattccctcgccctcaagtttaaatgagatattaatgaattatttttgccttgttgcagacaacatacctgttaggaggtgtgtgtgtgtgtgtgtgtgtgtgtgtgtgtgtgtgtgtgtgtgtgtgattctccatccaagtgtttacttcctttctcatttcatgactttgggttattgactcctgtccctccccaacctctgccctccccagttgggtgacctgggaccaactccccaacctccacatctgtctccttattagtgaaatggagctatgacagaacccatgatgtagggatgctctaagatttaaataaagtaatccaggtaaaatgcctagtcaattgtctggcacctaataagcattcagtcagtggtagccattactttcttattaataaactcaaatatcacaacctaccaagtgtctgactatcctcagggcttggcctctcccagacttcatctgtcccatgctggcactgtcagaactatgcccatgaggccgaatcaccctgactattttgaggcaaccttgctcccacatttccaccatctgttgaaggtatttcctctattgacccccagggaggcccaagagggccaagtcacagatgggatggggaagagaatctagaactgatccctcttaaagacagtgcagactagcagacggctgcaaaacctgggtgttggggccctgggaacttccagaagtggaccatccatccctactcctcccagagttacacacacatcccaagttgagacagcacctgtgactggcctggccacacactcaccattaggtggtcaagaccggctctctaaagtggctgcctcaggccctgtggctcccagtaaccaaagtccacaggaggggtggtgcagtctgattgatccaggaagtgagcagtgatgggaacaagggatccccccatctttctacgaggccttggagccgactggagcatgtcacagaggggtgagcaggacttatttcatcatatgttcaaatgcttgtgacagacttccagacacttctgttcctgcctcttctcccaaacacacacccatccacaggaaccctgtactcatgtccgccagattcatgtctactcgaataaaaacttcaattcagtggttacgtttgatgtccctgtgcctttcaacacatttttacataatctgactttagagccttttctttataatatgcttcctttctaagaggagccgatgcctttggttaatggagtctattcaaaaaatacctattgaatacctgctaaggcctgctgaaagccagacacttggggtgcagggaggggttgccaatgggatagaggaagccagagacacatactttccctccaagaagcttagagtgggggcggcctgggggagatggaaattcacacaactaatgccaggcttggtaagtacacggaaagaagtgaacacaaattgcttcaggaacaaaagcctaattcctgtgtttgcatgggcctctgatttcaggtttgtgaattcatgagttacgatttgttaatatacatcatggtgcatgaaataaagctcttgatctaataacactaatacacaccaaatagagtgtgagctggatgagtaattagtgaagctctggggtgtgacattagccctgcttgtggagggaggcgtagcactgcctatgtgtatatacagccatgcctccagtatggcagccaccaggcacacgtggctactgagcacttgaaatgtggctggtccaaactgaaatgtgctgttaaatacacatgagatatcaaagaccagatatcaaagaatcagtacaagagattaaaacagctcatgaatacattttgtactgattacatgtttaaacaataatatcttatacagtcatgcaccaatcaacaacggggatacattctgagaaatgtgtcgttaggcgatttcatcattgtacgagcatcacagagtgagttacacatgcctagatggtgtcgcctactacacacctacgacacacctagatggtctagcctactacacacctagatggtctagcctactacacacttagatggtctagcctactacacacctagatagtctagcctactacactcttaatggtgttgcctactacacacctagatggtctagcctactacacacctagatggtctagcctactatacacttagatagtgttgcctactacacacctaaatggtctggcctactacacacttagatggtctagcctactacacacctagatggtctagcctactacacacttagatagtctagcctactacacacctagatggtctagcctactacacacctagatggtctagcctactacacacttagatggtctagcctactacacacctagatggtctagcctactaaactcttaatggcgttgcctactacacacctagatggtctagcctactacacacttagatggtctagcctactacacacctagatggtctagcctactaaactcttaatggcgttgcctactacacacctagatggtctagcctactacacacctagatggtctagcctactacacacttagatggtctagcctactacacatctagatagcctaacctactacacacctagatggtctaggctactacacccttagatggtctagcctactacacacctagatagcctagcctactacacacctagatggtctagcctgctacacccttagatggtctagcctactacacacctagatagtctagcctactacacacctagatggtctagcctactacacacttcgatggtgttgcctactacacacctagatggtctagcctactatacacttagatgctgttgcctactacacacctaaatgctctggcctactacacacgtagatggcgttgcctaccacacacctaggctatacggcatagcctgttgctcctaggctacaaacctgtacagtacaatactgtactgaatacagtaggcagttgtaacacagtggtaagtatttgtgaatctaaacatatttaaacgtagaaaaggtacaataaaatatggtattatcatcttatgggaccatcctcatatatgcagtccaccattgactgaaatgttattatgtggcatgtgactatgtatattgggttaaataaaatatgttatagaattaaaattaatttcatcttacttctttttactttttttgttttattgtagctactggaaaatttaaaaccccaaatgtgattcacatttatggtccaccttatattcctattggccaatgcagatctagagcattcatattcgtttcgtcatttaattctcaccaccatgctacaaagtaggcattcacccccattttacagtcaagctaattgaggctcagagaagtagtaaattactccaagtcacatgacattaggcttcagcaactcacttgagctgatgactatcttgggccagtggctcaaggccttgcagcaagatgaaggccaagacaaccacgtctactggcagtgtggcctggggccagttatttgctccattacttgtgggtaagaacagaaggagagtaggtactccgtgtgttcaacaagtgaggacggtcatcattgtatcacacgtcttaaaaatatcccctccccctggcgcctcctacctacaaggcccacagttacagcctttgaggctgggctagaagcccctctcctcccccattatcaacatcccacccctccagagtggtgcacttgttgcaatcgatgaatctacattgacagatcgtcatcacccagagtccataggttacatcagggttcatacttggtgttgaacattctgggaattttggcgaatgtataatgatctgtacccaccattacattattaacatacagagcagtttcaccaccctaaaaaccccctgtgcttggcctgttcatccctgcctccctccaaccccggcaaccaccgagatatttactctctttatagttttgcctttccagaatgtcatctagttggaatcatacaccaagtagccttttcagggtggcgtccttcacttaggaataggttcttccatgttttttcatagcttggtagctcatttcttttttagcactgaatgatatcccatcgtttgcatggatcacagtttacccgttcacctgctgacggacaccttgcttgtttccaagtttcagtaagtatgaataaagctgctatacgcatctgtatgcagatttttgtggacataattttcaattcctttgggtaaacgccaaggaacactatgctggattgtataagactatgtttagttttgtacaaaaccaccaatagctgtactattttgagttcccaccagcaatgaatgagaggcatgctactttgatgagctcattgccatgttattcttgtttgtaggagctccacctttctggccagaccccagccatccaatctcactggggttcctacaggtagcatttggcacttggtggatgtacctttgccgcttactaataattacagctcatggcaagcacttaatatgagctgggaactgggcagaggtctttccatatcttgtcccattgaccctcacagcaaccctatggcccaggcactatgacagtccacatttacacacaggacaacggggtctcagatgtgctcagtggcttgtccaaggtcacactgctggcaggtggcagggtgggatgtgaactctctgcaggtggccccctggactaggctgctccctggtacctgtctctccatcttacttagctatgagctctttaagggccaggacaatacctcatgcgcctggaagtcacccccaccctgtgcctggtgcctcacctgttaggacaccagtgatgctggctgagtcctcagcgaccctcccagtcctgtgtcgtaggctctgctctttcatgtgagctgtccccaagaacccagccctatctctatcatccctcccaggccccttcactctcatagtcccaattttccttctgggctgttgacccccaaatgccacacccaacctggtcttgtgcaaagatctccatttccttttgtctctgaatgctgtcatcagttgtccctttaggagacccttacagacccctcatattcgctggtagggactgactgtgtttccccagatccatatgttaaatctccaacccttaatgtgatggtattaggaaatggggtctttgggggtgattaggtttagatgaggtcatgaggatgtagcccccatgatgggatttctgtccttataaacagaagtgcatgaaccaatgaaggacatgtgagcatactaccaggaagaggtggtgccctcccgtcctcaccaagaactcgggcatggttggcacactggtcccaaacttcagcctccagaaccaagagaaatcagtgtctgctgtgtgagccaccagtctctggctttcttcacagcagcccagttgactgacatttgccatgacagaagacgacctcattgtccctccttgccagtccccccatttcctcacgtcagtgccatttccacttgccctttagccagtcccctggaacccaggacactctaactctcctctcttattctaattttcaattctcaatttccccttcaaaatctctcttgggttcttacctttctatccctactccacgatcttggctgaagccattttccatccataacagaagaactctaacagtctatgtggtgtccatacctccaatctcccttcatccagtcatcatacacacaaatctgcaacagcaataccacccaaaccatgtagatcactccacaacccgctatggctccctactgctgcttggataaagtgcactctgttctagtattcccagactgcaggagtctcacccctagctgcagctgtcccagctcactctgcacagatccctgctttggctcagtccaccccctctctgttgcctgcccgagttgggctcatttccacctccgcgtggctccacatacagtcccctggcctggactgccctcatcctccttccctttccatctgggtgacaacaggccttccagaatggtcccaaggccagccacagaatctgtggatcgttctaaactgcacagattgagaatgtacatgctgccattgtttctctgcagatgccatcaaacaacaggcctctcttggtagctggtgtctcttgctcaccaacaggatgccctccagtgaggaggtgtccagcaatcctcagattgcatacccttgatccttgatcaatgtcgaagtaaaaagtaagcctagtgacaacccgcagcaaaacagtctccctcttgagaaatctagcatgtgcccgagtgccaacccaccagcaatgacctctgcaagggtcccttacaacctcaggtcccacaagtgacagggacattcctgggggtggcgtgaggggagggactcagttaatcccttgtagacagcagcaggttcccctaggacagcatccccctaatgggcggtagttcctcacctctgccagccagccagccagtctctcctaggcgtggagggtgggaatggtatgaagtgaaacctccctactccaatgccctcatctgaaagccccaaaatgaggagggaattgccctctcaggctcctcattgaccacctatgtcactaccattcaataaatgtggtatttgttacaactgccctatgaagtaggtactcttatgaccattttaaatattagaaaactgaggctctgagaagtggcacagctagtaaaaggcagagttggtagagtgcacacctactggctctctcctggctcacggcaagcccattccagctaactgctcccttccttcacagaggggaaccatggtggtcttgtttgagatgaccctgttcactggctgctactgattgaaccagaggtgggctcctgatccaagctgggccaatcagaatctggtattgggagagaaaatgcttagataaagagcgagagcaatagagaaagagagagagtgcgtgcaagaacgtgagagcatgagggatattttagacttccatctcctaatccacagtgacccaacggctcagctgcacccttgccttgggtctcctgagatctctccttggggcttatgccagcccagtgggttctcttcaactagaaggagagtaagcaataaggtctgaggcaggtccgagtaaggcactggaggtgcaaagacaagtgtagcccacgggggttcctggctgcaggaatttggggcccacagcagaaagaaccactccaggagacaggccatgagaatagaacagtaaggccggagagtcagggacactcagcagggatctgccagcatcccaggactgtgctgctgagaaggggctgtcctcttagctgggccagggaaggaatggagagcaaatgggtttcatgcagatttcagatgaggcctgattgcagcattctagaagaagacatttgctagaaagcccaagtgccaccacctcctccaaacctctcctaactctggctaaaataaacgtgacagtgaaactaggactttattcacatggccctgcctgtatcttcattcctatactggaatggaaagtactgatgcagaatccatgtgtgatttatttttgcatcccaaagcacccagcccagtccccagcctatcctaaggaagtctggaaggatgcctgttgaatgagtgcacagggagatccccccagcaggcagcctctgcctagccacagctgtttccaagcaggtgtgcgtgtccccattcagggcttctgagacagggctcccaagacagggctcccccgtggggcaggcaacaggtttgccacagaggtcccttactactcctgaattctagggtgatactgcccctctgggagaatcttgcctttgctcatctagtttttcttctgcttcttttacaaattggcaccagacgcagggctgagagccagattagggaagaaagctgtcaaaaatatctcccctccagaaaaagcaaaggaaaacaacatcttggtgggtttttccaggggaagaaaaagtgaaatagtttctttttgccttctatgtgttgcccgaaaatggcagttttgcagagagaaaacatattttcctgagcaaagctgtttgtggtgtgaaagacagagtgtgtgtgctgagtacaaagacacaaattggcccgaggctcagctacgcatgctattttcacatgagtttagattagggaggaagaggttggggataagaaaaaataaaatctttgttttgtgaacatgaaaaaaatgttggcctggagcaaattcaaacctggtgtctggcacaaggcagggctgtaatagagatgtgttgaaagaagggagggaagttgagggcaagactgtttgccctccccaggctcaccagagaaggtacaggctcactccaacagcaggatggctcaggagctggggccattgcagactgcagctaggggtctgctccagggcatggtcaaacacccctccaagccctgcctcctgccctctcaggacctaccttacaaggctcctgagaagactaaaggaggtaatgcccacaaaggtgttgacactggccctcccctcatgagcactgaggagcagtagtggctttgctggtggtggagatggtgatagtgattgtgaccatgaagataaaaagatgacaacgatgatgatggtaccgatggtgattgtagtggtgataatggtgatggttgtgatgatgaaaacgatgatcaggatggtaaggatgatgatggtaataatgatgaagatgatgatgatggtaatgtggtggtgacgatggtaatggtgataatgatgatgatgaagaggatgaagattatcacgatggtaatgatgatgatggtaatggtgatgaaggggttgatgatgatggtaatggtggtgaggatgatggtgatgaggatggtggtgctaaggatggttacgatggtgatggtggtggtgacagtggagatgctaatgatgatgatggcgatgatgacgatagtgatggtgatggtggtggtgatgatgatgatgacgatagtgatggtgatggtggtggtgatgatgatgatgacgatagtgatggtgatggtggtggtgatgatgatgatgacgatagtgatggtgatgatgatgatgatgatggtgatgatgatggtcgtaatgatgatgatggtaatgatggtgatgatgatgatggtggtaatgactatggtaatgatgatgatgatgacaatgaagaaaaacaaaatgaagaagatcacgatgacaatgatgattatggtgatggtgatgatactgttaatggcccctgccccactcattatgggcactgccccataacctctgcttcccttcattgctctaccagccccttagaattagaaaggcctttccccaaagtcgacctgaaacagagtcgctcaaagggtagtctgagaaccaactgaatgagaaagcctctgggtgtgtgtgaattatgcagatacccaggtccactcgtatcttcagattatgactcctaggggtccagaaatacacattttaaacaagctccccaagtagttcttccgtatactagacatggagagccacccatacaatccagctctctcattttacaaatgaggaaactgaggcctgcagagaagcagcttggccagccaggaatggcagagccaggactataaccacatcctcaaatttcaagagcagtcccttgttgctccagcatagcctgtttagtcaaccttatgtgttaagtgccaactgtctgcaaagcacagtccacgaccaaactaaatgagaaaaaaacaaatcacataaaacgcatgcctcaaggagacatggcctgtgtaggagataaaagaataatggggaatggtgagtgccagacaaggggaagagagagaagctgagggagttcaacaggaaaggctgcacagtgtgggaaatgagaggctggaggatctcaaagatccaggaagacggcatggaggagccagcacttcagctgcagctttgaaagatgagcacagtttagccaaacaaaataacaagaagggtgccacaggccgagagagcatcatgggtaaaggtacaaggcaaaatgtccaggacatttatggggaaggggaagaagctgcatgtgtctagagctccaggtgaaatgtaccacatgaagcacaaggatgggggagccagagaatatgggtacctgaagctaggcaggtaagattggcttttactctatgggcaacagagagccatggcaggctttccaggaagggagtgacatgcaccttagacaggtcagcctgacagcagcttaaaactagatggaatgggagacaactttgtccctaagctcagtcccctaaagataccagcacatgactgtcaggcccctgctgggacagctgcccctccctaggcctgtccattctcttacctccctcctgcctctgatggggaaggggtgatgggttggaagtgggtgtgtgcaacatttaccatggccaggtctgctctgtgctctgtccccacccagcacacccatctccatccataccggccagccttgcctgttccctcacagtgatgcataagctgggcttctcctgcggtgtgatactaatgtactagccaaaccctgagaggccacatatggtgggtgagggatgtgggactgccagactgccagccagtgccctgaagactctgcatttcatatgcgtacacatttagtagtagtgtgaccctgggccagttactgattctttctgagcttcggtttcctcatctgtaaaatggggatgatgatacttaccttaaagggctgccatgaggtcgaaagacaaactatgacaaacagccagtctcgtgcccagcccagcgtgggtgcaagctatctggtggctgctcggatgatgatgatgacgatgacaacgatgacgtagcaccccatttccagctcacaccatcgggatcaccgccagcatcagcagcatcatcaagccatcttcctgcgttgtggcagcttgggcccccactggccatgcaggagccaggagatcaaatcatgaatggggctctttgcacttcaggcaaagtgcaactccaggaaagagagaagattaaggccaaatctctgcacccaaacaggatccaagaagtggggtaatctgggactcatcacatctacataaagggaggaggaagccccagggtggcctggggaggaaccccagtggcctaagagcaagttctgctctgcagctgaacttcaagaacccagctgcatctcgaagttctcgctgaagaatttggagacctgaaatatcctgttttgcatgaataagcatttcaaagatattgattacaacagctccttacatgtgtacagacagtggtgtgtcatttctcacacattttcagatccatcatccctgtgaggaggcaggaaggagattagtgagttgatgtgatagatggggaaactgaggagagggaggtaagtggtttccctgaaatgccacaggtctgatttttttccctgaaaaaggcaggtctgattctacctacatctagggctcccctttgtgtatctgaccagatgcatgtgagaaatctgagttgagttacctgtgaaagtcttttttttttttttttttttttgaggcaggatcttgctctgtcacctaggcaggagtgcagtggtgcagtcacaactcactgcagccctgacctcctgggctcaagcaatcctcctgcctcagcctcttgagtaactgggaccacagatacccaccaccataccaggctaattgtttttcttagtttttgtagagatggggtctcactgtgttgcctaggttggtctctaactcctgggctcaagtgatcctcctgcctcagtctcccaaagtgctaagatcacaggcatgagccatcacacccagcctggaagttccttcttaccaggcagagagagaagcacttccaagcttgtaggattctaggaaagtttctaatccaatctcttcatgtctcagatgagaggtgggagacctagaggaagccactgtgcccctatttaaagtaagaataaccccaaagatatcttctctggtcaaagagtttccaaaccgttgaatgtgaatcttgctaccggcagcatcagcatcaatgggagcttgttaggaatgcacattcttaggccccaccccagacttgctacatcagcatctctgggtggggtccaggaatctgcattttaacaaattagccaggtggctgcacagtaaattttgagaatttagcatgcttaatctgatgcatgctaagatctgaacaacactgctctcaagagttgggggtgagtgttctttggagggttcaacagaagtttaaggcacattttcattatgttgacgtaactgtgtttttaaaccacaatttgaaaacagcccttgaaccctaagttatataccaaattttaacaactgggaggccaccttgggccacagacttaggtcacgctttcatgtccgaactccctggaaggtggctgcgtgtgttattctgtgagcacagggtggggcgtgccccatcctaggcagtgcacactggcttgagctagaaccgctctggcgagctctctcagttagctctcccctgcttgagaagccccctagatcgggtatgaaagccagctgaaaacgtcggtgccctctgcaggtttttgtatttattatgatcctacttatacttatgacgaggcgtggatatcatttagtgatgctacgtgacacagaaataacacaacacttctcaaatttctgcatctgtttcacccaacaattataagttgagctgttaaaaaaactttttaccatccacaaccaccacttatgtgattacatgagttgatcaagaattttaatacttttttctttttttaagacagggtctcactctcacccaggctggagtgtggtggtacaatctcggctcactgcaaccttcacctcccgggctcaagccgtcctcctgcctaggcctcctgagtagctgagactacaggtgcacatcaccacgactggctaatctttgtatttttgtagagactgggctgtgccatgttgtccaggctggtctccaattcctgggatctagcgatccacccacctccggctccaaaagtaccgggattacaggcatgagccactgcacccagcctcaatgctgtatttctcaatactgtgttacacgcatgtaaaaatgattgaatgggccgggcgcagtggctcacgcctgtaatcccagcactttgggaagctgaggccagtggatcacgaggtcaagagatcgagaccatcctggccaacatggtgaaaccctgtcactactaaaaatacaaaaattggctgggcatggtggcgtgcgcctgtaatcccagctacttgggaggctaaggcaggagattcgtttgaacccagaaggcagagcttgcactgagccgagatcgtgccactgcactccagcctggatgacagagcgagacttggtttcaaaaaaaaaaaaaaaaaaaattagccgggtgtggtggcacacacctatactcccagctactcgggaggctgaggcaggagaattgcttgaacccaggaggcagaggttgtagtgagccaagatcatgccactgcagtccagcctgggcaacagagtcagatatatctaaaaaaaaaaaaaaaaaagattgaatgctaagactaatgtctaagacaaactattaactaccatccctgatccctgatttcaaatttctgtgtcatcgaaaggggccggtttttctcatttgcaagtttactagcaagtgacattctaagttttaacttatgggaacctttatatgaaaaatgttacttgtatctaacttgtttagcggtgagcttgtgtaggatttaatttgagaaaaaagtgtctctgctttttaaatgttagaaaattactaatttaggacaccccgctcattttatagttaaggagtctgagtccttatgatgtcatgtgagtcactcgaggtcacacaggtattttaagtataattaaatcagagagcagggacacattgtgtggagaggcacgaataaattgtggggaaaagggaagagtacacttcatggactcagataagtaattgtagtcattttgtgtgtgtgtgtgtgtgtgtgtgtgtgtgtgtgtgtgtgtgtgtgtgtgtgtttgaggcagggtctcgctctgtcgcctaggctggagtgcagttgtatgatcacagctcactgcagcctcaaactaccaggctcagatgatcctcctgcctcagcctcctgagtagttgggaccacaagtgctcaccaccacgcctggctaatttttttattttttatttttgtagagccgatgcctccctatgttgtccaggctggtcaaggacttctaggctcaagtgatccttccacctgagactcccaaagtgctgggattacaggcatgagccaccgcgcctggccgacttcaggcatgtaataaatttaagtgatttagattggcttagtttggccagaggcagctaggtgggcttctgaggctttagctacctgcttacactcactcgtttcccactagggctgcttaccgcccaactcagttgtcgacgccacccccagctgcagggcgggtgggcactgagaccctgccactcagagcttatggtccccagagagtggcgcaggcccagtgagagccagggagacctcaggggactttggcaggaagaagcctgtagtgtcatcacaccgccgaggacaagaagggaagcacacgccgccccactcagctgccctagaaatgcaaagcgaaggggaggccaccagccaatgtactgaagtcataaaatccactccagatctcactcatggtgtgaaacagaaaagagggagactgcagatccaaaaggcaggaggaagcaacaccagaggggggattgaggccctgggaaagctacaaagagtggctgggcaatgaagccctggaacagaaggctctgcagcctcagatgggcctgcaacagccatggttaggccaaggccagcctttccctgcttactggacacgctgtgtgtgcaagatgagggacgcgcactgcccatgagtaacttctgtgtgccttttctcttccgagatgaggacattgggccttgacggacccatggctggggccaccaaagaacttggaacagagacaacacgcgctggccccaacgtccagggtggatggaacaagaccttctggtgcgagaggggagagcccggcggtaacagttccagcctggtggcccacgccctccacaaggactcccaccaattcccatctgtactcgccccttcccaaggacggcagctgagaccgtagggccttgaatatgcacctgcaaatgaataagtgcacgtcccggccctacctgggcatacagcccccacctgacaagcacagggaagcagcccgagcacagctctacgaacgccggggacagctgctctccaaagagcaaaaggacatcagcccgttagcggaacaagcttcctgtccatgccttaaaagcataactcgttaactgctaaggtgctgaattatttatgccacccggctggggtttcccaccttccagcaattgctcactttcctatccccatcccgccaccctctgcctccctcaccgtcgggaggtgaggaagcaagaagaaaacggaggcccaggcagttccttgggaagggtgagaccttgcagtaaggacccaggccggggggaccttccactcccttgtccataaggtccacgatgccctactttccactcctgcaggaacaggacccttcctgcccaaggctccggccctgcctcagtccctcaaaactaccacagcctcacgcctggaatcccagcactctgagaggccgaagcaggaggattgcttgagcccaggaatttgagaccagccggggcaacataagcagatctcatgtctgctaaaaaaaaaaaaaaaaaaaaaaattagccaaacagggtggcacccacctgtagacccagctactcaggaggctgaagcaggaggatcacttgagcccagggggtcgaggctgcagtgagccatgattgcaccacagtactccagcctgggtgaccgtgcaatcctgtctcaaaacacaaaacaaaacctaccacagcctgggaggcttacaaacaacagaaattcatttctcagttctgaaggcttgggagtccaagatgaaggcagatttggtgtctggtgagggctctcctggttcgtagacgatgccttctcactgtgaacaaaccctcctcatcagggcactaacaccatcactgggctgcaccttcacgactgatcgccccccaaacccccacctcctaagaccagcacatggggttaggatgtcaacacatgcatttgggggacattaacactctggctgtagctaatggcctcctgtaaaacagaatcattgcttgtagcgtctctctcacaggggcaactcagggaaaaccaaatctcagtttgggggcctgaagaagactcccagaagcaggtatctacgtacatcgggcagatactgaagcaaatgctttgaccatctcctccgtgctaggtgggggctgcagggacctaggggcaatgtggaccttatggacaatggcccattccagcctctcaaacagcattggtggaagtggctgccacccccatcaggatcagaggagagatgccactgagacgttagggacagctcagtgtaccgtacatccctgaaacgcattttagaaatgttattcatgaggagtttataaaaacttggatgatgcttgtaacagagcattaagggaaaacaagcagaacaaaacattgtgcaaagagcatgacatcaggccgggcgcggtggctcacgcctgtaatcccagcactttgggagaccaaggcagacggatcacaaggtcaggagtttgagatcagtctggccaacatggtgaaaccccgtctctactaaaaatacaaaaactagctgggcgtggtggtgcgtgcttgtaattccagctactcgggaggctgaggcaggagtatcgcttgaacctgggaggcaggggctgcagtgagtcaagatcttgccactgccctccagccttggtgacagagcaagactttgtctcaaaaaaaaaaaaaaatcaacttaggttttgggaatgatgttgatgatgcagatgcaaagggaggagccaaaaaagttaacaactgctggtacgtgggtagtggggttgtgggtcatcttaggtgggactagagggagaagaggagaggggcccagggccctgggggctcaaagaggctcgaaagaaacccctctgccatctggcccaggccaggatagggaaaatcctgggaccttacgctactggtggaataagacattaaaaatggtctaatacattgatacagttcaggaagttttctctctgcaccaacacatatacacacacacatacatatataaacacaacacacacaaatgcaaatgtaaaccacacacatgtatacacacccacactcattgtactgtatatatataagtgtgtgtataaagtcctcttcccaccccacttggcctcccaaaggtacacaccaaactgtaattttgcagtggtcctttatgattaaataagcaagtacacatgcacctgtctgattttcccgtttttaccaataggaggcattctaaacatactgttctgccttcttcactcttcacatcacagcaggactgtggcagtttatcacaggtcgagtctcccttatccaaaatgcttgggaccagaagtgtttaggattccttttttttttttttatcttgaaatatttgcattatactagttgagtatctgatatggtttgactgtgtccccacccaaatctcatcttgaactgtagctcccataatccccacatgtcatgggagggacccggtgggaggtaactgaaccgtggggacagatttttcccgtgctattctcaagatagtgagtgagttctcatgagatctgatggttttataaagggcagttcccctgcacatactctgttgtctgccaccatgtaagacatgactttgctccttctttgccttctgccatgattgtgaagcctcccagccaggtggaactgtgagtccattaaacctctttttctttataaattactcagtcttgggtatttcttcatggcaatatgaaaatggattagtacaacatcccaaatccaaaaatcccaaatctgaaatctgaaatgttccaatgaacatatcctttgagcatcatgtgggtgctcaaaaagcttcagattttggagcatttggatttcggattttcccagatctgggatgtgctacctggactaacatttggatcccagcagtggacccttccatggcccctgccttggcagaaatggggaaggcagctccctgggcctccctagcacttaggcccagaagagtcctccctgcactcctcttcctgccaggtctctggaactcagtgaggcagggtgcaggagacttgagattggccagccccacgagcccagggcagtggtggaccccaggcttgtgctgctgtagtgctcttgccagccctggggggctggggcccacccagaggggtcctggttggagacctccacagagtactcagaacacgcagggctccctaggaactccatgcattatgggaggataaaatatttaaacctatacaatataaaatattaacttaattatcataaataatatatgcccaatgcgtctttactgaagaggaagagaaaaaaaaaaagatgaacactcttagcgtgagcactcaaacactggtgaggatgcgaggtggggtgttgggagtgagtctcccctgcagcaggaactcagctcacatgcttggagctaagcggctggatggctgcaagtctaggaaatcgtccatctcctcctgggccacccagcctcctcttcctgctccttcagggagccgaccctgacctcttcctcctttacctacccaggactctctggaagtccctccttcacgtttgaccttgaggagtttgttttacgtcccctgagcctcagtctctgccccagcagctgcagagcccctggagggcaggcactgggtcttgcacttcccctgggcagagtcagtccaggaaatctctactgaatgaaaaggtgttcccacctgagaactaaaaataaaatcctaagcctcccaaaccactgaatggtcccacccacctcttggccaagggaaccccagagaaatcttaaaaactaagttcccgcccatgacaggacaggaggttggatgcacctcattatacatactcccgttttcatttaaacactagaaacaactgaccagcattaatgccaaagcagagatcataagactgacagaacagactctgtggtgataagatacccaattataaacaggacctaaggccgtgcaggcaatggtgaagtcaggcacacctacacttaaagaatcaactaagctctaactgtcacagggttcttctttttctccagcagctaaacaacacttgcctcaagataagcaatagtaaaccacttgcagctccaccagacagtgactaaccgaacccctgttccaccagctgtaactacagctttgattggacaagagactgatttcagtaactttctcctgataagaccactgaccgtggactggttctggctggtttacagaggctgagcactgagggccttcatgtccttgcctcaccttttaacgtacagaacctaactgtaatgcatttaaatgttaagtctccaaccaaaaatgaacatggaacataaagtgcatgtttgcttactatgcgtgcatgcattcccccttcatgaatattcatagctcctcccagaacctgttgaatatgtattctcagccaaccccttcagcaaaaaagtccttgcttttggttttcaaccagtggttgcacttcccgcctgcagtttgcgatctccttcttaagaaataaagctctcctttctaaattcatcaattgtgtgatttttcagctgacacacctggggcccttccatcgccaaggtcagcatgaagtgtactttatggcaaacacatctacatatattccctcagatcatcctcccaacaacgctgtcttataagcaggcagggtaatgattttctgattttttttttttttgctctgtcacctaggctggagtgcaatagcatgatctcagctcactgcaacctctgcctcctgggttcaagtgattctcctgcctcaggctcccaagcagctgggactacaggcgaatgccaccactctgggctcattttttgtatttttagtagagacggggtttcaccatgttgggtaggctggtcttgaactcctgaccttgtgatccacccaactcggcctcccaaagtgctgggattacaggcgtgagccactgcacccagccaattttctcattttacagatgagaaaatgaaggcttagagaagataggtagcaggctgaaagacaacatctttctaagctcaactccagtgatctttgcttacttgtaacattcccttatttgccctttgtgttaccatttccaccctcaaatcactctttttttttttttttttttttttttttttttgaggaagtgtcgctctgtcgcccaggccggagtgcagtggcacgatctcagctcattgcaacctctgcctccaggttcaagtgattctcctgcctcagcctcctgagtagctagagactacaggcacacaccaccagacctggctaatttttgtattttttggtggagacagggtttcaccatgttgactaggctggtctcgaactcctaacctcaagtgatctacccatcttggcctcccagagtgctgggattataggtgtgagccactgtgcatggcctcaagccactcttaaagatattaaatatatcaatctgattttgattgtcccaataatgccagaggggaggatgggcagctatcaccatctaggttcctacttcttagggtctgtgtgactagttataaaactattttctcttttaatcttccatttcctctgctataaaacagagataatactactactgacctcctagaattattgggagggttaaattaaacaatgtgtgtatagtgctgagtgttgcggacagctcggagaagatgcttgagtctagccatcatcatgaaaactccacaacaccaaccacatcaggtctttctcctgttcctatctttctcctgctcccttccttattgaatttccacagtctccaccacagaggcagtgcactggtgtgacttgggggttaccacaaggaaaatggaagaaagtaaacgtttactgtgtctcatcacttgtaagttaaaaaataaaagaaaaagaaaagagacaatagccacagccagagtaggatggctgttatcaaaataacagaaaatcccaagtgttgtcaaggatgcagagaaactggtacccttgtgcgctgttgttgagagaatgtaaagtggtgcagctgctgtagaaaacagtatgcagtccctcaaaaaagttaaacagagaattaccatataatccaatcccacttccgggtatatacccaaaagaatttaaagcagggattcaggctggtcacggtggctcacacctgtaatcccagcactttgggaggtcgaggtgggcagattgcttggggccaggagtttgagaccagcctgatcaatatggtgaaacccccgtctctactaaaaatacaaaaattagctgggcatggtggcacgtgcctgtaatcccggctactcaggaggctgaggcagaagaatcacttgaatctaggagacagaggttgcaatgagccgaggttgtaccactgcatcccagcctgggcaacagagtgggactctgtctcaaaagaagaaaaagaaaaggaaagagagtaaaagaaaagaagaaagcagggacccaaagaaatatttgtaccctttatatgaacattataatgttcctagcaacattattcacagtagccaaaaggtagaagtaactcaagtgttcaccggtggatgaatggatagagaaaatgtggttattacatacagcagaatatttttcagttataaaaaataaggaaattctgacacatgctacaacatgataaaccttgaagatgtagtgctaagtgaaataagccagccgcttattcacaatagccaagataaggaatcaacttaagtggccatccatggatgaatagacaaagaaaatctgagacagataaagatatagatacatagataaatgtttaatagagtcttattcatccttaaaagatatttaaatcctgtgatttgcaacaacatggatgaacctggaggacattatgctaagtgaaataaaccaggcacagaaagacaaatactacatgatctcgcttatgtgtggaatctaaacaactcaaactcatagaagcagagaggaggacggtgagtgccaggggctggggagaagggaaatggggggcgggtgttggtcaaagggcacaaagtttcaattcggcaggatgaaagagttctggagctctaacgcacagcatggtgactatagttaataacatattgtctacctgaaatttactaagagaatagatcttaaatattctcacagcaagaaaaaaataactatgcgaggggaagctacactaattagcttacttgcgggaatcatttcacaatgtatacacagtgtatcaaaacatcacacagtacaccattaatacatagtttccttttgtcaactacacctcaataaagctgggaggggaagcagagttcatgaaaccagttgtaacacaaaagatatgttaagaatattttatttttcaatttttcatcagggataccatgtggctttcatgggcttcacgagtaggatggtgattccactactgtgtacatttactgctttaatgcaaatataaactacatttcaaatatgtcattggcccattttccatgaaaaagaaaccagtcacaaaaagacaaattccacatgattccacatctgtgaggtccctagaacagccagattcatagagacagaaagtagaatgagggttgccaggggctgggaaaagggggcatgaggagttgttgtttgatggagacagagcttcagtttgggaagatgcaagagttctggcgatggatagtggtgatggttgcacaacagcgcgagtgtacttaatgccaccaaacgatacgtttacagatagttaaaatggtaaatttaatatatgtattttaccataaaaaaattggccttaacaacagtgaacatgcgattactgaatctcactacatgatcccaggaacaggctcagtggatgacacttctttcagttaatctttacaaccttctgattagtgttgaaagtcccagttttacagatggggactctaaacttagaggagttacctgctttgccaagaaaattctcaaacacagacatgtcagcctccagcgcctgtgttctcctgattgcaaccctgaatagctccacctctttagcaacccagagtgataacaaggggactgtctgtatccttcgatcacacaccccccacgctcagtcactgcagcagccagaaagccacctgttgagctggtaacactcagccctggggaagcctagcgcctagacactatggggctgaacttccgtatctcaccgacaggtcacctcacaccatcagcaaggggaatccggcccttgtttctcaacattctttgcctgcagttctgaaacatcaagctgtttagggcagacgactcaggaaggaagttcaggtcttctcgccagggggagggaaactactgctttctggaggccttgccttctctccccgccccgcccaccagagtccctgtgctcctttgatgaaatggtttcagacttgcagaaacgcatatcgaggtctcttaatatgtatagcaataccagacagcaaggacacctgagcgtgtgttaaaaatacaggttcctgggaccaactcctacgtgtctgagtgcctcggcgaaacctggagatgtgtatttttaaaggcccccgaggattcggatgcacggtgaggttggagaagagctagcccaggggtctctacaaatgaagggagccctggaggctgagtccccttcctgggtgactctggactccgcaggcctctggtctgcagggtttgtgctaccccctgtcctgtgaagccccagacctcccggtggctgatgcctggcgctgcccctggctctgcgtggttctgggccaggcctacagcctctgctctgtcctctcgctggcctccccctccttacccctgccccatggcactgtcctgcccactcgctccagccggccccgcctgtctgtcaattaagtgggcttggctggctgcccaggtgcacagtggctgaggtggctgcaggctcttatcaatgagatcaacagggtgtctgctgaagacgagtcggaacaagatcccgtgactatgccctaggtggtattctggaggtcaccctgctgaagtggctggccttggtggcaagaagcttttctggggaggaaagggctctgggttctgggttgctcaggagcccattggaatggatgctctgtctgcctttgcactgcagagcagcttattctcggaaaaggcacctggggttctaatggctgcaaggcacccactggcttaatgaaacctgctcttggcatctctgctgcctcttttaattcttgtttggagagtagccaaaacctctatctgttcccccttttctcaggacatgacccggcaggagggttcagagcccttccaggctgggactttatttgagtctatttgtgaacaggtggatgcctgatggaacacagcccctgacccggggctggctgctccctgcgcctctctgcagggggctgcgggaattagcctcctccaggggtggctgtacgtgaagacctaccaagagctgaagaccctactgacaccactaagagggattttttactggggagccccagagagagggaaatggatcaaggccctggagcaggcttggcagcgagacccatcctgcaagaagggctgccaaggctggctgaggtgcccacctccccgtgggctggcaggggaggcaccagtgttaacactggaaacacctggctgataaaaaccaaaaacattctctcaatgatgggtgagaaagaagaagaaaaaaaagttaaccaaatctgttgggcagaatttttctagtcttttcctacttagctttaaaaggccttcaagagtcactaaggggcaaacagcgcatacacacagccaggagagaaagactgtgtctgctgcagagaggctagaaggacatttcccccttctgtgcctcaatttaccattgcaaaatatagcgtccattgcctttcccgggcccctcgtgaggaaatcatattgctgcaaccacagagatctcgcatttccactaggagctgctccctggccttgagcaacacgctccagtcctcggggttttcacttgcaaaacagaaacatttacaaaggaatatcaggaatggattcccctcctactcccagggccggtgctgttgtggctagcacacggagacacgcagattcagtgaagctggctgagtaacagagacaagcgtgccagatacagggaggggcaatgtaactgcgacaggattcaagaatatggccaacatcagctatcgtcgagatcgcggctgatctcagcaatcgtggcattcacattaagtcctggttggagcgagtcacttcgtccctccaagccccacgatctcctcatcagtgtaaaataaggggatgggcctggatgatggtctcggagatcccttccagctccgacagtctacaactctatgaagaacaatgagaaaaagacaagtttgttgacagaaacatttttaggtccccagccaaatccaagggacagaaaagggagaaaagagagggaaacagaagagagaaagagctttcattttatttaaaaaaaaaaaaaaaagagagagagaacctgacttgatatcccagaaaagctatgaagaaagagaaaagaaactactgggcaggaaaagaacacttgtggatatttttctttcaaagagaagagctgtttggtagagaagggcttccgttttctaccaccagccactcgcttacatgccctctgcctgttcttccctcatgtccccacagacggatgaccatgtccccagaaccattggccccattcctcaacacctatcccccattccccagtgctgctccccactcctccctgcaccacccactcttctctctggtggtcaccctcatcctcagaataacagcccagatatttcaaaaatgaaaacatcctctgacctcacatctcctccagctatggcccttaattctctgtttcgccttggagcagaacgtctcaaagaaactaccagtattgactagcagcccctgccagtctctcattcttgccaaaaagtcaccaaagcccttagtcctcccaagtctgatgtccagctctcagcagccctctcccttggccttgttgtagcatttaattcagtggatcaccccccatctgctagactcctttcttcccttgggttccagacacttcttcttcctggtttgcttctagctcactggcccccgatcaccctgctggttcccccacctcctgtcctccaggtatggcaagctcagacctcggcagctgcctgtctctccagtctccccctcggtactttccttccgaccatggattttaacattatctagatactgatgactcccaaagtgacatctccaagccctacacttccccaggggtgtttcacaggcatctccaactttccaaattcaaaactgaactcctaagttttcccctccaggcctgttcttccttcgggcttccccagcggagtaaaggacaccatcacattatccagttgctcaagccaaaaaaataaggcaaatctttggctcctcttttcctcacgccccatgcctgatccttcttaccccacctgcagaacgtatgtctgcatctgccggcttctcccttctcatctccttggctgatactaactgactccattcacgagcagcttttccccactgcctccaccctacacagcagccagaatgaaggatttgaggttgaaataagactgcagccctccagtgctgaaagccctccaatagcttagcctttttttctgtgtttcttctaaaaaaaagcaaaaacaaaaaaaaacccaaacaaacaaaacgggatacacgtgcagaacgtgcaggtttgttacataggtatacatatgccatggtggtttgttacagaggtgcgcgtgtgccacggtggcgtgttgcacaggtatgcgtgtgccatggtggtttgctgcacctgttgattcgtcctctaagttccctcccctcaacgcttagtcttatacttcagcataaaatccaatgttctttccaccgcctgcctctctgtccccttccccagacccctcaccccctctgctccaaccaaactggcttccctgctgctccttccactctccaagcaggttcccaccccaggggagctgcgcttggggtctcctgcctggaaggcttcttggatctgatgtgctccttcccaccaccgaggtatctgctcaaggatagcagctcagaggggcctcccttgactcccgaatctaaaacaacacccccatcccataaggcactatctgtcccccagctcttgtttcccagagcacttgtcatctgaaatgaaaatgtctcttttgtttgtttatggccttccccacgaaaatgcaaactcgaagataggaaatttgtgtgtccagttccctgtggaatctcccggaccgacactggctggcatctggcatgcagatggcgcgaggtaaggctctgttgaatgggtgagttggtgaagggatgggtgtgctgagggtgggggcatctccttcagccccgttcctggacgtgaggctttggctgtctggcctgtgggggagcccagagcccagttctctctccccctggttttctctccccattgcccgcaccttgagttaaagctggtgtcctctcctctcttccccacccccaccccgacccctgtttccagttggaatggccttgcccaccgggagtgagcccagagcagcacactccgggaaagcttggggacctctagagggctcgttaggattcctctgctgcccgccgtcctcccactcccgcacccctagcaggggctaaactctcctaggcttcctggccacctgcagaaagccttctgggctgttgggcacctgcaccgctgaagccccggcctgtgctgcgtgtctggcatgtttggtcacagtgctgaggggctcagtcaggggtgccagagagcactgcgcggggtccagcctaggtgggaggggctgaagcccagctgacccccccacgcgccaccctgtgcacccagggtgcagccaatgactcccaagggaccgcaggcttccttctgagccccgcagacactgcgcaggagcagcaggctgggatccgctataggctgccatgtgccattgtggaggaatcacttcctcatccaggcctcagtcatcttgctacttaaaaaacatagatggcaagggctaggggcaaggggcttattttatttccaaagtctctaaagtctctgcattaagcaaccccaaggtctccggcccagcacgcttaaccatctcccgtgagcggcctgactcccctgccacaagggtaaacccatcaaccacagcagagatcaatcccaggtccttctggtgctaattagaaagaaagctggctcccagagagctgcatctcttccccattcccagacagaggaggtaatgaatgattcatggcaggaggatgggcggcatccctgcaggtcttggtcaccggcttccagcaggtgctgcgcctcctgcacccacttcctgactctggctcccagaaacagatgagctctgattgactggcagtactagaatttatcaacggcttgttctctctggaaccagctttcattgatcaaatctgtttctagccctctgttcctgagaattcccacagggaccaagattcacttgtgctgtcctgtggataaaaataaaaacatcccccagtccacatgacttcactttttgccattccttctctccagcaaacatccccaccatgccacctaagcagggaagagaaggcgagatattacctaggtctttccgcactctagaatttgatgattttaacatgtgtatacggagttttcagccatgcacaaacatgctttctggagggaacatgggaaaatgcaaagaactgctgaaccaatgggctacaaagacagaactggagtggatgtttttccttctttatatttcctctaacattatgtgataacactgttttgtgcgaaataaaatatggtaggaatgctgggtggggaatcaaagggtgaaagttccaagcatgcactgtcatggttgctggcaggtgtcattgcgggtggttaaatgaagtcagaggtttgagagaattgcatgcaaggggagccatatccccctccctcttctggacatggccattgttccaaagcaagccacatctgggcagcaagtgttgagcaggaccagaggtgaaaagagagagcgcacagtaagtttgtcctaactactaaccttcctctgatgaccaccagaagctgcaaggcctgaagcctgactcaaggactatgtgccctgtacaagaaatctgtccatgtaccggtgttcaagttgcacactgcccaaatatgcaatgtcctggggaggggtgccatttacgttgtagatcaacttatctgagagtgcatgggtgggcacagagtcctgcagtagcagtgaagagctacataaatccacctggcaatgttataagcacacacgcatgcctgcctcatagggccctatcccagccatgctccgggagggacctgcagtcacttctccttcctgccagccctttaggaaacccaattcctgcccccattgagggaacaacccagaacagttgcctattcttgctggtgggtgggaaggaggaaggaagtgtgggtggacggggtgtgatattgctggtgtgggtgagggtccgagggcgggggctgccagggtggtgctcactggggccctgggagctcctgggaggaggagggccagcccacctcatacaggtgtccaggtcacactaaggtgagccacccaaggaagaggccctttcctaattcatgcaaaggccctgtgggctagtggaagcctgggctcaggccaatcctgtcttctctgcaggaggggaatgtcaaaacacagccagagggggctgtagacaagcagatggccacacccagaggctttgcttggatgtttgtgggaggaggtattaaataaaaaattattcccgacacttattaaaatggtaaggctgactttattcagggggactgccacccaagtatagggactactaccctggagttttccaggaagtgagagagattgggctcaactctgatgacaacaaagaaagtagagattcacagcccagaagcagcgtggggtggatgaaaggatatcactaagaggaaacatggaggctgcaggcaggccaaggcaataagatccctagggtgggggaggaggcatctgatcagatatcaagggtgggggattttcactaaaatcctgacccagcaggattcttgctaaaactggagtaagcaggccaaggccagagcccaaggtcggggccttgagggctcaggggagcctgcctagaggcaggtcaaggggtgtctttgaggaggctcctgggtctaggagagccacaggcctccctcagccctgcagggagcggcatggggttccgcccgccccgcctcacagcacagcagcccctctgggaagtctggccgctgcccccaaatccacgtcccaggacagctctgtctgacaaataacaggtttggagctggaggtgactgcatggacgggggcctcctggattcacctaggactttgcttgcacagggcacatgggctttccagaatgacctgcacagcctcgtggtgacctcccctggtagaggcagcacagcgggccccgaagtccactgcacagggaggaaagccatgggtcgggggtgggcaagaaggcctgggctggggaacctggatcacagttctggtcacacaacctcctcgtaaaacctgatttccttcatacccccgctccatacactttgtgttccaggcaaactaatttcaagtagcaacaacaggaagcctgtctgaaggccccctccccctgcttccgggcctgtgcagcccttgggtctcgattcaggattcctctcccgccccacttctcaccggcgccccctgctggatgccccataggaggccgtggacgacgtcccgactcctcctggacccagtgctgctggggctggggagcttcctcctctaggagcgctagatgagagaggcttccggaggcgtcctgctgcgctccccagactgggaggcagaagcaaaatgagcctgattactattcccaggggattgctgcctgctttttatttatgcgtttactgggaagctctttatttacattgctgtaatttacatttcccacaagtgccttcctttcccatctccttcccttctccacattgctaaacgtgggttccccagttgctccagaacgccggcagcgcacaggctcttctgagaactcctgggtaaacatcccctgtgttcacccggaaagtgtcaaaagggtgggcagacatttctgtgcacatggcaggctcttggcacttggtttggagatgttcatctaccccaaatgcaactcctcaaagagcaccacccccataaaggcacctctggctgtctgaccccagcttccccggaactggggaagggcaggtcactggggccactgcgttctggaagctgagtggtctacagaggcagccacacaagtgcagcaattaatgtcaccattgatttaggtgaagtctgaagggtgctcataccctgtgtgaccccactaccttttcttcaatgggagagggagcctgagcccttttccatgtcttgcagtcttgggtgcatctgccttcctgctcctcccgtctgctcaggctccagccaggggatcagctgggaggatgcagctctcttggcccctttcaggcctctagtctcacccttcaggtctctagtctcacttctcccagtccaggctaagaaacccacaggcaaggtggattctacccccacgttggtgcccaccagcccacgtctgacgccttgtccttggctgcctgtccaatctgcgtacaaggtgcagccatgtcaccatcttgaagcacagcccaaatcacatccttactcaaaagccgttcttgatgccccgacccaatcgaagcacaaaacattttcctatgactctccctctcttcatggatcctatttgtcacccaaactaaagaataaggaataacatcaattactctataaggagcccccctactccacactgcctgctttatgtgtctttgtcacacttgtcactgtctaactcactagataccttatttatttctggtattctctgtctccctcccccactagaatgtaagcttgcatgagagggctttttgtctgttttgttcactgctttgaaacaaacagggcctgacacaaaggagaggctcaaaaaccacctttcgaatgaatgaatgaacaaatggacgagaagtgacatttgtccagtagtcccagtgttctgcccttgtcaagtgcatcgtcgtggctcatcctcacgacaacacgctgaggtaagtgttttgccctcatttcacacatgtgaggcattcccatgagttcccacggtcacagaggctgggcgggtgtagttttgttcagcaggagtccctgtgttgggtggaatgaaggaaggacccaggctccattggcgactgtgtccaagcttggtctgacgtcaccatctgttcctgtcctcaccttcaatgcccacctgtcaaacctcacctcctccacaatgctcttcctgactccttcagtggggccttgggcctttttttaaccttttattacattcatacctacctcttactactaaatgaggagttcctgaggacacaatgcacagacatgaatcacagcgctgagcacctgccgcatctgacagacattgaaggtgtaatgagtgcttgttaaatgaaggaagagaaagaaaatagcttgaaaatcattgtgtctgtgtcttgtcatatgtctgtggcacatgtgttgcctttaactctaaatgaccaccttcatccccaacttattttagtcccaggatctattctagaatattcgaggactaaatatcggactgggtctcccccatttgagttgtgttctgccagcacccagcgtgacccatgtgggaggcggtggtatctttaagtcggaatgggtgaatttttaagtagggagggagagtgaatctcctgcaacattttttttctcattttgaaaggaatgtaattgtggaagacagtgtggcgattcctcaaggatctagtaccagaaatgccatttgacccagcaatcccattactgggtatatacccaaaggattataaatcattctactataaagacacatgcacacgtatgtttattgcagcactatttacaatagcaaaggctatttgctacgtaaatgaaccaacccaaatgcccatcagtgatagactggataaagaaaatgtggcacatatataccatggaatactatgcagccataaaaaaggatgaattcatgtcctttgcaggaacatgaatgaagctggaagccatcattctcagcaaactaacacaggaacagaaaaccaaacaccacatgttctcactcataagtgggagctgaacaatgagaacagatggacaccgggaggggaacatcacacaccggagcctgtcgtgggctggggtcaagtcgagggagagcattaggacaaacacctaatgcatgcggggcttgaaacctagatggcgggttgataggtgcaacaaaccaccacggcacatgtatacctatgtaacaaacctgcatgttctgcacatgtatcccagaacttagtaaaatttttaaaaaaagaaaggaatgtatagtcactgtgggatatttagaaaacgcgaaggtgtacagaagaaaacacaaatgcacattgttcttaatctgtacaacttcgcagccaggtgggtgggattatccccgctttacagaacaggaaactgaagctcagaaagttgaaatagcggcccaagcccttgggccagaaagcggggcaggaccaggctctcacccacctgtgcctgaatccaatcccaggcctcctatccagaccaagagcttttcaggcccagcatcccagagcctgcatccacggcgtggcggccagggtttcgagggctcccgcggtttgggcgctctgcccctgcgctccccaagctgcgaccccctgcgctggccagcgtcgtgtaggccgggcccagcgcggtcctggcgcctcagaaatctttgttgagcgaatgaatgaaggaacgaatgacggaagtaaaaggtatgagcgccccggagactctggcttgcgttttccctctccagcccccagcgaactggagccgggctggcgcccgaagggagtccccggccgagggcagcgctcagctccgcgtccccgcgccggcgccgagaaggaggccccgcccgacaggcagctgcggagccatctgctgcgcgggcggcgccgctccagtgtttgtttacaacccggcccggcgagcgacaagagctcggctcctcttccaggcgcgcggcggtgccagtggaggaggagcagggcgctgggggcgcggggggcgcggggcggggcgggacaggtgcggggggcgcggggcgggacaggtgcggcgggcgcggggcgggacaggcgcgtctctgttccccggctccccggcccgcgccccccggaccccgccccgcggctccctctcacccgctgtaaccccctgcgcgaccccgctggagcgcggtccacggggacaagagcatttccaggatccaggagtgttcaggatgaagggaggtggcgcgcagggtggcacctaaaaaacaacgctcctgcagtgtccctgaaggtgacaggatgggtgttaggcatttcacaaaatctctaagtccaatagctcgcccaactcaggggattccccttcttgacagtggccagatacaggcaataaggtctggtttaaaattcattccagggagtaataattccattcttttaaagcattctgatgtaagtgcacttctggtgttaccatttttacctccactccccacagcagccacaagctcagggttggatcagagcttggggagggtggcaggcggagataaagagaaccccaagttctgggcttaggggtgctagcaggtaaaaggaagtgacatctggacagtgactaatagccagactttggtgagacagctagtgtggggaggagacagccagcagcagggctttcccttcctcccgcctccctgcctccatgcctccacgcctccacctctccaggcctccccgcatccagcctgcactgcagaccttccctagaccatgctaaacctagagcccctgcctcctccgcagccccgcagtgccttgatggcgccacccgccgggaactaggggtgctccctgtactcccagggggacagttgtgggagaccctgacctgatcctcggatgcccagggactcgtttctacatgattattggtctgtttgggtttttctcctgcatacaagggactaagaggttacaaagtcctgacaaagaggaggttacacttcccgtacacaaaggagctcgcagtctagaaggggaagacagggaagacaaagtggacaggaatcaccgctattcaatgcctgcctactaggcgccaaatgctgagtttggtgtttctctggcaattcatccaataaatacttattacatcctgccctgcactgggctctgtggatgcagcagagaacaagtctcgtagatgaggagagacaaaataattccagtgatagcaagtgtgccataagggaaatacctcttttgatcctgatacaaaccctgatgaagggtaaatattcttatcccctatccccattttacagataatggctcaacaaggagaaacaacttgcccaacatctccaaggctgggtttggagccaggtctaaagcctgtattctgaagccaacgtctacctagggctgagggttggagatggcccgtctgccagctctggatgaaacagctgggacacagcaccatgaatggcaaaggttccttgctggggctaaagcagaatagatgtccacttggagagtgctgttttcaaaattctgaatcggctgggtgtggtggctcacacctgtaatcttggcactttgggaggcccaggtgagaggattgcttgagccccaggagtttgagcccagcctgggcaacatggcaaaaccccatctctacaaaaagatacaaaaattagccaggcgtgatggtgtgcacctgtagtcccagctactgtggaggctgaggtgggaggatcacctgaacctggggaggctgaggatgcagtgagttgtgatcatgccactgcatgccagtcagggtgacagagtgagaccctgtctcaaaaaaaaaaaaaaatttctgaaccagtaaaaatgggaacagacactgtgactaaaagccaccatctgacaatcccatgttgcagaagcacaggcctgtctgggtgagtgtctccctcatgcacatccgttcattcattcattcattcattcattcaacatgccctgaaagaccaccctggcctggtgggagggcatgtcctgggggctgtgaaagtacagaggaaagagaattaaacatccattcccctcttccaggagcagaagcccaggacgaggccagcccattaaacccacttggcccaaagaatgagaagaaggaagggggctgggctgaagaagaggcaggagggcagccatcggtgatggggcgaggacatcactggaggctgttaaaatgagtctgtgtgcttgggtcaggcaaggacgcggccagcatcagctgctgctgctcttagcttccctgcctgtgtccctcggctggccctgctcctccctccaaagagaaggcaagaattctaacagggtgaaaccaggacagtgactggctcatacatccaggggaaaatcatctgaaagcactgcattccatgggacagacaggatgggaaaaccaggatgctcagagaaaccagacctgacagcagacagcaaataatatcccatctggaagtatgacaggacaagaggagaagctgcacacatcggcccatcctgccctgggatagtccgtgcccaggcgctgggggaagtggaccacagagagcaacacaaactatcacatgccaagaggcctgggagccaaggccagagagtggggaggagctgcaggcttctcaaaagacccagggggccaactgtgacatatgatctgtaagccgaatatttataaatggaatcagatctcctcctaggttgatgcctttatttgtatgttccttcatttagccccaactctccttatctccctagtaagatcttataaatcaaatgcacacacaccaatacatccagctccatgaggtcaggaggtatttcattatcaccatctctcctctacctgcccgatccagcaaagacccaggcaaaacaggggctgattggctgattaaatgcactagcaagggagagcttctagttaaaacaatttatctagatcttttaaaagcaaagaatcccacaatagtaaacataattactctttaatgtgatctggtttttagttagagtttcatctattttatggaacaaactctttttttaaatactgtgacataaacagctacgtacttacagaaattgttctctcttttccctgggcacagagccagccccacctcccagcctcctcggcaatcagcgtggccgtgcgcctgagttctagccaatgggaggtgagtggaagtgggtgtcccttccagacgtcgtactgaaattcccccacaggtaattctctattctctttcttcatgcattggctagaagtgaaggactccagagcccctggagatggaggatggaggagcctgggttcttgaatcctcacatggaatgccagccacaaattggcatttggactcctatatggacaaggaataaatttaaatcctattaaggctgggtgcagtggctcatggctgtaatcctactgccatagaagaccaaagcaggaagatcacttgaggccaggagttcaaaaccagcctggacaacataagtgagaccccgtctctacctaaataaataaataaataaataaggtaacataaaataagattagcttgtcttcagagggacagaactaataaagaaaaacaaatcaaagttaaaaaaatgtaaagaaagaacaaaaagtaaaaaaaaaaaaatcccacaaaacaaaattagccaggtgtggtggtgtgaacctgtagtcctagctacttgggaggctgaggtgggaggatcacttgcatccaggagttggaggctgcactgagctacgatctcaccatctcacctctgcattattcctccccagctccccaggtgacagagcaaggccctgtctcaaaaaaaaaaaaaaaaagtcctattacgctactgagattatgttatggcattgatctattattacagcacccagcattagtccagcacaaacatgtatatgcaaaacatggctggcaagcctggcttgggtaggggaggtaccagtaagggttaaattttaatatatggggagaggccgatgccaggaacatccacggagatgaggagttctaagaattcctgatacgcttggctcagtaacattttttggaatccccccattctctttcccacctgcaacttgcacctggccacagatactctccatttgctgttcgtcaaatctccccatagaggctactcgacactgggatttaactgatggccccagaatgcatctctttctctttgaactttttcctcaagctaataatttccctcaatcttctgaacttgccatcgggtctgacaaaaagcttactgagtgccttgttccgcctctatttcatacaaccttccgaagttctcttctatatcaacatccatcagtccttccctttctactgcgtttgggttctctctctttcatgtatcacttcctcgtgttgctttcctgcgtcctacagtctcactctgctctgccccatttcctgtttctttcccaataaatggtttcatctttcatgcatttcctcccttcccagtgctccaaacacaaccccacttattttctgagacacactccctccccattaatctttcagctaggaaagagaggctaaagctttcctttccattcctgtccatctctgcctcagttaattagagccttgtgaaaaacaaactaaaactgtttaaccagctgtttcatcctgactcttctacccctcgtggtcatgggccatcatctgatcacatagttcctaatccgttatcgtgccaagagggaagaaagccccaacatcttaaaagaaaggaagcagaataatttatagaaagaaataaagtgcttagtcaaaagcataccgcaagaattgtcactgacttgttctcagcttttccctcattaaacttttcattttctgccatctgtcaaatataaatcaacttctgtcaagtttcctcagacatttcagatacttgcatactctattctttcattctcttttccctccaggcatttataattcttccacttccgaaaagaattgtaatcgttcacaacagaaggcacacaaataataaaaataacttgtaacgtgaaagaatgtgagccactgtaggaaatggcaaggtccatgaatctatgtatcccaggttaaggatacttattgtcactgggcacaaaatggaaccctgagctaagtgcaaatagtgttaaagacaaagcaaaaaggaaaacagaagaagtgacaaaaacctcaatggttaaaactagaaagcatactgtacttgtctatactctttgttactcttgtagaaagtctttgaactactttaaaaatatttctttacatcctgcctatttgctaaaaggatatgacacagcataaaatttaaaaaaatcattattgtaaaaataaagacaagacatgctaaatgggatatgtgtgtggaaggaagactgactataactttcttttaaaaggctagactcatggtaatgaacacaatggagtacatactttagctctgagctccccggcacccatggcaaagaaggaaacacaggattatagagctgaattttttctaaccacagttacaagatagtcacttcgtaactatgaaccatgagaggaagttgtcttatggatcttgtcagttcccttattctttagaaaaactctccaggggttctatcatgtaatcttcaaaatccttggccagctccaccattcggtggcttcgtcatatgacccagctctctgcctgcactgaggacattactttatccttggatgcaacgtttcccaggcatttaggttctgtggccgtgatgagcgtcatatcagccacaccaactgcagtctcatctacttatttttttttctttcactctatttgcatttttacttaatacgtttttttttttatcctgggaaatccctgctttgggagacagcctcgagaaggttagtattctttcctggcttgcgaacaacttactccttcctctcattccacgtgaactccatctttccctccaagccgggctaaagtccggtctcttccggagcctttcctgataactcagcctgggaactggaatatcctccgctgagcccagggctggctcctgccttcctactacacagcagctgtcctcaaataggcagtggcgtttttccctagcaactgagcacgtcgtaggtgccccataaacatggcaatgtggcagggctaagcaatggatgtgtgcccacagtacctgggttcctgggtaagtcactcttcaagcttcagtttagccagctataaaatggcaaaggggttggggaagagggggctctgcattctctgaagtccctgccatcttgaagccccgccttctttggcatcccccaaatgcaccctgactttggcgttttccgttgcttcagttttccttccagggaattgcacccatgggttctttagcaatcagcagcccttcttatctctaaaacagccctccctgtggcttgcctctgcccaagggaggcacattccaaagtcctggacaaccttctcaccccctctctcctgtcaaactgatctggtctctgcctgttcgaaacagactatttttagccttcatttctgtctgctcaatttttctgcctcccaccatttctattgcatcttcaggaatacactgacatttctgtccctggtgaaacattgtctgttcttgattttggacataagccaccaagtcctggactgtacagtgacagagctgctccattctagttgtggttctgcctcctggcaggctctgcacctttgtggatgtggcttaaccactctgagccttggttttcacatttatccaatagagacgtcacccgcccaggctgactcaaagtcagcaatcaatcaagacagccccagtcccacagtctgcttgaccagctcacgaggccagtcctgaggaaagcttttcctccaaagcacgtggacagcactttagagtttacaaatcacattctcatacactgttctttgaggcattacaatcattgtggccattttctagatgaggcagctgaggctcaagcagctcaccgaagacgtacatccaggtcttcaaaaaccagaccttactctccccacctgcaacaggctgggggaacagtcgagaggcccacctgagctacgggtgtctgcacacagtggtccccggaacccacactcccatcccccagcactgagggatatgtgggccgttgtcacctcaccacaagggctcgctcccactgcatcgtgcgagatgggtctgcagaggtgcatgtggaagcttcatgggggtggtgctgtgaagaggcagaaacaagacctgagggcaggatgagtgaggcgacagggctgtgcgacactgcttcatcttgcctgtaagctgtgtcttagggagcagacagtttcggagagacgtcacccaggctggtggggaggggagaatgtctgacgcgggcatctgagtcattctgactgaggaggaggaggcggctctgactctcccagcaggggcaagggcaagagcctggggcggcagcttgaggtcctaaaataaacctgcacatttggcttgagcttgcatcctctgtggattcccttgcctcccggacacctggagcagccactgtggcagcctgggcagagccccccacccgggtgatctcaacccaggcacttctcctcgaagcatcagagtcccatttgaacatcaaaagggttgaactggaccatccctgagggctttttgagccttaacgttctaggattctaaattagtaaaatattttggtggttattgactatgtctcacagtgaaacattatttatcttagacatgggccaagcgataatagacatttcttgaaaggtaaagattctccaggagaaaaatccacccacagtgctgattctcttcctgttaccagctgaggggagttgagacaggtggttggtgtgtgcccacacacagtttcctcttctttccgggccccctccccaaactccctgaagctggatgtggccacatggcaggtccagagaatggggagaggagtctctgccacttccaagagcaggcgtttcagaggtggatgtgcctcccactttttgccccatctaccagctggaacacaggactgctctggggttgcaccactgagcctgggggtctccccatgactgcagccgcgcccatgctcactgggtaatgctgtgacaggatgccctcatcggtctgcatagtgagtgaatgtggggtggttgctgttgctcgtccacctctcctgctagattctgagctccctggggttcagggtcacatttgacttttcctcctgtctccagggccggcctcagcacctgactcaatagtggtgtgttgatttagggaaaaactcaccttcaacagcctctcccagcccatctgctctttgtggccctagagttggagactgagtgcccagtggctgtcctcgccctcccagggcccctcccagctccatcatctcagaccgtcggagataagggggccttggtgaccacctcctctagaggcagcctgggggcggctatggtcatcttgatgactgagtaagggcatccctgggatacggtgggtggggggctgggcaggctgaacatctctcagtgagcaatggtcccctccatgaaggactgtcctgcccaaatgccattagtgtcctgacacagatgtttgggaccctgacaattcttgagccatttcccatttttttcttgccctgttttccctgccatctactaaaatcccttcttttccctgcctgctgctccgtgcctgcacaatgctttctcctccctgtctcttctgcagaaagctactgcttcaggcagcctgggatggcatctcggcaggtcctggtgcccacacagctgtgtggacatgggcagcgtgggtttctcctctgcacacagcctgcccaccttgcctttcaccagagagaggcttcccaggaacacaggctcctacaggagctgcagccaacccagccagctggacactgatggtgtgacacccacatgggctcccaccagcgaacagcccacccctggccaaggtgggccctgccccctcggtgcctgctaaactggtcataactgatttcttccttcagaaaggcacccgtcaggaagaatctcctcccttgatccgaatccactcctgcacctacattctcccatctgcccctccccaggctgctccttttcaatggggcacttctcccactgctccatggccagcccaacctcggggtcctgattgtggctaacttacaagagtgattaccgggccttccatgttttcccttcccccagtcttgccccatcagcagagctgagaccgataccacaatcactgccatcaagtggggcggctcagcccagaaacatggccctaggatcctccttaatgggataaagagtagaggccccactgtctttgataaggcaggcaggttccactctccaacctgaaaagatatgccaaaaaaaaaaaaaatctacatttggagggaccgactctggccttctgcctcccagaagccctggggttctttctcagtctgaagcagaagcagcccccctggtccatcccccaccagaggatgccagctctcccggtctcccctgactccacccacagtatctctcccgcaaggccctccctggagcctggccagagcctgtgttgccacacctcggggtcatacaggcttcagctcacatggctgtgccccctgtctgctctcctcctccacttcctctgatgaccctcatgatgggtcatgtaagaggcatacccctaaccccaactgccatcttcccctgcccccaagctgagcataaaagaaagcaccctagagtgccatcagcccactgacatttccagaagagggctccagagaggatcaataagcaaacagaataaagagggagaggggaacataggtgcaagagagttcaggggtcagtaaagatttctttactgcagagcctccagagccttcagtgcactactgtgcaactggatttccaagaaggggatgtagcatgcggcgtggcccagactcactgacaggctaagctttgtgacaggagagcttctaggaaaacatcagagaaaaactatcggagtcaaccttgggtattttaatgttctcaggagggccttgatattgacccaaggattagtcaatagaggccaggctgcctcatgacttccgcccttctgcaggcatttcccaagcagtgtttcctaaagggatcttctgaagttgagccatgaattaagcagaactcttccttcccctggccccacagttttggcttctgggttctggacatgggagtcctgacaacacagatgtgtgagaaatacaaagaagaccctcagggcagtgctggaggacaagagtctttcatctagggtccccgtagtctccaggactgtcactactcatgtatttgccctgcgtcttggtttatgtttttgtagaacatggatgttattcatccacgcctcatcaatccctgctgagaggtttaggtaaaagagagaagctgggtttgtagcagtacacttcactgaaaaaaatatttcctcagtgactctaaaggaacatttttgctagatttcacatatgtagtcaagaaccagaaactttgagggtttaggacctatttttgggtaggaggagaagatcagaaaggggcaatttggggtggtggtggttaaaaagcaaagcaaaataaagaaacacaaaaccaggtaatgagtgagcaggctctccccaaagctagtctttaggctggttccatcctgaaatatgccagtgcctcactagtagatcccaatgggcaaaacagcaggaggtcaaatgggataaaaatgtgaatgtaatgattcctcacatttacatagcacttcacagtttataaaacacttatacagatgattccatttgaacttcataaaatccttacataggaggcaaagtagaaaaggcttcctaatttagagatcgtgaatcaataattaggtgacttgcccaagatctcccagcttactggaaaaccaaggatcaagacggaagccttctgccttcctgcccgctgcccctcattcctcctgctgaacccaccagaccaagagtacatggcaggtaagaatatcaaggaatgaatgaacaaatcaaccaacccatcactggggcgctatcccaagaagctacatagtcactggcacacagtgggtacggctgtggtgacacagagggttggccatctcctcctggccagttcatctcattcactggaacagggtcgtgaacaaagcaaatgtttgttaatggatactcatatcacattctcaaagctggaccctgggtgggcaaagcagtgaggtggtgtgaggtctcagcccaggcacagcttcctcacgggtgtgtggtcattgctcagcatttagggccctggaggtactgaagaaaaaaatttcttttcagatgaagttttgctattgttgtccaggctggagtgcaatggcatgatctcggctcactgcaacctccacctcctgggttcaagggactctcgtgcctcagcctcccaagtagctaggattacaggcacgcgccaccatgcctgtctagttttttgtattttcagtagagacagggtttcatacaacctcattttacacctttaagtctatgagccccgagtccatgagccccgagtccatgagccccgagtctatgagccccgagtccatgagccccgagtctatgagccccgagtccatgagccccgagtccatgagccccgagtccatgagccccgagtctatcagccccgagtccatgggccccgagtccatgagccccgagtccatgagccccgagtctatgagccccgaggccatgagcccggagtctatgagccccgagtctatgagccccaagtctatgttgtttgttatgatggtcttagcaaatgaatacgaggcccaaggtcaggctgggacccaagaaggtgatttaaggtggcccagcaccctctccccactgggcaataacccaagtgaaagtcctctctgttcacatcacagggaatcactcttcctttcctaatactgtgtcctctgaatatatgcactacaccaagaaaatcagatcatatatagacctccaaagagctcgaagtccagaataatatacaaacacacagccaagataaatacatagaaaacacccaattttttttaacacaatgtgtccaaaagccagtgtgtgggttgactgtttcccagaggagcaagctctctgtggtgaccgcatctctagctaaccctctggcacccaacagtcaacccacatcagtgatgagaaatcacctgtacagccaataccgtcctctcagctccaccccctctctgttttgataaggtctgctggagagacagcagggctccaccccctctctgttttggtaaggtctgctggagaggcagcagggctccaccccctctctgttttggtaaggtctgctggagaggcagcagggctccaccccctctctgttttggtaaggtctgctggagaggcagcagggctccaccccctctctgttttggtaaggtctgctggagagacagcagggctccaccccctctctgttttggtaaggtctgttggagaggcagcagagctcctctcaacaaccacattgcacaaggaaatgtgcaggcttacagaaagttatgagacttgcccaaggtcatgcatcttgcactgatgaagccaaaagtccacacgtctcatgttgagtggagagagaagggagagaactccatgcccctgggactctgggtagagaaggtgggggccacccctgccaggcaacaacacatgggtcagggtgggggtacactggtggtcagagggcaaaacaggtgtggccagagtgtctgaactgtgcctgaggctgcctgccaaagttgcccccacatgctaggccaggcaaggtagctcaagcctataatcccagcactttggagaccaaggcgggtggatcacttgaggtcaggggtttgagaccagcctggccaacatggtgaaaccccatctctactaaaaatacaaaaattagccgggcgtggtggcgggtgcctgtaatcccagctactaatgaggctgaggcaggagaattgcttcaacctgggaggcggagggtgcagtgagccaagatcgcgcctctgtactccagcctcagcgacagagcgagactccatctcaaaaacaaacaaaaagttgcccccacatgctaaaggaccctgtgattagcacatttcagacttagggtcctgtctatcttttcctgagaaaggcaatcattcattagcttgtctgattgatatcgtcacctttcccaaaatccgagtccctgtggaatccatgtgtccttttatgagttgagtattgggatccctcctgatgcataataattaagggctttgatgaactctggagaccgcacttaagcaaacactggcagagggtcacctatgtgctaggaactacattgggtctttgggggtcagtttatttcagagatgcatcctgcctccaaagacctcacagtctttggaggagaagaagacctgtatatgaaggactggcatacaaggcagagtgagacatgcctaaggtgtcaacagtcctgggacaatgccccaaacctggacactctggtaataacattccctgttcctttgaaacagcccagatttagtctttcgctgtaacatatgcactgatcaatactgaagatgaattaaactgatgaaaatcaatcccaaagccagttttcctttccagaccaaaacttttcatcaataatagagaattaaaagatgtcactaaatcctgatacctgcactgcacgtagttcaatcacaggttgtgaaaatggattaagaagtaggaagccttgccaagaagcttgttctgctggcctttggcagacagagaggggccagtgagaaacaaacagacagacagggacccattccagaataaagcgaaagcccttgaggccgactattcaatctgggcaggtgacccagggcttccctacccactcagtgggctgggagtccaggcagtggaatccagaatgctgccaggaaatgagccagacacacagagaacacccagcagtctgttcggctggtttgaagaagagaattgaaaaaagaaaaaaaagcagagagagagatttgggggacatcacagaagactaggaattggagactttcagttgctgaaggcttttgagcagaaagctaagatcttcaaagacgcagctttgagcctattcttagagcaacagggaatctgagtatttctccgaggttcacggccccagcgatggggctgctctgtctgctccagcaggagcagaaaggaaggagccaggccacagggaactgcagaagctgcgctccctctgtctagtgtgccgtttcccggccttgggtctcctctgtcttaggagcccccacatggccccatggccactgccaggtcactgtggtaagtgttgagttagtgacactgacgatgcaccagcaagatccagcctgcaagactgcccagccctgcccagagctgatggaggctctggcctcatgtttcattcatttattcaatcaatcatttcctgggcactggccagataccagacactatgccgaatgtggcaatgaagaaagaaatgaaggtgattatggaggtccatccctcaagcatttgtctagtaggggagtccttcattccatcaacaaacattctctgagcacttggtatgtaccagagcaaacccaggcactggagacatcacccctgccccaggaagcacacagtccaaggtgggagagaggcagagagacggcgaagtggaatgtgctaccagtgaggtgggcccaggtgctttggggttccaaagtagaggctgcacaccagacctctgtgataggatcacaaactgtcgctgaatgaagttctcatgctggagcatctgtgggcagctgccctctgggagcaggatgagcaaaacagcactgagacccaggatgagggaagcagagtggcagagccctgggaaaagctgctctagggcagtggaaaactctgcagtgtccccatggggcagcagaccagaccaggacgcagagcagagcctggggagaggagaggctctgaatggcccacaggacttggctggtggcaccctccctggaggctggggcactagtacaggtggggagggaagaggatgctgcccccgccctgcagaggctcccataaggagcccatcatgtggggagcacaggaaccctgccatggcttgaactctggggaaaaaaagggtggttgtctacaaggcgccacagtccctcagtgagaaatctgagcctagtccccttgattggtcttactccggaagtaagcagatggggcaccgacaaagagcctggactttgctcactctgccctccgagcaatccctttactatgtccaagtcagtctctcttctgccaatgaagctccttccagggttaggggttgaggaaactgttcccagaaacacccggtaggtgcttgattcctcttggcaaaagctgactcttcccagcccaggttgatgacaggaaagactatcatgacccctaccctaagcacaaagcacttccagccacattcacaactcaatcctcacagcaatctggcaggtggatggagtagatactactgttctcaatttactgattcaaaaaagtaacttggccaggctcggtagctcacatctgtaatcccagcactttgggaggctgaggtgggtggatcatgaggtcatgagtttgagaccagcctggctaaccccgcctctactaaaaatacaaaaattagctgggtgtggtggtgagcacctgtagtcccagctattcgtgaggctgaggcaggagaatcacttgaacctggggggcagaggttgcagtgagctgagatcacaccattgcactccagcctgggcaacatagcgagactctgtccccccgacccaaaaaaaacgtaacttgatcttgaggagatatttgtactctgtgctcacagcagcatgattctcaatagccaaaagatggaagcagccccagcgtcacttgacacatgaatggagaaacccaacatggtccatccatccactggaatattattcagccataaaaaggaaggaaattctggcacacactacaacacgggcgaacctcgatgatagtatgctgaaagaaatgagcccgtcacaaaatgacaaatactatatgatgcttcttatatgaggtccatagaggagtcagattcatagaggcagatagtagaatggggttgccaggggctgagggaaaggggaatggggaggtgctgtttaatgggtgtggatttttagttttacacagcgataaagttctggagtggatggtggtgatggttgcacaacaaggtgaatgttcttaacacaactcaaccatacacttaaaattggttaggattgtagattttatattatgcatattttaccatattttacgatcgtgacttgaatccatatttcctgcctgttgggtcccagcctgacccttaccccatcagcagaggagcagtgacgccatgaggcactagaagaacccaaggcctggagtcaggccagggactaggtgagagtctcgtgagctgtgcgacctcagcctccttcatctctctaaatttcaattttctaacctataaattgatgccaatacctaataatgacacagtagcaaagcgcccccagcacagggcaggccccgaagaaagccacagaggacagtaaggaagggtccagctgagtccagccaggatccggggcctcagccagcgcaggcagcgatggcagcctccttggagtggcctggccaactctgggcccgcagaggacaggcagtcccgtgcccactgctaccttgaatcccaaggacaagaaagttcaggcctttacaagtaatagtttgattccttcgtccattcaaagcatggagagctggctgagcgcggtggctcatgcgtgtaatcccagcactttggaggctgaggcatgaggattgcttgagcccaggtgtttgagacaagcctaggaagcacagtgagaccccatctctacaaaaaaattaaaattagctgggcatggtggcacatgcctgtagtcccaagctactcaagaggctgaggcagaaggatcacttgagcctcaggagtttgaggctacagtgagccatgatcacaccactgccctccagcctgggcaacagagcaagactctgtctctaagaaaaaccacaagcataaagcattgtgtccagctgccgggaagcccaagcagcagcgtgcagtggctttggggtccaaagcctcagcgtggcctctttacctgtgtggccttgggagactcatttcattttttcaagcaccatccagaaagtgtggacactcatggcccctcctgagagtggctgcagggtcacatggggtgcctgcagccctggggcgctctgtgaggtcatctcccttacgtggagtctcaagcactttgagtatgagactgtggccctcagtgaacagttcctctctacatgcagctcactcaaggaggagggcatgggagaaagctggtggctcagggtcaggcaaaggcctgatgcttcactgtgcaccagactgggtcctgtaaatctccaggaggaggtgaccctcgaggcctggactccctttggtctttggctgaagctgctgaacagctgaggaaggagcctgtggctgtttccccgcccagctccctcttattaagtgggaaccctccagcctctccaggaggagtcccatcctgtcttcccagctgcaagaatgcatctgggcacagtttctggtccccatggcaaccgctccaatctgtgtcagcagaaatggagtctgctgctgctgtagtcacaagagggggaccctggcatgatcatcagaccggggacccaggggatccacagaagagaggctcaatccgggagcagcctcccggtgtctacctgcactggccgccgggctggccctgctgggcaggggaggttctgggtgggcagacctgacaagcactgaccctccatggaaggacctcaatgctgaccttgagcctgaccccaaaccacttccgacagtggcgctgttaaagccctctgggaaaacatactctgcagcctctcttggtgcctgactctaggatttattcagtctcatggagtgtactgggaagacagacctatttttaaaatttcatttggaaggatgaagtaggggaaggaactccagagggaaagaagaactgacacttattgaatttctcactgtgtgccccgagactttatcgacattgtcaacttcaattggcaccatgagtctaagggatgttgtcttacagagaaatgagacccagagagctcctgccacttgcccaagaacacacagctttcaaatattcatgctggcacacagcttttaaatactggtgctgggatccaccaggtaccgtctgccattctgcctgtgtgttccccactattccacgtgctgctgaccccacgtgaggcaaggcttcttcccatctgccaggaaccttgaggtcactggtgaatccttgagtcctaaggaagagaggatttggggaaggaagtgcaatggggtgtgagagtggcagccttgacaggacctgagggttgtggctcccttcctgcgagtctcaagacaagagggtgcttgatggaggccccccatgacagcacgaaggctgggctcagcagcagtccaggaaggtgctagcagttggccttcaggacccgttaggaaattctgggtaggcccagaatgacgagagaggacagtgacgccaacccatccagccccacaggcctccagtctcagcaccataggagaagagtggacataccctcccatggcaagcaaggcctcccaaggggggccagaggcctcatcctcatgagccgtcaatttcagccaacttaggctgatggccaaacacatcttccaatggccaaggcaaaggggacctgggtcacctcaggaccactccggggcgaggaagaaggagcaagactagaggaacagggcgctgcagggccataagaaccccaacccttctgcaacctgaattctgcccctcctaggcagaaggctgtgcaggagaacagagtgcagatccctagccacctgctcccagggaggaaacacctccttcttcccatgaaaaagtggcctctgggcaggagataccagggggcagagctctgtgtgtgtctcctggcttgtctgcaatggcaagaggaagtgtgtgtgtcagaggcagggaatgagagatgacctaactgtatcaattggggaataaataaacacattttggcgcattaaagtatgctgaacaatagagtaagtgcagcttttaaaaataaagaagcagaattctatttttgacttaagaactgtccacagtggataaagcaaattgcagaacaatatagtgactattatcccatttttgtaaaataaaatctgtctatctgcatatggttttgatgcagcatccacataagatcatttggaagtctacactgcaccaattgttagtagctgtcgcctctggaaggggaaaaaggaaatggcatcaggaaaaggggcaaggaagaaagaatattggtttcactttatgtacttcttggaattgtgttagaaagaccaggtaacgttgttgtgataaaccaataagggaccaggcacggtggttcatgcctcttattctagcactttgggaggccaatgtggcaagattgcttaaggccaggagtttgagaccagcctgggcaatataaggagaccccttgtcatctctacaaaaaagttttaaaaaattagctggcatggtggcgtgcacctgtagacccagccactcagaaggctgaggcaggaggatcacttgaacccaggagttcgaggctgcaagtaagccatgattgtaccactgcactccaacctgggcaacagagtgagacctcatctcaaaaaataaataaataaatacataaatacataaataaatgaaataaagttgaaaaataaaataatcataaaaggtccccaaacacctctaaacaagggtgcatgcttgagatcagtccatttttcgagtgagcaattcactaaactctttgcagagacccacctcagaaagcaagaaaaaaaaaaacacacccacttgaattttcttaaatgacacagacttttggtcctttgccttaaaagaaaaccctgggctcccctagtcattaagtccccataatcagagagcttcaagcaaacgaacacagagagatctcttctcacacaatttgtccaagctatagcctatgccaaatcagggaggtgtctttttataagaaaggacaggctttagaaacagggtggggaaggagaaaaaaaaaagagatcagtacatgtcaaaagagatatcttctgcaattcctctgacctgattattgggctcattgtagaaatttaactatttatctatttcttgttctctaaacagcagacagtgataatcaaaactttggagatgtaaagtcaacacttgccactgctgtgagtctgtccccagttcatcatcacagtgacagtctgggcaggcccccaggtggcctccaaagccaccttcacagcctacttctgtccagccagtaggccaagaggtctctgttgagcactggcttacgctaggaaataattcggaggaggaggagccaggtggtccaccacctcaaagaagcatgtaacctagtcagagggacactaccgtcagagacaacgcaagaacaccagagacaagctgggtctggccactctgtggcttatgcaggcctctctgggcactgtttgccggtcgaagctgccaacctctttggagaggagaatagagatattatcacctccactgtacacacgtgaaaactgtggatcacaaaagaagatccgtatgacaaggagaaaaaaattcacaggacatatcaatggcaaataatcaagaagaaaactcaaaggtctgtagttatttgggacaaagacctccactgcataactttcaataaaggtgaaaccattaactttaggtagcagcaacatactgttctaaggactgcaagaagccgtctacctcaaaatggcatgattttgctaaagccggattctgagaaaagtaaggatacttaagaaaagcactaaaatccctctgtgaaaactgttgcttccacagaaaactagaaggtaccaggaaaatccagcagatggactttacctttagcttgacctcggcttcctaatgcattaaacactcatatggaatgaatctgttcctgcaggggtagaattacacagttatctgtcatccaatgtcaaataggttatcccttgattaaggtcttagcacggatgagaattttattgaaatgattttcattatctgcacgacagttcatcacaaatatatttggcccagtgtgtttcaaatgtgatttgatcacacatcaaaatgtggacatttaattcattttaatcgagaaattaaatgcatctgccttgcttcctctcctggggctcttccatctcaggaaattcccacaccagcaggtctggacaagtcctcggcagtaacttcactcagcctgaattcttcttcctttccccacggctctgactccaagttctgatcatcaagttgaaagggaaacttacaaccaaaggagatgtaaacaagaatagtctctgtcagttcagtggagagagagagagaagctttaatgggcactagtcagtcagaggcttattctgcaagtgttcattaggaatcagtggaatttccactgtttccctggtgtcacttgggctgctgcctcttggcctgtgtcaaagacaacaaaggaaaatggtccttgcccctcgaggtgggactggatgccaaccagcccgacaggcagtgggtggttcacggttctgttcccactggaggatgctcttgtcggcctaccctctcgcctgagacctggaaggaagtgcatgcccaagggtgccagttggaggggagctagcagtcagaccaggctggtgtaggctttgcagacagagactcacctccttccactgccagaagatgctgccgtcgggtgaggagctgtgacctgggcagaggaaattcaaggagccaatttctgctctgtacatagaaaaggtggtcctctcctgtttgttcggggggcatctctgaagcccagctccactctttaccatcttgctaagaaccaggagtctggaacatctcccaaagtctacgtggggctcaatatcatgtgcaatcactttgcaccccgttacgaatgtgggagcaagagttggtcaattttggaagggcttggttaagacagctggtaaacctcagctgagataatatctctattctcctctccaaagaggttggcagcttcaccgggcaaacagtgcccagagaggcctgcataagccacagagtggccagacccagcttgcctctggtgttcttgcgttgtctctgaccgtcttgtctgtccttctgactaggttacatgcttctttgaggtggcggaccacctggctcctcctcctccaaataatgggggattcagcctgcagcctgggagaaagtcaaacaagagtcctctgtcccaacagcagtccccaaagtcacccttctgcccttaggaccctggctttcctcagttccttttaactgggacacagctcaggtttgacagagcctggccactgggctgggcctttgggccgtcctcgaacactctcctgagcaggagactgagtgatgttaaagctctgacgtctcatggttgcagaactgaagacaagcccaagagcaggaaagtggagtcccaggcagtggcctcaagtatttctattatttctatttctgtatttatttctcgtctttatagctgctgcggccaggtagccctaggcagggcttcctccctgcctcaccttcccagccctttctgcacaggcagcgcacagcactccgtgtgctttagaatcctcctgccctgaggtttctgatcctgtgagtctcctctggaactcgggggctgctgcagaactaggccactctccaagcctccctctccgagtctcggcagccagtgggagcccagcacttcaaagtgcccgtggggctcctctgcacactgccattatccaccacacacatggctcagcacattcacctagtcgcaccacttggagttcagtgactccctggaaggccttacaggagtgaggaaggaatgggaatgcctcctgttcccctacctccccatacaccgacccacggtgcaattttccccagattacaaggaaagctctggggatgcacaacctgaaaggcagctgggagccacctgtcagggaatgtcaccactgcgccctcacaccgatcgcccctgggacttgacaggtggctgcatcctcatgtgggaccggattctctttttattacaccccccgttgagctattccccgcttcaagttttgcattttcggaatgcaaaacttcaccagtgctgggctgggtttccccttggggggcctggggatgcttcaatgaggagagaggacaggaatgagttcatagagaaaaagccaaatgcatatttatctcacaattatacgtaaaagtcaaaaaatctgaaagcgatctaagtgtccaataggaagggaatgcttagtatcaataagagatctggaaagctgctgtaaaagtaactgtcaaaagcacaccaccatatcaggaagtgatttgaatgtattaagaaagagaacatggaactgtatgcccactatgattacatgttttaaatttttgcaaggaaatgcagaaatgaataaagttcttgagacagattgtaagtttgctgtttcgttaaaaaaaaaaactcctttaatactatattatttttataataagtaacattaaaagaaaaacattaggaatctggagaaaaagggatcctaaatgggaatccctaagtcctggcttccagccctgtgtctgccccatccacaaccgcatggctttggatactttcctctaagcctcagtttccacaatgatacactaagttccactgtgtgattgcctgggtatcttccagatcggacttcccacagtttggtttatccacaaacagtgcttactgacctaattaggttatgacttcaaccactgatatctaccaaaccaagagagttggaaatctggtcagaacgccatctgcgtacactgctcccggtaattctgagcaatttgccacatacgatttcagccatgcttgactttccagggcacaaatagaaactactatattgctttaaggctgaatcacttagcacttcccagaattcagatatgatttataccgtcattttaaaataaaactctcctgtctaagaattgcactatttaccatagagcatttcctaattttggaaggaaaaaaaaagaaaatatttattcagaaagcacttcatatttacatagcacctaccgctaatgaaacatcttatccgatcttaatgatgagattaaggtgtaaatttagagctccacccaccagcctggtgcatttcttattcagtccaagtctgtttgagataagttaccagacttcagctttcagagttaatgtgtgggagctattttttcccttctagaaagaagcacttgccagtaacattttagctatttcccaaggctcagagaaggttctccatacttttctatgttggaggtgggactgctgccagcttggagggaagggaaaggttactcacactcgatgggaaagagctctactgtccatggtcttcctcacatatttgcagttggtcagctcctaagaaaacagtgccttactcctacaaaaagaaatctgctgaagaacagcatccaaggtgcaccaccatccccagggtaaatgccccgcaaccacctgcatccaggtgcacctgcagtttcccaccccccagctcatccctccatccagcctttgccagccttccttcgtccccttggcttcctcctccgcctcctccttccagggtctcctctgcagcactccctggcctcccaggcactacctccccttcttgtcacccaagagcagttggcacagatctctgtgggcatcacacagacttcctcccatcaccctctcagatcctcctctgcggcccccatgctaggtgggagcctcattgtctctctaactgtggcaacaggcgaagcacgtgctctcactcacagggtccttggagtgcctgctctggttgccacatgccatggggtgcggttgctgctctcaagaagcccacatcctcctgcaggggacctagcccacggagagtgccaagtgtatgcttgtcagaggtgaaagaggtgtgtgtgtgtgtgtgtatgtatgtgcatgtgtgtgtgtgtgcatgtctgtgcttgtgcatgcgtgggctgcattaatcctcataccaatctcctaagtgatcttggccagaggcaggagaatggggagtgggcactgctggacgaggagggggccagagcgggagattattcactggggtgcccaggaaagaatgcccgccataggatggtctcccatgaggcttcccttctgccctgccttggtcagcatcgggcaggcctcccacaggcctctcctctgaagagtccaatttcagaccgtcagcatggccctgggacagcaacggtctggttccaccagtctctccccttcctcctcataccccagctcgaagccactgccgccggagcaagggcctgcagatgccctaccttgcgtcactcagggagtctgagaatgctgaaaatctactgggtcagaatgtctgcaggtgggacccaggaatctgcatttccaccaacttcccagatgactgctgtgctcactagaatttgagaatcactcacttaagctctaagcttcttaatcaaagtctcctccttggcagggggcccgagtgccccggaggacactctcacggtcccgccagctgcccactttccctcatggaagaataggaccagaactcaattgtgtttttttaaaaagaaaatatatatatatatatttttttttaaaaaaaacaagcataattcataattctgatccagattcttgctaatgcatcaactcactggcttaggaacagttgcttaaatgtaaattagttatctgagaaagaaaatcacattacaggcaaacatagagcttgtacttggcctgacctgcaggacattctggatattaaaggactcatgagacccagcccaaagcccgggccgaggatgtgcccggcacacagtgggtgctattcgctgttatccataaatggcagccttcagcagaggtgggctttcaacacggagacgctcatcagcctcacaccttgtcattttatcatcacagccatggaaagtcattcctaacgggaggaacacactacaccctgcccagcccacatgaaggcaaccctagactgacaagtgtaaaatgtcagatagaataaaaagctttcaatgacaataagtcaagttgcacacactagaaagatgcggtgaggttaagtgacttacctcagctacaaagtaaacccccagcagcgggaggaatataatccaagtctccagtgtcccactctgatcctatctcttttctagatcctgctgcctctccagtgaaaagggagacttcaaatgaaaagtaagcacagtagcttgttctgctgctaatagaggcagtggcacggctgctgccagcatcctctgaaaagatttaacactagaaatattcgaaacagaacagaggcgtcggaggtcacccggccagtcctgtcccgcagggatcagtcccaccttcttagcgatctccaggcagtggctccatggtctctcggaagctgagatgggccccatgaaactctgcctttacttccagggctgacgtgtgggcaagtagaatcaattaaccccgaactcccctctgaactctctccccagtcctgccctcactctactctgtttctggctctaaactcttgtacactctacaagtcttcctctatagctcacctcttttcctcctctccaatcctgtaacaccacagtgtgaggctttggtgttgaaatatcgctaagtctacccttggaggaggcattcaaccactgtcccagcaaagatcccacttggcctccactattggtgaaccgtccacatgctcgtctccctttcttccttgctaacaggaccctgatcctgattcctttccacccctcggggaagggcactgacctcaggctcaggatgaattccaatttgctcatgtcaatctcagcagtcccattcctctggccagggattaactttccgcacagcaacgtgatgaagtttggccaaggagacatggagaaggctggcaggcttatggacaaggtttcttctttcttaaagagagatataggaagagacctcctctccttcctctggacatggtcaggtctcaaaatgatgaccaggaacaatgaaagcatcttgcaaccaccaagggaaccagcctaacattctgaagacggcagagcaaaaagatggagggaacctggacttccaatgtcatctctgagctactgaattagctaatcctagagtcacatatccagcaacttcctggggagagcccaacccattcttcagtttgtgaacatctgatctcacacgcaaaggtcatctccactgataagtagtgagtttccgtcactagaaatgctcgaggagaaggaggaggcagagagcagagatttctgtcctttaaagggtgaagtctgcataaagacctcatccacccaaagtttccaaagagcctacctggataaggaaaagccattaaaacaaacaacttgcacctgatttgttgaaaacataaagtattgccactgtcagattgaaaattgttttccaggaatgtagtaggaagaaagggatgcaaacaagataagtagcttcaagaattcagatggctgtttgaaaaaatgctaagaaaattctattcagtgtcaggtcagaaagatatttcaggctgacaccttgtaacactgtgatatcagaagaccactgcaaatccacacctctgtatcaccttagatgtaaaagagatattgttaaatatctacttgagcccttcccaaaaaaaggatttcacagaaacccaatctgacataaaatgataattctgacccagatccccttatggtcttacacagtcaagcataaagcaaactgtttcattacggacaatttcagatcacgatgccagcattatttatttggtccacatctcacattgctttgtcacgttactcattttttgtggccctgtcttccctctccaaccaagcgcaatgtccctagagaggcaaaatcatacctgaagtacacgctggaatctaggctctcagtaaatgaaagggctgaatggccagagtaggacctaacacctttccttccttccttaggtgacaaagacaagagggagtgcatggtactcctattaaaatcaatcagctaaagacactaaatatttagattcaagtgatgaggattaaactgtaatcttaacactgatttcaacgttctagacatacaatctgagactcatttatttcttcagccaatatttaatgagctcctgtaagtgcaaggcattaaaatagaatagaatggtatctgccctacagtgcctagcctagcaagattaagtgaactttaatgtgatcaattccatgttagaggtataaggcaatatgtgattttgtgaaaggtgtgattatttgtggcagggcaaatcagggtaggctgtatgtgccttgcacatagaagatgcccaataaatgcatgatggatggattgatggggtgacattttgtaggctttgaaaggggtgtcatatagtcagagtaagggacaggagattccagccaacaaagccacacaacccaaagcaaagggatcaggaaagcataggacgtgacctgggaccctacggctggaacatcaggtccactggagcataaagctagaatgaaaccagggagtggagggccacaagtggcccaccagcgtgttcagaccttgtctgatctagagtgccagatgcagggactgcaactcgacaagtcagctaaaagaaaaccttagaaacctactgcatgggatgaaagcaatatttatcatacactcacgccagcctggggttgagtgctttttaaaaatgaagtagtctgggccagtggctcatgcctgtaatcctagtgttttagtaggccgaaatgggagtattgcttgagcctaggcgtttgagaccaggctggacaatacagcaagaccccacctctacaaaaaaacttgttaaaaaaaatagcagggtgtattgatgcatgcttatagtcccagctacaagggaggttgaggcaggaggatttcttaaatctaggagctcgaggctgcagtgagctatgactgttctactgtacttctgcctaggtgacagagtgagatcctgtctccaaataaaataaaaatgaaatatttcaacaaatataaataaaaggtaataatattacaaggagcacatgtacacccactcagctttgacaaaatttagcgttttgcatagttctactttcaagaaataaattacttaatgtgcagtaaaacctgtcttctccgtcatcttccccttcctggaggagccgctatactgaattttttgttaatcaatcccatgcatattctactattcttactagatatatacttattcatatgcacacacataaacatatataatagtttgttttaaaattttatggaaatggttttgtactgtagatattctacgttgttttgttcactcaactttttttcacatttatccatgatgacacaaatgtggctttaacagttggacagtattatagtattctattaaatgaatatttgcaatttatccagtctcctttttattttcccacacagagtcttgctcagtcacccaggctggagtgcagtggtgcaaattatagctcactgcagtctcaaagtcctgggctcaagcgatcctcccacctcggcctctcacgtagctgagactagaggtgtgcaccaacaggccctgctgagttttagtttattttttgtagacatgaggtctcactatgttgtccaggctggtctcagattcctggactcaagtgatcctcccctctcagcctcccaaagtgttgggattacaggtgtgagccactgcacccacttccagtcgctttttaatggttttttttttttcttaatttccagcatttttgccactaaaagcaatgttggaaaggatagtcctggcaatgacaccagcagatggtaggtgtctcaaagagagtaaaccagtttacatattcagcagcagtatgcattattagtgcttgacacacttgcctgcattttatgccatatgatagatatgaaacagtatgttattgttttaattgcatttttctggattgctaataaggttgaacatctttttatatacaccgatcttttgatttcctcttcagaaagtgcctgttcatattttttgcccacttttataaattgggtctttttttccttattgggttgaaggaggttctttataaattctgaacaccaatcttttgttggttctatgtcctgcaaatatctgcctaccatctggggcttatcttttaagattgtttttggtgttcatgtgtcctggatatagttttattcctaactataattcatgaaatacttgcaatcaccccatttgatagatgagaaaactgatcctgtgtgctacgttaacccagctgtaatggaaaagaggcacaactcgagcccaggtctctataacctttgcttcctccaagttctcttctaggccatcctctctcttaggtgagaggtaggaaagcatgtctgtaccagcaggtggcaccaggaatggcatgaaaggaaccaagcaagggctattgctagagaaaaagcaagacaaaggcctggagtggtggttcatacctgtaatcccagcacttgggagagacaaggtgggaggatcgcttgagtccagaagtttgagacaagcctggctaacacagtgagaccccatctctacaaaaaacaaattatttataaattagccaggtgtggtggtgcatgcccacagtcccagctacttggaaggctgaggtaggaggatcacttgagcctgggaggtggaggctgcagtgagccaagattgcaccctgcactccagtctgggcaacagaatgagaccctgactcaaataaataaataaataaatagatagatagataaaaagataaagaaaaaagaaaaagaaaagaaaactcaagaggaattgactgatgactggatgccagtagcaaggacaaagagaaggctgtgtccaggctagggggtccaatggtaccattaaagatgcaggaataggggaggaggcagtgggagttggttttacatgtgctgccctgagatgccggtgttaagtcttacagaggagttagaaatgtggagcaggacatttggaagccatttgcagtgatgccctgcagccgtggggccgggtgagttacctgcatgtgaaactgaagaaactgaagcccagctctggtggccccaaatccatcctgcccatgggactgttcaagtcccccaacacctcctctcatactcacttttcctcctttatctgacacccagcacaatgccaaggtcatcgtaagcattcaataaatatttgctgaatgaatgaaaagcgttatatttcttatacagatccaccacaatctcttatgcaaaaaccctgcggttcagaattttttcgcccttagaaaagtaatcaagtgtaacacacccactggggtcaaaggtacaactccattctgcagttaagcatacaaatgttcatagcaagtgagataaacaaagagtataaataatcttaaattacatgaggttgtgttttgctgccaaatgacctcatgccaaacttaaaactttcaggtttgcgataagggactgtgaactcattgcttttaaaattcttctgacaactcaagagtaagaaatgtatttttcactgcaactcattgtgcacgcacacacacacacgcacttatgaatgtagaagtgagcaaatgttttagcaaataatacatatccttacaaccttggaagcactatggtactttttattttactcattttagttttagaattctggttgcaacccattatatggagtttgcagcccaaatggaacactttgacctgagactcccctctaggtttaggggggtaggtgaggaccctggctggaaagatctgatgctctggaagccatgatgtgaaagctctgcagtggggacagggggtatcccgggtgataaaggttagaaagagaaactgctgatctcacgttcgtagggagctggccatggtcctgccctgcaaacaagagccgggagactgcaagaaaggctgagtaaagcccaaagagaaactcttccccctggatgatgatcaagaacctcattctgccggcttctggaggaatcttggccagaaaagaactcagaatccctttcaacctctttcaatttttctggtctgcaataatcaataaataggtttctcgccatggaagactggagcagaaaggggcctgacagaccaaaccatccaaccagtcagtccgcctcatcttacagcaggccatgagggccaaggagacctggagcaactggcccaggacccccgctgagggcctcctgcccaccatgcagcccttgactacccacagtcgccaaccctgctccccagcttgcttgcttttctttctcttttcttttttcttttctctttctttctctttctttttcttttctttctttcttttagacggagtttcactcttgtcaatcaggctggagtgcaatggtgtgatctcggctcactgcaacctccacctcccgggttcaaacgattctcctgcctcagcctcccaattagctgggaacacaggcgtgtgccaccatgcccggctaattttgtatttttagtagagacaggctttcaccatgttgaccaggctagtgtcgaactcctgacctcgggtgatccgcccacctcggcctcccaaagtgctgagatttcaggagtgagccaccacgcccagatcttccccagctttctagcccagcttttatctcaagtcaaagcctcacccactgcccttagcacgaagatggctatgcaagaaaaacttttctgcgagcagttctggtgcttccctgctccccgcactccactgtgggtggcgtcttgtgccagcagcacttagtgcccggccacatccttagtctcttagttataatagccagatgttggcaacatggtccttttcttcttcttgaaattctctaagatgccttcaaatttagtttaagtattttatacttaaatattggaaaaggatataaaaactagtgaataactacttcaagtcacgcctatctttcccttttttcatttcttataagaaataaatgtactctctataattcaaaatttaccctttatacttcagggtctttacattatgtaattttttttgtttgtttttttgagatggagtctcgctctgtcgcacaggctggagtgcagtggcgtgatctcggctcactgcaagttctgcctcccgggttcacgccattctcctgcctcagcctcccaagtagctgggactacaggtgtccgccaccacgccagactaattttttgtatttttagtagagatgggggtttcaccgtgttagcccggatggtctcgatctcctgacctcatgatccacccgcctcggcctcccaaagtgctgggattacaggcgtgagccaccgcgcccggcctttttttttttttgacagagtcttgctgtgtcgcccaggctggagtgccgtggtcatatcctagatccactgaatcagaaaacgttttttaaaaaaactttccataagcccacaaacttacaaaggagcagagccaagttgcacatgatatatacatatatatgtatgtatctcggctcactgcaacctctgtctccggggttcaagcgattctcctgctgcagcctcctgagtaccagcgattacaggtgtgcaccaccatgcccagctaatgttttgtatttttggtagataagggatttcactatgttgaccagactggtctgaaacccctggcctcaagtgatcgtcccccttcaacctcccaaagtgctgggagtacaggccagagccactacacccggccattatctacttttcatttgggggcatttgtaatttccctctcaaatggatcagaggacctcagaaacagaaagggacttctcctgggaaccctctgtctcccaaataccccacttcaaatcatccactgcagtgcacagactgggggctggtgggaccgacatcgatggagtggttactagcagccagacactaggcagatgaccacacctatcatcctcacagacctctggggtggcatcaacgtcagcattgtcaatgtcatcatcagcatcatcatttctgaggctccaagattcccaagttacttacccaaagcccaggcctgcctgcaccttccctctcctctcctgcagactgactgctgcttctttaaaacacagaatgccactaaaaaataggctgaaggagggagagcatcaggaagagcagctagtgggtgctgagcttaatacctgggtgatgggatgctctgtgaagcaaaccaccacggcacatgctaacctatgtaacaaacctgcacatcctgcacatgtacctctgaacttaaagtaaaagttggaaagaaaaaaagtaggctgatacaaaggcaaatttccttataaaatctttaacgagaaagcctgcagctccaggctagagaaacagggatgtattttcaatattaactcatgagtagcgttcaagtttgtgcaaatacgtaagtggacatttttggttgactttctttccccaaactgcaaatattatctgcaaggtcaaccctccatctcaaatgagattctgctatatatcaaacagcaatgaatcttggttttaagaattatatgaatgtaaggtattcttaaatatattgtatcttctaagttttttctttttaagaagctacttgctgtagtgttagtaacacctaagacaagcatgagaatcagcatggaagtcagaaatgatcacatgccagtcaaataggtaacactgacttgtgagactggtgcttttaggcaccagtgcaattttgcaggggctcccccagcacacactgttctgaatctcctttcttctggaagctagaatgacagcctgattctcctagtgaacagatgtactgactgtgacaaaacgcacccgccatgccaataaatctaatgagtaactcaagccaaaatatatatgtatatatcatgtgcaacttggctctcctcctttgtaagtttgtgggcttatggaaggtctttttcaaaaacattttctgattcagtggatctgggatatgacccaggcactggtaacatttaaaagctcaaacgggtgattctgatgcatatatctggttaagactagaccacatttaattcatggttgtatgttcctcaaaacacttgctgccaattagtaattccactgttttccaattaagtctatgattaaaactaactttaattgtcattttatttttggattgggaagacatttttaaccacaagagcagaagaaagcataaaataaaaacttgacaaatttgactagataaaagtaaacttttctgaatgtcaaaaatgctatcaacaaagctaaagaataaatgagggaaaatatatgtaccagtgacaaaagttaataattcatccaacagatatttttaaaatatcttttgaattggtgattccacttctcagtatttaccctaaggaaataagcagagatgtatacaaagattcagtacaaggatacttccttgcagcataacctattacataataagaaacaggctaaaagttcatcagtaacagatgcctggataagctggcatgcatccatctgatggaatgccaacttgtcaacaaatacttttaaatcttatctcaaaatttggtggaacattcaaatagttttacacggaagagtaggttacaaaactttaataataaaaataattttacagtttcctttaatttctaattttttgcagtgaacatgtattatgtttttaacaaaacaccattagaatactgcacaacgaaggcattggtgtatctgaactgaataaggtatcagacggatcaaagctttccatgctaccattgcactcctcagtggcaaatgcttggaaaaggaagatggaccgatgttagtcaagcagccttttcctggaaaaagtaaccatgagagtcaaaggcccccatgaggtccactttgccccacatcccatcaacccaggacaggcaggcctcctgccaacagctgggtccttgggctccagccgacaaagtctacaactgacttccatgttggtgtcttcttatctttgtattgcagtttttagctgtttttcaacaaataccatatgaagaatatgcatactcaagacctcactgaatgtcacccaaacaccaaatgaaaatctagctggaatgaagacatttggtttcaggatggcagattctgagagatttcgcccacttgcatatgatttgcacatcctttgtaccatctgatgagaacggtgtgctccatcaatcaatgccactgagttctcaagtttcagttccatccagaagatggaaggttgcctagagtcaagttaaatctgatttcctcagagatagtcaagtaagtttgtcatcagcaacaggacacttgccatctgacatggcaaggctaagaactctcatatagactttgtctccttagcccacttggtcccactcataagccctcaagagacacaaagtgataataaaagtatttgtgtattttccccattgggtttccagaaatgtcattttcgtcacaccctcccactcaccacttctacattcaggatgcaatactgcagccagagttggtacaatgcaaacattccacgagaagttagaaaacttgggttccagcataaacttgagcaatatgccactttgaacccattttcttatgtgtaaaagtagataataccagcactgctgaacacacagggcaatattttctttttttttttaaaaaaaaaaaggcaataaatattggttaaaaaaattatacaggctgggtgcggtgtctcacacctgtaatcccagcactttgggaggccggggtgggcgtatcaaccgaggtcaggagttcaagactagcctggtcaacatggtgaaaccccatctctactaaaaatacaaaattagccgggcgtggtggtgcacacctgtggtcccagctacttgggaggctgaggcagcagaatcgcttgaacccaggaggcggaggctgcagtgagccaagatcacgccaccgcactccagcctgggggacaagagctagactccatctcaaaaaaaaaaaaaaaaaaaaattatacaaatgtaaagtattactaaatacatcgtaaattctacagtttttttttttaaagctatttgctatagtgttagtaacatctaaggcaagatgagaattcacgtggaagtcaaaaataatcacatgcccatcaaatacgtaatatcaactggtgagactggtgatttctgggaaccggtgcaattttgcaggggggctcccccagcatacactgttgtgaaagttgttggcaagctagagccttgctaggctctgcagtttacagaccagcagcactggcttcgacttccggcttgttaggaaggcagaatcccacgacccactccagaaataccgaattggaatctgcaattgaactagatccccaggtgactctctcacacacacacacgcactcacacacgcacaacacacacacacgcatgcacacacacatgcacgacacacaggcgcgcgcgcacacacacacaaagtttgaggactgagctggaggcctgtcaatcctggtagcattatttctaagagctggtacgtgagcaagaggacccagtggactcggtgaacttgaggtcctatttttagcagtctcgagtttttcctgacgctactaatgctgtgtgtacttctcactcacggaatacgaggtgtcagaaagcacaatttggaactgtatcttggtaatttcacaactgggacaggaactcttgtctcatcagaactatgccgaaaagctttctccataggctaggatgactatgtggtcatgcatgtttgaattatgttcctgtttccaattaaatatcccttacagaaaggttcaaggtacctcttttatagtatgtggaaagtttatttttgaataatttatttattgcttgcacaagtgataagaacctcttagaaatcttgttcccttaactattagtctattcacattcttggacgaataaaaagctttactttcttttgaatcttaagtggggctaggagggagaaatacaaattctgttctgtttcaaaagttggttttaaatagactttgcatcttggaaacttctggaacattcccccatggaaaaaaaaatgattattaggttctgaattgagctcatgtaggtgtaacatagaaaggggtattaataagaattttctttatgggtatagtctaggagaataatgagcttcttcccccttccctagcccctgggcaccctcaacgccccaccaggtaggcacgctgtccattttcgccctcctctgtccaaaaagcagcagctgccacctccctgggaagaggcaggcaccctattacagctcccgctccactgaaccacatctcctttcttcagatctcttctcttagctgggtacagcaggagggcaatcgtccaaccaaagtcacatcgaaaatctggaagcttggcaaggctgtccagctgacttttgtcaccctggcctctaacacaatagccacaccattgctgctgcccaataaatacctgttaaatggctgaatctactaaaacatttttaaaagatgatgcttatcattagcacaagtcaacctccaactgggggaattttaggctctggcttcaagtgaaaattctgggagagaaggggctggaggcaggaatggcactgctgggcagggcagccctgcctggagagcgagctctgagatcagctcctctcttacagtcgctggatttttttcataactcctttactttctttacttctaaatccacattctttaaaatctccaagtttccttgcaactccctaggcaagggcaatgaaggatttactcattcactcgctcaaatattatataggtattgaatttctaatgtgtctcacgcattgttctaggtcttgaaaaaacagccaccaacaaaacaaagcccctgccctccctgagcatatatttagcggaggagacaaaactataatgtgaggtcatgatggaggtgatgaggaagttaagggagaccatggcagaggtgccactctagacaggctgggcagagccctctctgcggaggagacaatttagcagagatggagccataagcacatggggaggagcatcctagacaaagcgagcagcaaatgcaagggccctgaggcacgggggagtagggcaccctagcgggttgggcgctgggagggagagggggtgcagccagtttaagtagggctcattttttttcttttcattttgttttgttttgaggcagggtctaactctgtcgcccagggtggagtgcagtagcacaatctcagctcactgcagtctcgacctccccagactcaggcgatccttccacttcagcctcccaagtagctgggactacaggcataagccatcatgccgagctaattttccgtattttttgtagagacggggtcttgccacgttgcccaggctggtctcgaaattcttgggctcaagcaatctacccacttcgacctcccaaagtgctgggattacaagtgtgagccaatccacttggcctcatttttaaaaaagaatagaatttatgacttccacctaatccaagccttccacctaatgggacacggagtccttaattaagactttgtgttccactcattgtgtttagtacgcaatgatttagtctacaaactatcgtgagatcttatgaccacgaagtggctgggaggatggcacggatagaaggccaccactgagcaactgtaagtgtgcaagtccaatcagaccacttccagaaggtgctttcccctacaactaagacagcattcacacttaacccttgtagcaacttcctacactgagaaacacaacagaattttgctgtatgattctcatcttctcagaaaaatgtgttgtctctttgatctgcctaattaggctaattgaactaggaatcaaagcagtttctggggaggaaggtaggaagttctgtttttagtttggctatgatttgtcccaatcattttatgctacaaaagcttttgttggcgttggcctccgagtcagtgctttgaaaggtggccgcaaatgtgatttatgggaaggtgctgccgggggcatgcactttatgggcaggtggtgccggaggaagtggttaggagacagtttcctcacccatctcctggagagacctccatctcccttacccaccctgcagtggtaccacgcacatcggacgaaagaggctgtcgctaaaacgctttgaaaagcatacacacgtgcacacacacaatgctcacgggtagtatttgcagtacagaattctagtactgtgcacctcagctacagacatcccaatttttgaaagtgtccataatttatagcaagagatatttgggtaagtgcagaaattatacacgagagtcattgaaactgagtttataagagtcaaaaattggaaagaacctgaataacaagaattgtaaactgctggacttccagcaagagggagctggttatattcatgcagagcggccttgaaaaagatgccgtgattggataacgtacactgtacacggctgagaacaaaggaatctgaaatgacaatgaatggagtattagcagcagtgacctagtgaattttgttctgttcatttttgtgcactctctaaaattatttacaaattatgtcattttttatgataaaaagttgtctgaattttggaaaaacaaggatggagagatggaagacaggaaatttttactaaccaccttctcttctgttcctcatctgccagagattaaaaactgggaatccacaagagccaatgaattttccccctccttggtggaaactctcacaggagagaagtcctggaagatggaagtggcctctcctgtgcaactctcactccttagcatcaagtttgcagccctccgtgatctgcattctaagcacccttgcatttgaccctgctcaccattcctcatgctgtttagtttgtgggtttatctcggcctggagtgtcctcctaagccctttagggatgtggctcaccctttaaggccccatctagaaacgctctccttcccttacggacccgccacaattttagtgttgtatcttgcagtctagtttgttacaatcatgcccacctccataaataatgtcacggatgccatctgagaaagaggaatgacagcgggagaaacgaggaggatgtgtccagcaacatttagaaacagcgagggcttctggatgggtccaggagtggctggaaaagcagtcactggctgaaaaatttcaacagttcttttcttccttaagacaaacctgtgggtcaatcccaactgacataaacatcgtctttttcacatcttttcccctgcaagttcgtcttggaatactgagacctgccctccatcccagcccagcatcccgaggacttgcctgctctttcccatgagctctcccatattcaaattcatttatgccgttagtttaccgctgctagaatggcaactccatgctttgtgtcttttgcttcccaagagcccagaacagtgcctgaagtctagtaagcatcatcaatgtgcaaaaataaagaatttacttaaacattatgtccagctgcactgtgcttctcaagttcccctaccgaatagctctctgagaagacaattttgctgtactctcattctgaaaaaggtggggacagacaggaagcaagaatggaaggggacaaacaccaattgttgagaaatgtgatcttttcaataattcagcagaacctaactctatggaaaattctgcccactcacaaccggaagcccaccgaggcaccagtgtaagtgtgctaaaacagtttcgtgccactgaaaggctacttcagcattcaaagtttccatcaggcaagaggaagatgaggagggacagagctgacatgggaagagttaatgtgcagtgctcagcattcatgaaaacctagagagaaaccaacactgcctgtccctagctcagaactggctgcatttggaggattttcaccccatccttggacacttcccttccatcactgccttcttattcttgctctgagtttcaaacctataaggtggtcatcaacctcatgaggaaagacagccaggaaggttggaggcaaagaccaggcacacaaagattagagaaacggcttttatgcagtcttttactccactcagaccaaattctcatttttttgccagaatttaagattgatatattatacataacactagtgtaagatggagttttagatcagttgctgatggcagtttttttaattttagaagaaatggcagctactgaattaatcctacttaatctcaatttacacagataaatctaaaaaataaaatccagggagaagacagaaactacaatttgttacagtgacttcctagagagatgaacaaaaaagacacaggaattgcttatgctggtagtgtgaaaagcaatgctccaacacctgccttaaacttcctaaaatcatgaagagattcaaacattcaggagttcaatcaagccacccagccagagaccagctgaatcaggccccacaagaactcagggagacagtctgagctgtcccagagccacatagttgctcgcatttggaaaggtaattctttatttctgaaagtggaaaaactacctgacaatgatctcaatattttctagattccacaaatggggcttttaaaatggcatgctaatccattctgtgatgtgggtttctaaggtcaaaatggggctgtaaagggtcactgagaaccattcaagtagtaaagaaaatcctaattcctaagggagaacttctgagatactatttgactaaaaatggagcttgctttggagggagactgagataaactccctgcttctgtgtcaaggtacccagtcaaaaacttgtgctttctcttcaaaatacaaaactgcaaatcgacacaatttttgatcatgtcatattttaggcaaaatcatttcaataagtattgatttagcatcttttctctgctgcaaaattgggaatgttcaaaataaattcaattcaaaattttaatggcaaagtaatgccttccactgttgcggaatttaaaagccattgctgacagctgtcgtacccttgggaggagatgcggagtaatactgcaaatgaagtccaaaatatccctcgtaccaatttcattttattcagtaatttcattcttgctttcaagtcccacagaatacagaaagcaggtgtctgcctcactaatcatagcccagggtttaataattcaatgtcgggcctcctaagaaaacgtctctaagggaaacacttaatgtagcgtatggcaagctttccctaatgagcaattcagcacgagttttgcaagatcctgggaaataaaaggacacactttggagaactgtgaatctgactggagatcactgacttcctctgaacttcctgcctgccggcatccattgaggaagagtatcaaccccaattttaaataggccaaggaagaaatctcagtatctttcttggaaattttctccttgacacagtatatatacagcccttggcacagtgattggcactcaatcgggcgagatataaaaatgggtattcagcataaatttctctggaaaatgtccttccactgggaaaatgaaggcaatcgccacacagcccgaatccctcatggattcatccttggtttctcttccttcagggcgcttttgtgcagttctttaaagacaattaataaaagtagttaatcacacaaaactgtgacatatacagtcagtcttaaacttgatattgtagatgatcagaaataaaaataataccagttataaccattgcatcaattttggtcatttattagtgttcaattagtttttttgcagattggtggctattttacaggttgaaaagttatccacatcgcttcttggccttttggctaagatcaagtgtgaaaagtgatcagcaaggtagtgtaaatgatttcctaaatgcctgtattgcagtggatctttgcgttatgtgaggtttcagtgctttttcacatataacttttggaagtctgttcgagagatttccagaaagagttctcagtcaagcgttggttgaaacaggatggtgacggctgtccttttaacctctaccacattcggtttttaaaacaatgtctcccatcacacagcaatgctgaagtaattatcaaaactttcccagactgttcttggacaccctggttaatgtcctgtgagttatgggttacgagataaagaaaagcaaataggtcctctaggcagaactgagactgaatatgctaatatttattgcacggttccaagaaatagcagctctcatccttctgacttcacaaaccagtaaaaaagaatgtatatctttagagaactcagggttacaaacttttttattttaccaaacaagaacatacattagagaaaaggacatgaaggtttaaggaacaatttaaggctgaaaaaaatggtgaagtccccatcctgtccttttctttcctattttgccacaggctggcacctgccctccgctggtcattcaggaactgcgggggctcctggtgctcaagcgcccttgatcttggcttcaggtctgcaggacacaccgaccgtcaccactgctgagtcaagaagggggtctcccctcactcccttccccacattcctactgattcactcccactgatgactgggtagaaaagttgcagaacactgatttagatcatcgtattgatacgatcttcttcttcatttcctttcctttaattcacgtggattttttaaacaaaatttacttagtaaaattccttcacagtacaaagctcttttatttggacaaagttggctccaggcaccgaaaagcttgatattcatttccagccaccccaacctcaagcacttggtaattacagccaaaagatcagcaactctcactggggaaatacatggaccctgtttacaacattttcatacatggaacacaaacatatacaagcagcttctgcgaatacttatacattacatgaaaagcaaaaatagtatcatgctttaaactgtttctcaaaaaataatttcaaacgacaagcttttaaataattaggccacttaatttttattacaccaagagtcagaaaatgattgcagactacatccttttacacaaaacacatttgtagggtttctaaaaagctacatacataaaggaaaaattttagaataatatcctactttcagtgtgtcagggaaatttgctaatatgttttaaggttatgttagtttttatttttttaaagtaatacatacctggatagtcaatgagggttcaatgcaggttcatgtgggactgcaaatctggcctattttttgatgaatcttgctttcaaaatcttattgacgtgaccaccttccctgcacatgattagttttactggcatctgggggtcatacatgggtctcttcaactacctccttaactcagaactccagaagccagcgagctccagagaggccggtatcgggtcttcccatgcctgaggcacccttaggtccattcctggcctcaagggaatatggtggttggagggaagagtggacacaccaacacccaggagagggcctggcatgaagcagatgtccagtggagacaactgtcatccaaacaactgaaaggctacctttaagatacaatgctggccgggcgcggtggctcatgcctgtaatcccagcactttgggaggctgaggtgggcagatcacttgaggtcaggagttcaagatcagcctggccaatatggtgaaaccctgtctctactaaaaatacaaaaaattagctgggcatggtggtgggcacctgtggtcccagctactcaggaggctgaggcaggagaatcacttgaacccaggaggtggaggttgcagtgagctgagatcatgccacttgtactccagcctgggcaagagagtgagacttcatctcaaaaaaaaaaaaaaataaaaaagatacaacgttacaaaatgtttacaggcaaaccttagacaacccagatccttcagcccacatttattctacttccccacaagaagctacaggaagggagacagaaatcaagggcagcaagtgaactctttaaggcaactgaaaacctcccatccccagagcaaaacatgacaatgagaggaaagaagatggaacaaactgtgatgcttctatcttgacttatgacaaaagggctaaaaatgagcaacatttcaaagggctagaaaggaactgtactatgattacttggcaaagaaaagcaacacggataaacaggattccaatttttttttttttttttaaataagagatggggtctcactccatcgcctgggatgaagtgcagtggcacgatcacagctcactgcatgctcaaactcctgggctcaagagatcctcctgcctcagcctctcaaacagctgagactacaagtgcacaccaccatgcccagctgattttttttattttttgtagagacagggtcctgctatgttaactcctggccttgggcagtcctcctgcctcggcctcccagagtgctaggattttaggcgtgagccaccacacccagccctgatcaatttttgactcctttgtgctcgacgttatccccacatttatatcaaccagcagggagaagtggtgaggacagagaatgcagatctgggcacggatccactcaggctcctctctcagcggcactctctctgtagatgcgaaacagtgaggcacatgttgtaaaagcccaaacacaatacttcaaaagcatgcacagaaaccccttgacatctgaatatatgacgttaactttcaggccaagtggactgaccctggctcctctcctgctgctaggttcatccgcaacagacaggaatgtttgcgaggtgagagttgtatttttcttacataaaagatctgttttacaaggttattttatctggttaccagtctaatgcataaaagacagtggtatcctgtctcatgtacaaagagcaatgctgcctgggacgcctcccgcatgtgcggcggcaccactctgatgatgctcttccatctctccactcggtcccaatattagagtttcttcaggctgcttcatttttccacgatgcgcctctcagcgaggctgtattttgtaggaaagttccagtgaacgatgtaacaggtggagaatcccagatccgaaaacagagattggaaacacgcaaagggacccgtgtgttgaaacacatttctaatcagataatcgggtgcatctgttctgttaaatgtccactacacttataaacaaattaaccaaattcagaaataaccatacaattgtaaaatctgtaaggaataaggaaggaattatctgtgaatcttgaccattttcctgaaaatctgctgcagatttaagtgttatgaaacaacagaatcctaaatttccagtcactactacaatttgaagtacacatgttacgctgtaaatctgataccccaagacataagaaaaagtcacacttagggagaaaatcttcataattgttagaaatgttagaagaaatatgttcatttaaaaaacaggacattagtactcaacttatgaaataaacccactaagccagcaggaggcattgcctaggaggactgtggctcagcggccttagtgccttggactctatttctatcacccgtgcttctggggcagccctttgcagagagtttccgtccatttcattaggaagctcttgccatgtggctcagttctatgcgtggaaaagcaatgagcgaccttcaagatctgatgctccattccaaggcgacagagaatcaaccacagatgggcgcgagaacagagtcagatcaccggccaaggtaaaatgaagacgatcttctggattggggcttcctgacacatgaccagggccagtccctacacccacagaaaccacacgaatacgtatgtctgtacagtcttcccaggaaaaggatccatagatttcttcaattttccaaagagtttgtctgaaacttccaaaataaaaagaaccattgtttcgggctcattttctctgggtgttcctatgtatttagtgcacctgaactcataacgatgtattcgtccctgggtaaagagtcagatttctgaattctcagtgatatgccgggctatgaagtgcagtgaccaagaaggtgcagattccccaagagacacatactgaaacgcttttctagtacaactgaggccaacataaaatctgaataaaagtgtaaggttttctttggaaccttatttccctatgtctagatgtgttctatttctaggaagtttctaggaagcaagcatcaaaccctgactgtattcatgccatcatctccactacgttcagttgtctacattattttctaaagttatccaacagggacagaagacctttattaacaatatttccctaatatctaatatacttatttttagctaagttaatctttgagccacatatccattcagaacataccagaacaaactcaaactcactgttaggaaatgtatcgatacttccaaagatctcatgccactacccttaagacactgcagcctgctagggtgggctatccaacatcagaacgcccacagctccagacccggcatggaccatctcatcctccccaggaaaggcacttccttccctgacagcactttaagtcagctctgggcgagtttatcccccaaccctaccaccattttttattcttaggctctgaagtttttccttcttgggtcgctttcatttgtgctcagagttttcagcatctaagatggcctttaaactattcattccagtagggaccaagttttctcctgcctggttaattccttctgagtgtagcaaatgcctgggcccagtcaatattgtggctagaactggctaagaggaaacacctctactgacgaaagcatcacagaataaaagtttctaaaagcctgtcataataagaaaatgactaaacagccaatagaggttcagattaaaatttaacgtgacttttaaaaacctacttaatgttgtttttttgtttttgtttgtttgtctttgacatggagtcttactctgtcgcccaggctggagtgcagtgacacaatctcggcttactgcagcctccacctcccgggttcaagcaattctcctgccttagcctcctgagtagctgggattacaggtgcccgccaccacatccggctcatttttgtatttttagtagagatggggttttaccatgttggccaggctggtcttgaactcctgacctcaagtgctcagcccaccttggcctcccaaagtgctgggattacaggcgtgagccactgcgcctggccttaaaaaacctactttatgttttcactgtgctttatattaaatacattaccagccaatttctcttaaaacaagcaaagcaaaaaggagccaggggtattggggtagactattcagcttccaaaagccatctaatagaaatgttatgaaaacttctgctatacactagtttcggaaatactggataatccaccaaccatcaaactttcaataaacgaatacacgaacattccactgagcttctactcagtctctatagttccgtgcattctcttcattctttccccttgatccatttccaagttgctctgaatgtcgtcttaaaagtcagtctttccctgttttggtcaattacttgaccatcatatgtatctgccccagaatgcttctcaagtttcttaatcccaggaacaggtaagaaaaaaagatagccgctcgaggactttctgactttcctatcaaatacaaattctcattcattccaatggtcgagaacacattagtctacattctgaaagtagcccacagttttaaatagcatgttcaggtacatggaatacactcaactttccttttttttttttgaggcggagtcttgctctgttgcccaggctggagtgcagtggtgcgatctcggctcactgcaagctccgcctcccaggttcacaccattctcctgccacagcctcccgagtagctgggactacaggcgcctgccaccacgcctggctttttctatttttttttttttttttttttttttttagtagagacagggtttcactgtgttagccaggatggtctcgatctcctgacctcgtgatctgcccgcctcggcctcccaaagtgctggcattacaggcgtgagccactgcgcctgcccaactttccattttttaaaggataaataagctttcctggagattaaagtttctgtccttctcctcccttccattcacactgtctacccttttggctactaattttgcactaattcattcagccaataatagaaggaggtggcggctggagggcaaactgaacagctccttctctctcctcattggcacttctgccctacatagtaacgtctcattttaaaaactggtagcactgtgccacaagtatatttggatataatttgggtggactttgcatattctaatacaggccattctgagaccggttccagactgaaattttgtctttactgcctttaggagtgtcacttgatgatttctttcttcctgaaaaataattgcctctgatctaaataacttacactgcaagcagacagaaaagacaagaataggcataggaggaattacagaaacttcctgggaaaaatgaggttcataagaaccccaaaaccttcaaaagataactgtctccaaagcatgacactaatactgatagctgataatgagagacatgcatgtcaacccagaagtacatcataattatctgttattagatatactttaatgaaatctactgattcatctagtaagttactagatatgtgaaaacaacataatttccagagttcctaaatatgtccaatatattgaacttagggatccaagattctgaacatgccatcaccaaaaaaaattgcaaacctaaaaaacaaaaaggaaacaaattaaacaatgtcaaaggaaagactttcttagaaatggtcaataattacttttataattttcaaaacattttaagttaatactttttatcgtcttaccattataagctcttaagtctaacattaaagttttatttaaaaacaaggcagttttcataaagcaaaataaatattacacaatactcatccacaccacctacttaattatagagtatttactgggtcaaaatatctccacattcataatttgagcctttaaagtggcattagttctgtctttattttcttttaaaagttgtcatcatggtgacagacattcagatgcataactaaaattatagattttgttcttatgcatctcatacttttagaaactatttttttagtcgagtaatagcggttacagtctttgtgcttctattacattaacttttagcacatgaactaagaaagatgctcttcaaagttgttctaaccacaaagaggtaggccttttttgaaaaagaaaaaaaaacaattttttggcaaaagaaatcaaaatttccaaaagtaaaaacatcagtattatttctcattaaaaatattaatatacaaaagtgagctgtatgaataaaacatttactataggcttaaagaccatgctacttagaccagcttatttaattattccacagaaaatcaagagttcagagttcatatttccaaaagcataaaacaacacatcaggagatatggtcaaacaaagaaccactgagtgcacactggtttttctttaagaacaaggcgaagctggcctggggaagcagaaattattaagagcccacacacataaaatcactgctctcccagtcaacctaatggggcccagatttccatggccagcttgtgagtaattttttcttagtgtatgtgaataattctccctatcattacagaaagccacatacatgaagaaaaagaacacattttataaatgttaaatcactctcaacatctgagattaagcagtaagaaaatactgtttgtagggaaattaagtaacacagaattacatgacaactgagtctccagaagagaaacatgaaaataaagatgacttttaaaaaatgatgatgttttcagttccttacaatttgccttctgtagcaccctccagaatgagatgaaatttaattttctcaccatctcatcaattaaatgactgcacaatttaggctaaacataagtaaatctgtgatactatatttgttattaatgctgttacatgtagtgaaagaaatgaagtggcgtaaacaaccacttatttgaaataatagcttagtgtgaatctgaactccaagcaaaaacctttttggaattctatttttaggagagttaaacatagtaactgccttataagctccactacctcaacatatttaaaaggacatggtccatcagaatacatttaataattaaataacactcccctccacccaaaaaagttttactaaaatgtaaaaagaagccactgtattatcttcaaccaaaaaatatatttgaacatgtaatagcttaaagctaactgatacaactaacattctccaaaggcacatcatattttaaaaagtaaaataaacaaacacacacatacataaaacattacaattctttaacatagaaaaaaaagttgtggcaagaatccttactttctagtctaaaaacctgtaagtctggattcccttttgtttaagagcaaaaccctattgtttaaaaaaaaatttcaatctccaactcctaatggctcaggttttttcatataataaatattttgttgctgattaggtagctcacaagagctcactttaaaaagccatgttaaaacagctctaaaaggtttaattagcatttatgatgtaagcccttttgtaaaacatttgagctaatttaggtacgatatgtcagtatgttgtttaatacctttggtttacaactttaaaatgtttttaatcttgaagaggaaggaactggggcagcacagacacggaaacacatgaaggcctccctctcgctggctttgccatttaccatgcgggctgaagtggtttcaggacgaggcgatcgctcaccttctagtcagaaatcagatgacctcaaaacaacctcatttcaggctgaggcctcatgtctttcgcttagagctaaaaataaaaatacatgtgaatgaacaaatgagcatggaatgaaatctctaacatgacactaaaatataaaatattagaagccatttttatcacagaaaaatgaaaatgtacacatttctacacagagaatcacaatcctattttgaatggagtggtgcccgtcttatcctgttagccgctgggtatcgtaacaactgaaatccaagttggttctacaaagctaaagtcatatttgattcatttcctgagattataaaacactgatttatttacttatttatttgagacagagtctcactctgtcacccaggctagagtgcagtggcatggatctcagctcattgcagcctctgcctcctgggttcaagcgattctcctgcctcagcctcccaagtagctgagattacaggtgcccaccaccatgcctgctaattcttgtatttttagtagacacagggtttcaccatgttggctgggctggtcttgaactcctgacctcagatgatccacccgccttggcctcccaaagtgctgggatgacaggcgtgagccaccgcacctggccaaacatttatttttaatagagttaaatttaacaatattttaatgaagtcagctacttagatcacatatgtgtgtgtgtgtgtgtgtgtgtgtgtgtgtgtgtgtgtgtgtgtgtatgtgccagggcaagaaaggtctgtgtaatgctaaaccgtaacaatagcctggccctcagaaatatatttttgtgtattcacaactcttggttccaatagcagtactcgtacaacatgaaaactaacctttttctctaaccaaaataaggcactcactcattcaacaaataccgaatgtttctaagcaccggaattaagtgcttggtatgacagaacgagttctaaacctcatcagtgagtctggagtcgtcagccatctatttcctaatttgaggtctcaagtctgggctatgatgctaaggagattccacaagaggtaggagggcagtatgtattaagtgacaacagaatgaggctgcaggatttgaaacaaaatcctgaatccctgaatctctctgctgttgctgtcaatgacctcaactcatcatgtgtctgtctcttcagtatgaagcttctgttttcaaaatcctattttaatcctggaaattaattctttctcatttggagaatgctggtggttttggtcccaaacataatgcctcaggctattttgaaaggttaaatctgccaagtaccttcaaaaaccatttattttaagagtaattcattcaactgaagccataatttaaaattcagaaatcctgctgctaaagttatatttaaagaattggccctagctatactgtaatgaagacaaatatgttacagaatgttttacaccattcatctatgcccattaaatattattcataaattatcacatatagtctacactaacattatcgttcaatgttttgcatttctctgctggttctacatataccaatgacattttttaattgtgtgggaatatgatacgttaccaaaaaaatgtcaaaatatatgcacctgattcaaattaagctccatgttcatcttaacccatttctgcctagggtcccattactgcaacgctaagcttgtgggagttatttgtgtcctactgctcaagatcatcaccaaggcctgatttttcacaaaaaaatctgcaacctccagcataaatgggttaaaaccagaagaataaatacatttctgagttggcttatcttctataatttttcatggagtctaactaaatttaatatcttgacaaatactaccaagtgaaatgttttgactctgaagttcataggtctcagaaaatactttaaagtaatatactgcagtttatgcttaaatacttagaataaagaagacaagaactattgggagtcatatctgggttttaagcaaatcaataagctttgaaagtacatttcccacggatgttcgtaagatgattcttaagttttagattttgctgcattcaaattttaaacatggaaaactgtatgctggtcttatgtgcaagcagtgaaacccgtcctcctttcccatgtatgtcggagggcactgttcttttcagttcataggaagcttcagagaaaacgtaactaattcatagataccctttttccactctaagtcttaaacatgctcatctatgtatcccaaatttgtcctgtgtcaacacagagaacctgtcggctacccacagctcaactcttacttgacttttctctctttttttgagacaagagtcttgctctgttatgcaggctggaatgcagtgacacaatcttggctcactgcaacctccacctcctgggttcaagcgattctcctgccttagcctcctgagtacctgggattacaggggcccatcgccacacctggctaatttttgcatttttagtagagacggggtttctccatgttggccaggctggtctcgcactcctgaccacaggtgatccacctgtctcagcctcccaaagtgctgggattacaggcaggagccactacaccaggcctatttgctaccattcgttggcaagaactaaaagcagctgagaggtttcattcgcctcccgaactcagatgtcccccttacatctcacaacctcatccatgccacagtcacagctgccatttccccctttttccttcaaccacttgatgttttgtaatgcaggttacagtcgacaacaactgcgacactgtcctaactccaaaactttcactacttccactttaggcctttgatgataaaataaggaggctgaatcctcagaggtatatttcagcttactaactatatacttagtcttaacttttactactcataaaactccatccaccacttcagtaatattacactgtctcccatttaataggattgatgaattctagtgagttagttacaaatttagactaactatagagtcaaacttctataaaaacaaatgctatttatttaagaacattcaacgtcaaagatattttcatgaaaaactgtttccttagtttagactgaatcttttttgcagaaagggttaacccccatgatacactaggggtgaaactgcaacctgaacactgcagtcccctcttagaagttttctttctgctcccagaacctgacagattctaagatttcctgtctgacacatacgcctcttgtctcctaacccagcaaaaaccaacagcattcttaatttctgtgggagtcctgcaacttcacatatgcagcttgcaccctaaacacaacacatttatcagtcagaaaatcccaaactgaaggattccacaggaagaaaacagaatgtctgaatgacggcgtggagacagcggctggccatttgggaaacttaaggcagcatctctatcttcattccttaagccaaaataacatccagaaatgtcacatttaatctgaaaatgtgaaaccataaaaatgtgaaaccataaaaatgttcaaagaaaatatggctgaaatttttaaaagtacattttaaggcacatgaagaactttaattatgacataaaccctaggagccaaaaaagaacacaactgattaaaaagtggccaaaaaaccacttataaacaaacaacataaactgagaaaaaattctagtaaatattaatatgaatacagttcttataaattcccaagaaaaagaaaaccccatgaaaactgtgcaacaattacagacaattcatcaaggaaaacaagaccaataaatacagaaaaataacttcaaacccattcaaaagcaatataaacccaaatgagacgctaacagagtgacagggaataccgagagtgtgggggaccaggcatccaaacagaccgttaggagaggtatacaccagcaccaactttttgaagaataatgacgttatttaccaaaatgttaaaatctgcatgcttttgacccagaaatttaacttctgggaccagattcttatttcttctcacacgtaagcaaaaatatttgtacgaggacattgtttataaccacaatacagtactactcttaatatacaaaaaaatgaaagaaaaaatctgcaaaacaagcccaactgtctgtcaaggggaagctggtttaaaaaaaatgttacctttcttttcttttgttgtatctctgccaggctttggtatctggatgatgctggcctcataaaatgagttagggaggattccctctttttctattgattggaatagtttcagaaggaatggtaccagctcctccttgtacctctggtagaattcatctgtgaaaccctctggtcctggactttttttagttggtaagctattaactattgcctcaatttcagagcctgttattggtctattcagagattcaacttcttcctggtttcgtcctgggagagtgtatgtgtcaaggcatttatccatttcttctagactttctagtttatttgtgtagaggtgtttatagtattctctgatggtagtttgtatttctgtgggatcggtggtgatatcccctttatcattttttattgcatctatttgattcttctctcttttcttctttattagtcttgctagtggtctatcaatttggctgatcttttcaaaaaaccagctcctggattcactgattttttgaagggttttttgtgtctctatttccttcagttctgccctgatcttagttatttcttgccttctgttagcttttgaatgtgtttgctcttgcttctctagatcttttaattgtgatgttagggtgtcaattttagatctttcctgctttctcttgtgggcatttagtgctataactttcactctatacactgctttgaatgtctctgagagattctggtatgttgtgtctttgttctcgttggtttcaaagaacatctttatttctgccttcatttcatgatgtacccagtagtcattcaggagcaggttgttcagtttccatgtagttgagcagttttgagtgagtttcttaatcctgagttctagtttgtttgcactgtggtctgagagacagtttgttataatttctgttcttttacatttgctgaggagtgctttacttccaactatgtggtcaattttggaataggtgtggtgtcgtgctgaaaagaatgtatattctgttgatttggggtggagagttctgtagatgtctattaggtccgcttggtgcagagttgagttcaattcctggatagccttgttaactttctgtctcgttgatctgtctaatgttgacagtggggtggtaaagtctcccattattattgtgtgggagtctaagtctctttgtaggtcactaaggacttgctttatgaatctgggtgctcctgcattgggtgcacatatatttaggacagttagctcttcttgttgaattgatccctttaccattatgtaatggccttgtctcttttgatctttgttggtttaaagtctgttttatccgagactaggattgcaaaccctgccttttttttgttttctatttacttggtagatcttcctccatccctttattttgagcctatgtgtgtctctgcacgtgagatgggtttcctgaatacaacatactgagaattttagaccaatatccttgatgaacattgatgcaaaaatcctcaataaaatactggcaaaccgaatccagcagcacatcaaaaagcttatccaccatgatcaagtgggcttcatccctggatgcaaggctggttcaacatacgaaaatcaataaacgtaatccagcatataaacagaaccaaagacaaaaaccacatgattatctcaatagatgcagaaaaggcctttgacaaaattcaacaacgcttcatgctaaaaactctcaataaattaggtattgatgggacatatctcaaaataataagagctatctatgacaaacccacagccaataacatactgaatggacaaaaactgaaagcattccctttgaaaactggcagaagacagggaggcgctctctcaccactcctattcaacatagtgttggaagttctggccagggcaatcaggcagcagaaggaaataaagggcattcaagtaagaaaagaggaagtcaaattgtccctgtttgcagatgacatgattgtatatttagaaaaccccatcgcctcagcccaaaatctccttaagctgataagcaaactcagcgaagtctcaggatacaaaatcaatgcgcaaaaatcacaagcattcttatacaccaataacagacaaacagagagccaaatcatgagtaaactcccattcacaattgcttcacagagaataaaatgtctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagctcatatggaaccaaaaaagagcccgcatcgccaagtcaatcctaagcaaaaagaacaaagctggaggtatcacactacctgacttcaaactatactacgaggctacagtcaccaaaacagcatggtactggtaccaaaacagagatatagaccaatggaacagatcagagccctcagaaataatgccgcatatctacaactatctgatctttgacaaacctgagaaaaacaagcaatggggaaaggattccctatttaataaatggtgctgggaaaactggctagccatatggagaaagctgaaactggatcccttccttacaccttagacaaaaattaattcaagatggattaaagccttacatgttagacctaaaaccataaaaaccctagaagaaaacctaggcaataccactcaggacataggcatgggtgaggacttcatgtctaaaacaccaaaagcaatggcaacaaaagccaaaattgacaaatgggatctgtttaaactaaagagcttttgcacagcaaaagaaactaccatcagagtgaacaggcaacctacagaatgggagaaaatttttgcaacctcctcatctgacaaacggctaatatccagaatctacaacgaactcaaacaaatttacaagaaaaaaacaaacaaccccatcaaaaagtgagcgaaggatatgaacagacacttctcaaaagacatttatgcagccaaaaaacacatgaaaaaatgctcatcatcactggccatcagagaaatgcaaattaaaaccacaatgagataccatctcacacctgttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaacgggaaacaccatttgacccagccatcccattactgggtatatacccaaaggattataaatcatgctgctataaagacacatgcacacatatgtttattgcggcactattcactatagcaaagacttggaaccaacccaaatgtccaacaatgatagactggattaagaaaatgtggcacatatacacaatggaatactatgcagccataaaaaatgatgagttcatgtcctttgtagggacgtggatgaagctggaaaccatcattctcagcaaactatcgccaggacaaaaaaccatataccacatgttctcactcataggtgggaattgaacaataagaacacttggatacaggaaggggaacatcacacacaatgggatattcaatattcaatagcacacagtgtgccataaagtgagtgataatcaattgtttttcatctcttccatcccagacacaaggccaatccagatgaactgctgttgccacagtctctttcagtgatcttaagtctccaagcccagctcctttgaaaatacggtcttgcctttttatgggacacccactattacagacagaagacatgaaaccagtcaggctgcctggtaaaacgtcactgaagatcagtctctaggaaggaggcaaagctgaatgtgctacaaaactattatttgtccattttactttacagatctcatatttgccccaaatcaacactaaccagagatagaatactttagttatatagctgaaccattcagcaggatgacaggaggcataatcatgtcagcatggctagattttggccctcacaggcccctccacctgcccaaaatgacaggagtctcacaattactgtcactgctgactactagccaatgggtgcgtaagcagtggcaggtataagattttgacatttttccattggcactcttatttagaaaataagatattctttagatatcaggccaattctttaggtatcaggccaccataattggtaaataatgtaattgttcttcaaaaagttagtgacagcttaaacctctcctcatggtctgtttaccattggtaatcactgtcaatctgttagcatctcattttagttcatatttattttgagggcagattgactcatactatttaatctgacttggaccctcactaatatttggtatggttgattctgttttccaggggaaaactagacaggaaaaagtaacacacaattcatgtagcaatggaataaacaagctcactaacacaataagttaaaatttaagtgattaaaaagcccatgcctctgccgggtgcagtggctcacgcctgtaatcccagcactttgggaggccgaggtgggtggatcacctgaaatcaggagttccagaccagcccggccaacatggtgaaacctcgtctctactaaaaatacaaaaaatagccaggtgtggtggcacacacctgcaatgccagctactcgggaggctgaggcaggagaatggcttgaacctgggaggtggaggtcgcagtgagccgagattgtgccactgcactccagcctgggtggcagagtgactctgtgtagaaggaaaaaaaaaaaaaaaagcccatgccccacacacaaacaaaaccatttacaatatttctcttgacaacttgctttaagttgccaacaacaatctggttatggaccttgtcattataaacataaagattttttgtttttttttaaatcggcaaattctatgttgacaaatactgtaatccagaaatctgcttttctacttcatattggacaggcaactaaagtagtcacattgaacaaggatatgccccaccttcaagaccagctgctacaatgtgaagcctgacaaagcttctatgacaatatcatcaccaacctcaaactggaactaatagaaataatcataatggatatacacgaggattaaaaattcaagtgtgcagagtttaagatacttggctatataaagtttaaaatactcaaatatatctttatgtatatatacttgtctatatttcatatttttcaagaggctgaatctcctgaagaaatccaatatgcacccctaccccgggaaaaaaaaacaaaaaatgaaaaacaaaaaagtctcctcatctcagtgtaatgccagacactatttggaaataaacacaccaaggcagttccagtgtcccgtggtccccacctggcacctgcactgtgctctctcttctgggactgcccttccctccctcatgatgttcttggcttgccacctcatcgcagcagaggatcggctccagtgctacctgctcagaggcactgccgtgagcagcctctctaaaacagtcctgtctcttcatcaaatcccaagcaatctctaggcccctcctgtcctgcttgagctctctctctctagcacgatttcctactaacatactatatttttacttatttactttatcttccctactagaatgattctaatttactggcatttacatatgaaactacagtttaatcatttgagggagaaaaaagccaaccttaatgctattctattatcaagcatattcatcttaccaaagaggaaagtgaaacccctctgttaggcaaaacacaaaccaggatgtggctaagtttctacccttcatttctactggactcttgagatcatcaataacccactcagcggtggggccaactcgatgtgaacacagtacacacatccaatgaaacatgggatgtaactggcagaaacaagcacgtacattttttgaagtagagaagtcacaagcagaagctgaaaaaacaattattacatgggctccatagaattagaataaaaatctttgtcaaagctcaacaaaatactgaaattgactgataaactgatcaagcaattataaaagcctaactgtgagtacaagagcactttagggttggttgaggcgaacagaaattaagaagaaaagagagtttaaaacactgcaggggggtaggagaaggttggagggaggcacaggaagccaacaagaggaagcaggagcagacagagatgagaagtgggcagtgagtaaaagacggctccattatctccagggcatgaggaaaatacagggcactttttaaaaaaagtattgatgctgggctggcgcaggggctcacgcctgtaatcccagcactttcggaggctgaggcaggtgaatcatgagctcaggagattgagaccatcctggctaacacggtgaaaccccgtcactactattaaaaaaaaaaaaaaaattagccgggcgtggtggcagatgcctgtagtcccagctactcgggaggctgaggcaggagaatggcgtgaacccgggaggtggagcttgcagtgagccgagatcacgccactgcactccagcatgggcaacagagcaagactctgtctcaaaaaaaaaaaaaaagaaaaagaaaagaaaaaaaaagtattgatgccagtaggaaaatgtgaaagcaagcgtggggccatgagggagtgcacaggtcacatgcccatgactctggccctgctcaccctgctaaggaccaagctgaggaccggaggcgaggcaaccgctgctgctcttcctgcaagaggggccaggcaaatgcagaccatctccttacgtacagagaccctagaaccccgcacaattcacagggcacatcgaggcctgaagacacctttaggtgtgctcaggttattgattttaggcaaaggggagggaggacaacacaccaagatctagaaacaactccatggttgagtatgagattaattaccacagaacaggtgggagcttactaggcaggaaacatacagaattgtgaagttttgttgcagggccataacggagatgatgtgagtcctgtcaccacccagagaagatcctcatggcttcctgagacctatacactctaactgaaatacctaataaacagccgtgcgaaggacagagaggacttttccctgttccttaattgcagtacaaattccatacctgcaaaaaactaaaaacaactgtgttcccttcctccaacctaaattcctctccaggttaaatatttccatttctgtccactgttctacatctgtgcatctgtacctacatcactcttcagtttaccaaagcctctcataaaacgtccaggaccctcagaatgtttagtcccaagtacaacaaaaccgatgctctcccgtgttctcagtactatacttctacccatgcagcctaatgccatgttgcttctctggcactacctcctagtaactcacaacaaacttgatggaaactctaaatctctttgtctttcttgcaaacaccaagtaagtctgctcttctataacctatactttggcagtttttttttggtggtttttgtttttttttttttgttttgtttttttgagacagagtctccctctgtcgcccagactgaagtgcagtggcatgatctcggctcactgcaacctccgcctcccaggttcaaactattctcctgcctcagcctcctgagtagctaggattacaggcgtgcactaccacgcccggctaatttttgtatttttagtaaagacggggttcactatattggtcaggctggtcttgaactcctgaccttgtgatccgcccacctcggcctcccaaagtgctgggattacaggcgtgagccactgtgcccggcctactttggcgttttttaagtgataaagtacaaaactctacattttcttatgctacattttatcttgtttttggcctactactcagttcttgaatttttttttttaagttctaaaagcgaatgtgtcattagtctggtttttgattatagagattcaaacttacaaaacgctccttcatattacttctcagctttgcaacgcagggccatgtcacttaaggaaaacaccttatatctcacaagaggccttctagaattgtagtcacctgccgaatttccaagatccacagactaatcctcacagggtcaacaaaacaatctattaatgaacagagccatctctggagtcagtttcaaagaactgaaccattggactaaaaccaaaatgccaactcgacaatgttaagtgaaaattataacctcagagaccaggagatgttagaatcctggggccgatgtatgtgcccctcccacaagccccacaaacaagtcatgttggaaactgatataaaccaaagggacccagatgatgaaatcattggctcagtgtgttccctccatgtaggcatgccacacagcaaaccagctgtaatccaatgtttattgagcaaagaaatcaaagcaactggtcatctaacatatatttaacaacatcagggtaagtttgtcttgtgtatcattctttacaacagggttatactctaggacagtagagtactaagggtactctaggtggtacattggataaacatcatcactttcatgaataaccaactcccttccggcaatcccacttcttaacgagatgtactagaattccaccagactgtggtcagattcagctggccttggaggtggttattctgttctacaagctctggagtcacactggttgagttcaaggccaagctctactgctttcttttctaattatgtgatcttcaacgagttacttatcttttttaaacttcaccacataataagttacccatcttttctaaatttcagtattagtttcactatagcagatgtaacaaattacaattacaattacacttaccagtggcttaaactaagataaattatagttctgtggactaaatgaaggtgtcagaagggccacatttcttctggagactctagagaagaatccactccctggccttttccagcttctagggaccacatatattcattggcttgtggccccttcctctgccttcaaagctagtggtgtaacaccttcaaacctctctctagttctgaccaccctacctctctctttcacttaggaggccccttgtggctacatcaggcccaccttacccagataatcctggataactgcttcatccccaaatccttaatcacctctgtaaagtctcctttacaatgtgcggttacatatttataggtctggggattggaatatggacactgcggggggcgccattaatgtgtctaccccagggctattacggtatagttttaacactgatttgacgttaaccagttgaaatttaatgaagcaatacgattttatcttaaaattttgaacactgttacctaaggaggacatggctatttcaatgcatagttcacactaaaattagactgcatttttctatttcagttttcacataaaacgacatgcatttgatttatcagtggagggtaaaaaatagaagagttaagccatcaaaatctttacggctttaccaattaatacgggactaattaaacaacaaattagctagaatgaagttaatacgtaaaggacaatctgaatgtttggttgagctttttctactagaaacaggaaaccacactgatctggttttcaccttaccccactggccagaccttcgcactcccctttgctggattcttctcctctccctgacctctaaagccccagtgcatccaggctcagttcccaggccttcctgtctacactcactcctgtgggaaagtcattcaatctcagggctttactatctgtgctgacgctccagattttataggtctcagtcagacctctgaactcccgtctccttcatcacaactgcctatttgatagcccatctcagatgtcaaacaggtatatgcatatttaaaaccaaatgcctgatcttccgaatgaccagttctagtagtacatctcattaagtgggactgcaggaaagcagttgtttagtcatcaaagtgaggcagttttaatgatgtttatccaagtaccacctagagtacccgcagtactctactgtcctagagtataaccctgttgtagagaatgatacacaagatgaaattaccctgatgttgttaaatggctgttcattaaacacctattccatcccattaaaaatcttcacatcatcctttccaactttctttccctcacatccattatgcccatcagctgaccaaattagctcaaccttcaaaatatatccagaatctgatcaccttaccacctccactgtcaccatcttcagccaagccaccatcatctcttgccttggtcactgctaactgatttccttttaaccttgttcccctggcttctttaataaagcagccagaaagtctttttttcaaaagaattaagatttttggtttgttctgttctctcttgttaactgaggtgaaacttacacacagtgaaattaagcacatcttaggcttcaattcaatgactcagatgcatccatgtaatcaagagcccaatcaagaaaatacttccaactttgggctatgatgaataaaggagtttcttttggagtgatgaaaacattttgcaactagacagaggtgatggttgctcaacattgtaaacatactcttacacgccactgaattgttcattttacaatggttaattgtatgttatgtgaatttcacctcaaaaggctatttctgtgagaaaatacctaatacccctgatgtaaaaagctaaaagttttatcactgcagttgtatcactgcaggagtcaggtacttaagagatttttcagttttattgatggtacttaacaacaacaaaaaaatattataaccaccaaatgtttcttgagtggttcacccttggctttaaatgttatcaaacagtggagagctgctctccacttccacaggaggaccattagatgcccatcttcaagagtcagtaactaactctagaacccaataagaatattcatggtacacgaacagtcacagaataccatgcgctgttaagaagacgtttcttaaaagattatatacacttagtgtcagacactttaaatgttataaaaccttgattctaccagaatttaaatttatcataaatctataatttaaggattttgcatttgcatctaattttttaaatcgatgtgggaaggaggacagggaaacaggacagagggatcttttctatccagccaagccaactgtctttaaagcataatcctttccattttctgcaagttcacaataaatgtgtgaagacaattcaatcttcacttttttaaaaaccaatctcagctgcttgatatataacaggagatgaggaaaaacgctatctgaggtacaaagctcaagtgtcaatctgaattcttagttccagattgaatgggaaatccctatcacatttcttacagagaagatctgacaataaagcgctgaaattaattctccaaagccacagaaaggtaatctcattacatactcaaaacacacacttctgaaaagacaagaaggtccttttcacttctagaactagacagtgtttggcatttaaggaaataacactattttgtggctggttgtgtgtatgtgtgtatgtatttagggttaagatgtgtgcactcagtttacagtttaattttttttaatgcttccaaaatgatagatttttcagcaaatagttaaaattcagttcctcttcacttactggtcaagatctaagttcgggatttttacgttttccaaagcacaagtgttttatcgccatatctacactaagccacgtagtagtctggttggtcttgaaagtatccatccacgctccttggaaccatcaggatcaggggcgagaaccgggacgtgtgtgttacacacagacagtgcaatggacaaaaacaacaaaagatgggttcattaaaagtctgcacccaagtgccgtagtctctgtagacttccttaggctaaagggctaggggctgccaactatggctaagacggccttttctccctcgccggttttttttttttttaagttaactatccccacctaaggatgatgtaaaaggccactcaggagctggtatctccttcagacaaaggtacagattgtgtatcttccatcacaagccaagggatatgctgaacaaataagaagtacgacagatgccacacagggggcctttgtaaagaacactggacccacatatgtgcacacctcccagaatcaacacagaccttcaggactccagtcccttaagtatatgccacttgactgcagcaatggtaacagtaaccttgcagagcagcaaatgtgtccccaaatagtagattttatagtcaaactacctaattctgagcagaagaccaagaaatgatgtcatgacatcacatacaatataagcacatttcataaatcgctagttatgtaactgaggaccctgttttagagattctgtcccgggggatttctcttctagctgtggatggtaatccttgttcacagccacaataacctcaatgcaaaaaaacactctaaatacttggcactgtattgaattcagcatttgtacactctggttcatctcagtgagcctctttcattttccatagctttatagttcccaggctttttctttatttgttacacagatgattcaactgtatcctatttctgtttcatttttggttcttaatctggattatgcctctttagcttcctatgtggaactgtgtgtgaatttaggaactgaaatttactggaaagatgtaaaatacaagaaagagtaattaacatagaaggcatgatgaaatcattttttttgagtttttctttatttatgatgttaaagaagaaaattcctgagaaacatacttaaacttcatgatgtaaataaagctaacgttttaaaaaatatttctgtatggcttaaaagcataaaattcaaaaagtgaacaaaggtacacaataaaaagttttcctttcatccttgccattagccgccagttctcttcccctgaagtagtcagtgttgtctagctctccttttccagtcatgcaacacattcacaacaatattctggtcaatgatggaccacatatctaatggtggtcccagatgattatttataccatatttttactacaccttttctatgtttagataggttagatacacaaatacttacctttgcattacaactgcctacactattcagtagagtaacgtgctatacaggcttgaagcctcagagcaacaggctataccagacagtgtaggtgtgcagtagactataccatctaggtttgtgtatgtcagtccatgatgttggcacaagactgcctatgcatttctcagaacattattgttaagtgatacatgactgtgtatgtttttcccctagtgctgctggcccgaagagccattatcttctctgcattctgtgctctgatacagtgggtctcaaacttcagcactgctgcactccactgacccgagattctgatgcagtaggtctggtgcagcgccctaaaatttgcattcctaacaagctcccaggtatgccaggcccatactttgaaaagcctgatctcataaaatcaagtaatcagttgtctttgagacaagttatcctcaagatcaaagtgaatgcatcacagtcacaggtggtacttacagagctactgtctaaacaacactattctacagtctgtactagtttcctcttaaccaaacctaaataacttactttctttctttttctttttctttttttttcccccagacggaatcttgctctgtcacccaggctggagtgtggtggtgcaatctcggatcgctcactgcaacctccgcctcccaggctcaaccaattctcctgctcagcctcccgagtagctgggattacaggcgcccaccaccacgccaggctaatttttgtatttttagtagagacggggtttcactatgttggccaggctggttttgaactcctggcctcaagtgatccacccacctcgatctcccaaagtgctgggatgacacgtacgagccaccgcgtctggtcaactttgttacttaaagttctatgtcatacctggcaatggcctaatcttcaacttttactttcttcatactggctctgtcccttcattcatacacacacacgcacgcacacacacacacacacacgcacattttttttcttggaagactttttttattacttacatttcttttcacctgtaatgctttgtatgatgtgtgaaaaaaaaaaaaatcttccaatggagatgccagaaataaatgctctaaagacaaaagttgcttttcaatttagactaaaaagatacaagtaaaaaagaagagttaaaaataaatttacacatttttgagatcaaaaatcttgtaagaaaaatggcaaaaagtaattcatttgacatctaatgttatagtgaggagacagtgagtttcaagttgtactgcaaagcaaatatatgaatatagttggctttaaatacaagcatacaagggagagggtgtgggtacgaggaattgaaacctaaacgcacatttataaaaagcttatcgctttcagtcatcagaagtaaggtatcaaaacatgatcattgctctgtttgtaaccagctagaatcacaggttgacagatctacaaaaatacggcgtcagcttcacatcaggccctcctttgtgagaggcaaggtggaagtgcactgtagcaataatcgttcctctgtcatgattagggcctctgagctggacctaactcagaggaccctggggcacagcatgtgaacaatacccttaagatctgcctcctggagagagggcaaaaactaggaggagaccaagctctccttaggaatgtccaagacctttcggagtatggaccttgaactggcgggaatgctgtttctctcagagtacacactctccggggagactgaaaaaggaataaatgctaacacagtacaggctaggactcagcaaagaattgtgtgtctaagaatagactaacctttgctgggaaaagcatgctggcagggctatacctcctcctttggaaataggcaggtggctgaaataccctatgttgaaaatcctccatgtcctcaatagcctgattccttttaagaccaatgttacttccctaagaaatgtcaggtcttacaaccaccccacatccaaaacataattaactctatgctttccattatatcatagacctattcagaccatgtcggctcctactaaaacccagcaagacttcctcccatttatggaataaagtctaaaccccacaactttgtctatggtgctattcatgagctggtctcttatgtttttgacctgatcttctatcaaatagcctcatcctgcaattacttgcacttcccctaatgcatccttcaggcccacagccctgagccccagaacgtgctgctgttctatataaatggccttcatcaccacaccctggttcctggttcatttggagaactcttacactctacattcaaaacagccaagcttcccttccttcatgacaccttccttgcccacccttaccttctcctctatgtccccaaacaaccctctcccacctctttcatagcactgatcacagtgtgtgttactgttgtccatctggattacctccctttccataccctatcccaatgccttaagggcgtggaaaacaaagacttctgtcatatgtatctttggccaagattaacaaaaatgaaaatatctgaaactaataagtattagcaaggatacagagaaaagggtagcatcatacactgttggacaacttggcattgactactccaagtggaaacactgcacaagttacaattctatgcactcatttctgtctcctaggcacaatggcaggcattcagtgggtgccatatgaatgtgtggcatttgttaagatttttaggaaactgaaacacagaagacttacattttgtatatttttatattttttggaaaagagattggatggttctttttactgtgagttggagtgtaaactggtacaaccgtttatgaaggctatctgaatacacacacgcacacacacacacacacagccccaaaagaaattaacctaccagcgaaataatcatggacaatactatattcacaaaaatgtattccgtggtgttatttgtaacagcaagaattagaaaaggcctaaatgaccaataatagatcaactaattaaactacagtacaaccacataaaatgctatacaaccatagaaaattatgtcataggatgacatttaataatacagaaagatatttccattatactctgctgaagtaaaaaggctggctacaaattttgattgtatttgtttattttaagtatataaatgtcaaaaatgcatagaaaatgcactaattttttttttttttttgaggcggagtctccctctgtcgcccaggctgaagtgcagtggcacgatcttggctcactgcaagctccgcctcccgggttcacgccattctgcctcagcctcccgagtagctgggactacaggcgcccaccaacaagcctggctaattttttgtatttttagcagagatggggtttcaccatgttagccaggatggtcttgatctcctgacctcgtgatccgccagtctcagcctcccaaagtgctgggattacaggcgtgagccaccatgcccggccaaaaagccctaaattttttaattgacaaaaatattgagtttctgccaccctgtaatttagaatctaccccaggatagatagaataaagttaccaaaagttaatcatgatttacttacagtttaatattgctatctttaaatatcattgtaacaattaggactggaagacccaaagaaagatgacttttactatagtttaaatagttgatctattatcggtcatttaggcctttttctaattcttgctgttatcagatattaaactatattctaaaatcacattaactaaaatagtgtggtatgaacagaggaacagaaaatgggtgaattcatgaaaaaatgtctgaaaacatgtacatgtgtaatttctgaggtagaatttcaaataaaaggagaaaaaaattaaagaaggaaaaggagaaaaaagtgaaaaaaccaccatacagaaaaaaatttcatataaattcaagatctaaataattaaaaaagaataaaaggaaggaaggaaggaagactaaacaagataaaaatacagaaaagtacatttttaaaagcagaaaatatttctcccaaaatgcaaaaaccacttaaaaaggctgataacattttaaaggaatagattaatatattgtttatataactcaaagttaccagtgtttcaacaattctaagaggcattcttttatctatggaattgagatatttcttacaatagatggcaccttataaattattgccattttttttctttcttagaacataaaaactagtgcatcccaccaccggaagtatctgcgaggcaataaaaaaggatgaaaagctttatgggactttacgtataggacttacatgctggtttcctccattactagggactgaatgtttatgtctttcaaaaattcctggcctggcgcggcggctcacgcctgtaatcccagcactctgggaggccaaggtgggcagatcacctgaggtcagttcaagaccagcctgaccaacatggcaagaccctgtctctactaaaaattagctgggtgtggtggcgggtgcccgcaatcccagctactcagaaggttgaggcaggagaatcgcttgaacccggggggcggaggttgtggtgagccaagattgcgccattgcactccagcccgggcaacaaaagcgaaactctgtctcaaaaaaaaaaaaaaaaaagtcctacgttgaagccctaacccccattgtgatggtacttacaggtagggcctttagaaggttattaattaggtcataaggatggagccctcatgagtgggattagtaccctatcagtagagacaagagggatgatctctttaccacgtgaagacagcaagaacgcattccctctgccaaccaggaagaggtcttcaccaggaccaactcggatggcatctgaatcctggatttcccagacctcagaaccagaaggaatacatttccattgtttaagccacccaggcaatgatatttctgttataaaagcccaaactaagatacccacacagagaacacctacacacagtgtggttacaggttgcatcatttctttttctttttcaatatttgcatattctctaaattttctacaatgacccaccacatgaattcttttaaaagaaaaaaatggtaaatatgaaatagaatagtagtgttgacccttaagaggaaaaagatggtagaagacactatgttgcttacagtagactacaaatgtgcgtgaaatttgtaaataaaagatgaatacttataaatgtcaccacctccctctctgatgtttctgaaaccagagcatatgtggttaaccttgctctagctccagtccatccatccatcatcatgctaaaacatacagctgtaggcagtggagaagagctgtatgtggtgaggaaagcgggagacaggaattccagaaatgtctactaaagcagtgctttaagttttaatttattcaagaaaccaatacatatcagagcataagtgagaaaaagaaaacaattataaaaaatacaaaggagtccaggataatagaaatctttcttcattcacatattctagctagaatagtgagaagaaattctccctcaaacgtggacagtcccttacatcttcagccgacacggaagtcttatctgagaatagaatctctgctacactaacctaggagacggccaggcaactgctgcggtatacccatcaccccagtgttctggaagaaaaagacagcagggagaagttctctttagaaccagctcttctacaccaaatgaactcaggagacaatgaatggaaacaccatgccatggtgtgagcaatgcaatgtggagcacaagcagcggagagtctgctgaagaagctactcccctgaaataggaaagaagaaaaccagttggctctgaatcgaatcctgctccggtcctctttctctttaccatttccccttaaacctcaggctttctgaactgcaccgcaactctagaatcttcaattaaggcaaatgaggaaataatggaaaaagactgatatattaaataaactaaagaataagacttaggtccaaaatcctatttcgtgacacaactcgaccttgatcacagtaaacccaccaggctcattctctctaatgccctgatgaagccgtcagcaaccccttctacctcggaagacatcagagcagaagggtgggatcctccatcgctgtcttcaacgtaaacaacattcttagggagaatgcttgcctctaccatggaatctgactacatgctataagcacctgctcaaacctgactttaagacccattccagaaagatattataaatgcaaagatcatacgaaaatcctgcaggtacttcaacaatgcatcacctacttaggacacacatgtgtggtgtctcatgttgaaatgttagcagatgataagactctcccaccatcttctcccattagtatgaacaactatgagttagaaccaccttactgagggaagaggacactggtcaggcatctatcataaagaaacatcaccacattttataagcaagtttctagctgttaacaattatcattcaatatagcatactgtaggtacccaaactgctagtgaacaagtgctgtgatttaatgtctgtctctactattggctctcagatggtttggctacattagttttccattctatatttgatttcagattcctactaaaataattaagtggagaaaccattaagaagcaaaactgtctcttatttaattttaatcctccctcctgggccttcctcaactccatgcaacaaaggttgcatcagtttttttaaataatcagttttttaaaacatcaaaacccaaatattcttacaaccaagaggtcttcaggttgatgaaaatggggagattatgattcctacagccagaaggacagttaaattcccagtcctctgaattttcacaaaatgactaattttatttgaaatgttctatattctctaaacaggcaaactatataaaacaaataacttatgttccaaagccagaatatttttacaatgaagttatctgggccatttcaccggcagaataaaaaaaaaaaaaacctgacctcaagatgaaattttcaacaatattcatattcactaatatatagttagctagttgccacattctggataattttcagtaacttgttaatgattaataaaagcaattagttctctaacccactctatggcaatttcagaataaaaccattaacctttaatagtaaatgcaaattacaaagctttaacaggcaattttactctcttggcctccacaacaagggtgttattttataaaagatgctttcctccatgaaataagataaaattcttcacttttatgtacaaaactataattttctctaaatgaaatataaaagcagaataagtagcaaaacccaaagtcagacatcatttcttacgtaactcaaagaatcctgtggacagcaaggcacacgcaggtagggaggcagtgaccaggccccagcagtcactgcccctgcaccagccactagaggaggcatgggctctcgggaaggcagaacaccccaacagcctgaggcactcactgaaaagcacagcagacccatttcttgccagcagctgctactaggagggatctggccactccacagagacagggagtgcagtccgagggactagatgagcctcacctcctggaactcggaaaacagatgctccagggctcccgctccaagccaaggcctcacactgaggagaaagtgctgggactggattcaaaaaggagcaaaacagggacagggacaaagaaaaggcaggtaaaactgggagaggggaagcaggaaacctgtacaaaagccacagccgaaggggctgtaacagggcagtgtatctcccaagtctccttccatgagttgaggaaaactagcgtcacatacaaacaagcaccgaaagcactgaggtcagaccccacacaaacttactacgagagaaagatttaagcagcaaaatccccacagacaaggaaagcacactgaagaaaatacaattcaaactgagctaaagtatgtgaaaatgatacaagccatgaacgaaggtaagccagaatgatttcctttttaaagttcaaaaagcgggcaaatctctaggaagtacaaataaaggagaaactcgttttatacataaagattatatggaagacaagaacacgtaaacacaaaaatgctttaagagaaacaggcggctcgaagaagaaaattttttaattaaaaaaaaaaagaagagataaaaagaatgcaagagaagaaatgaatactaaagacaggcaaagaatacctgaaacagataacaggagtctctgactataaaagcaacaatgaagcaatggaacaggacaaatactgaagactacaatccaagaaacgttttccgaatgaaaaacgatctgaagctatacactgagagaacataccacctatctaagcctatcaaccacaaatggctaacaccagattaagaaaaagtcctttgggtatcgaggcaaaaagaccacatgacttacagagggaaatatcactgcacatttccagcaacagtttatgccagaaggaaacagagaaagagagttaagatacttaaggaaagaaaatacaagccaataattttatctctaagtaaagtgaccttcaagtatcaaggggacagttatcactagacaaggattcaagatatgttgttcttaagaacccttcctggcctggcatggtggctcacacctgtaatcccagcactttgggaggctgaggtgggtgggtcacgaggtcaggagatcaagaccatcctggctaacacggtgaaacccggtctctactaaaaatacaaaacaattagccaggcatggtggtgggcgcctgtagtcccagctactcgggaggctgaggcaggagaatggcgtgaacccaggaggaagagcttgtagtgagccgagatcgcactactggactccagcctgggcgacagagcgagactctgtctcaaaaaaaaaaaaaaaaaaaccttcctgagaaacctcctagagaataagcttcagaaaatcaacatcactccaaagacatatatgaaagactgctgtgagtataaactgattacacagttacttgcagaatcaagttaaaatgagagttaagaggcagagattacaacacgtaatggttacacgctaagtcgacatggtacaacaattaaacacacaggagaagggggagaacagatgcaaaagactttaactgtattcagtagtcataacggaagctggtagtactagtactgttattcagagacttcctatgtgtattgtgggacaaagcaaataagtaattctataatagtctatcatcacgtgttatgcactgaatatgtccctccaaaattcctatgttgaaacactaatccccaacaccatagcactgggaggcaggatccttgggaactaattaggtttagatgaggtcatgagggtagaccccccatgatgggattcatggcctcacaagcagccttaactaaggcaccatgtgaagctgaaagccaggattctcagtgtagaaaaaagaaaatagagctgtaatacataagagatgatgcaaatgacctgcggtccttagaggataggtggcttgcaaagagaaacaagtcagacgcatactcttgacgtggaccccagctctgaggactcccagaccagtgctcttggctcagcaactaggctccagttggttacgtcactgacggctccacagctctcccccaatatgagtgatcgtgtgcccagtatcaggagtggaacagcagctcctgatgggagcctatctgtctccatagcccttgactggtgaccctagccacactctcaaaaggatgacaactgagagggaaaaggtcctggagcataaccaatctatgctactagaaggtaggacagtaattatctttggtggagtagggagcggggagtgactggggaggggtctagggtgctggtgatgttttctttcttgatctggtaactggttatagggatgtcaccaaattgtcactctgaaaattctccaagctggacacataagatttgtccatttttttctgtttatatactacattccaaaaaaaaaaaaaaggaaaaaaggaaacaccaagacaagttgttctgaacttgaagtaaaaatatcagtatgaactcaagatgttttatttttatacacacacatacatttcagccctctctactgggaaggcacagaagcaatgataaacccagtaacaatttgcatccagcatctatactcaggtcttgaagcatcatttccaattaaataaaactaggacttctttgaaaatggctgattctaggcctgggcaagatatgtagataatgaacctgaaacatcttgacataccagacagcaagaaagctataagggcttgtaaggtctgatcaaaaggactcaggagtcaatttaaggaggctccctttggccaactgatacagtttggatgtttaacccctccaaatctcatgttgaaatgtaataaccagtgttggaggtgcggcctggtgggaggtgtttggatcatgggagcagatccctcatgaatggcttaacaccatctccttggtgatgagtgagttattgctctgagttcacacgagatctgattgcttacaagtgtgtggcatccctgctccttgctccagctcttgccatgtgagatgccttctcccccttcgccttccactatgactggaagattcctgaggccctcaccagaagcagaagctggtgccatgcttcttgtacagcctgcagaaccatgagccaattaaacctcttttctttagaaataccccatctcaggtatttctttatagcaacacaagaacagcctaatacatcaatgatggaacaatgtgagcttcaatgaggatgagaatgacaatgaattgtaacttgtcgactatgctgaaagctctgagatcacaacgatttttttaaaaaagaaaagaaatgaactggtcacgttctaaggatgacaggaaatcaattcattattttgaaagctgtgtaaataaaaggaaagaatcaaatattcatcttgactttcctaaataaactcaacaaccaaatagataaggagaagcatcttcttatacaattattccagttaataaatgaaaacagaatgacaaagtcaaataccaccattttacaatccttaataaattaataaatctaggcactgagcatcaatagctaacataaaaaaaagaaacaaagaaagaaagagtgaaaaccagacgatacacattctgataaaaaacaaacactactcaaaactctcatgaagatcagcagtagtactgtgcctgtgaatagcctctgaagtccagcctgggtgacatggcaagaccaagtcccttctttaaaacacacaaaaaagaaaaacacactacaacatataattgtgctgaagggattaaatcctaatccgacaatgtaactgcattctgctgccaatctgcagaaaacacaagaggacagaggaatatgttgaattacaccagcagagcgcagactgagaaacaacattaaatagctggagtgatacctacagattaggagacttaaaagacacagtctaaaaacattaccaaaaccaaattatttagtgtctagaaatgtatgatggggtgaaggaactataaagaaatgtaaagaagcaactactaggaaaatcagaagagtggttactttggaggaagggaagggattgtgattaggatgggacacatacgggagtttctaatttcctgctgtggtcctggatggtggctaaaggggattcactttacaataatccgctaagctacttcattcgactctgagggctaccataacaaaatactgcagactgggtgacttcaacaacagaaattgattttcccacagttctggaggctggaagtgcaagatctaggtctcaaatgggttgttttctcctgaagtctctttccttggctcacaaacagccaccttctccctttgtcctcacagggcctttcctctgtgcatgtgtgtccctggggtctctccctcttcttttaagaagttgccagccagactggattaagaccccccgtcaatgacctcgtttaaccctagttacctctttcaaggtccaaacatagtcatactgggggtcagggcttcacatatgaatttgctgagggggcttgagggatgcacaattcagtccataaacgctgtatatatttatttgatgtagttttgttttaaataaaaagtgtgtgtgtgtgtgtgtgtgtgtgtgtgtgtatctaaagtaggcttcacaggtcttctcggctccctcctgaaactctcatgaaataaaggaagaagcgggtataaccccagaaggaaagacagaagtgagaagtgatgatactagatgagagatggtcacatttgagaaagtggaaaggagacagaggggtctgctggagcaaagtcgagaagcaggaagtagactcaaaactcagaaccctaggaagttcaggaaatgaaaggaccacgtaatctggagaccagggcgcaggcacaggatggcgctaagagctcggctggtaatgattttgactaacgagcagtttgagtcccagacgctttcctgcagcagttacctgtgggtaactgtcctccctcactcaggcagatacctcgatatctgctttccaggtatagacccaagtatagggtgagggcaaagtagcaagccgccaagctccttccttctttcctcaaagccgtgcctgaaacattcaaacactaccttccattttgactccgtaagataattaaagtcctcatctccagagccctgccttgttcacatcctaaacaaagacagctcagtttggaggaagggaagggaagggaggggtagggaggggaaaggagagaaggggaaggggaaggagaaggggaaggggaagggaaagaaggaaagggagagaagcgaggaaagaagggagagaagggaggaaggaagggagagaagggagggatggagaaagggagaagggagggaggaagggaaagaagggagaaagggagagaaagaagggagggagggaggaaggaaacaaactacctgagtatctctaatctgaaaatgcaaaacctaaaatgctccaaaatccaaaacattttgagcaacgacatgatactcaaaggaaatgctcactggagcattttggatttcagatttttggattagattttcagatatctacatcatgctcaactggtaagcatgatgcaaatactcccaaaatccaaaaaatgcaaaatccaaaaacacttctggttccaaatgtttcagataaggaggactcagtctgcaccagaaacgtctctaagtctcccacaactaaagataataattttctttgctgaaaaggccaagaaccagaacaaaagatgaagacatccacatcaaagtacattgttataaaacttatttgtagatgacatgatcatctacacagaaattcccatagccgctaccaaaaaaaagtttctgcaactaagacttagcaagattgcaggatatgcaaagataaaaacatcaactgtatttctataaaaataaactaacaaaaatagaaattaataggacaatgacattaatagcatcaacaatgaaacagagagaaatctgacaaaaggtgcacaggaactttacactgagaactacaacataattgctaagagaaattaaagatctaaataaatggagagatacgccatattcatgggtcagaaggtttaatattgtcatgatttcaattcttccaaaactgatctgctaactcaacacgatcaaaatcctagcacactgtttttgtagaaattaacaaactgattccaaattcagataaaaatgcaaacgacccacaatagtcaaaatgattttggaaaggaagaataacgtttgaggacttacatgacttcaagactttataatgaaaaacctagtaataaagacagtgtggtgtgggcatcgagatacacaaaaaggacaatggaacagaatcaagctcggaaatacatatttatggtcaattgacttttgataaaggggcaagggcaattcagtaaagaaagaatagcctttcaacaaatagtaatagaacaactgaatattcatattgtttagaaaacacaataaagcaaaaccagcactctgatccacacttcataccatatacaaaaagtaatgtaaaatggatcacagaactagatattaaactttataaaacaggtagaagaaaattataggagaaaatctttgtgcccttgggcttgacaaagatttctaaaatatgataccaaaaagcacaacctgttaaagaaaaaactggctaagtgtggtggctcatgcctgtaatcccaacactttgggagactggggcagtcggtctgcatgaggccaggagttcaataccagcttgggcaacacggcgaaacgccatctctacagaaagatttttaaaaattagatgagcatggtggcatgtgcctgtattcccagctatgtggaaagctgagttggggggatcacctgagcctaggagagagaggctgcagtgagtcaatatcatgccactgcactcctgcctgtgtagagtgagaccctgtcaaaaaaaaaaaaaaaacactaacaaaatgggcttcatcaaaatgaaaaactcccactcattacaagatattattatgagaatgatatggaaataatctcaatgtccattgtcagatgaacaaataaagaaagtgtggtaaacacacacaatgaaaaaacatttgttcttaaaaaggaaggaaatcctgccatttgtgactacatacacagacctggagggcattatgttaaatgaaacaagccagacacagaaaaacaaataccacataatctcacttatatgtggaatctaaaatagtcagactcacagaaacagagtagaatggtagttgccacaagctggggaagaggaaaatggggaggtgatggtcaaagggaaaaaatacagcctgaagctaacaatactgtgtggtatacttaaaatttgctaagaaggtagatctcatgttaggtgttcttaccacaaaattaataataataataataataaataaataaagggggtgaaaggaaacttggggtggtaatggatatgtttatgctcttgatggtgttaatggttccaagggcatgaacttatccccaaacttatcaagttgtataaattaaataggtacagctttttatgtgtcaatcatttaaaaaagaacttgtacctagaataaagattcctcaaaaatcaataataagaagccaaacaactcaaaacatgtgcatgaaatctcaacggacacttcactaaagaagatatatggatggcggccaggcgcggtggctcacgcctgtaatcccagcactttgggaggctgaggcaggcagatcaagagatcgagacaatcctggccaacatggtgaaaccccatctctactaaaaatacaaaaattagctgggtgtggtggcacgtgcctatagtcccagctactcaggaggctgagacaggagaatcacttgaacctgggaggcggaggttgcagtgagccaagatcgtgccactgcactccagccttgtgacagagcgagactctgtctcaaaaaaaaaaaaaaaagctatatggatggcaaataagcatatgaaaatatgctcaacatcacaagccattagggagaagcaaattaaggagatgccattacacacctaatagaaaggctggaatcacaacagttgatcttaccaagtgctggcaagtattacaggctgaactgacccctcctaaaattcataggaaggcctaattcccagtatctcagaatgtggctgtatttggagaggaggtctttaaagaggtaattaagctaaaatgagggccgggtgcagtggcttacacctgtaatcccagcactttgggaggccaaggcaggaggatcacttgaggtcaggagttggaggtcagcctgaccaacatggtgaaaccctatctctactaaaaatacaaaaattagctgggcgtggtggcatgcacctgtagtcccagctacttgggaagctgaggcaggagaatcccttgaactcaggaggctgaggctgcagagagccaagatcataccactgtactccagcctgggcgacagagcaagaccctgtctcaaaaacaaacagacaaacaaacaaaaaaaaactaaaatgaggctatcatggtggaccctaatctgatctgactagtgtccttataataataggaaatttggacacagaaagtgacacgggatgtgcatgctcagagcaaagcccatgtaacaaggcaggtggagggcagccgtctgcaagccaagaagaggggcctcagaggaaaccaatgctcctggcaccttgatcttggacttcgagactccagaactctgaagaaatacattgctgttgtttaagcgccccagtttgtggttgtttgttatggctgtgctagcaaacaaacacagaaaggatatgaagcaactgcaattctcagactgctgatgtgaatataaaatggttcaactactctggaaaacagtttcgcagttttttaaaaccttaaacatatacctatcatatgatccagctattccactcctaggtatttatcgaggagaaataaaaacatgtccacacaaagacttgtacacaaatgttcacatcatgtttatttgtaatagccctaaactgcagacaacacaagtatccattagcagatgaatggacaaactggtgtttccatatgatgcaatacttctgaccaataaaaaggaaagaactattaataccacacaacaacatgaatgaatctgaaaataattatgctgagtaagcgaaacagaaaagaagacagtgtgtaattccatcaacgtaagattccagaaatggcaaactaatgtatgatgaaagaaatatcagtggttgcctggaaatgagggatgacagggaggggattacaaaggcacataaggaaactgtgggggtctcaggacctgaatgtttgtgtgcccccaaaattcagatgttgaaagcctaacccctaatgtgatggaatcaggagcccgtgggaggtacagtcatgtgtcacttaagatgggaaaacattccgagaaatgcattattacagtgcacttacacacgcctagatggcattgcctacgacacacctcgactctatatacagcctattgctcctaggctacaaacctgcatggcaggctaccatagtgaatgctgtaggcaactataacaaaatggtaagtatttgtttaactacacatagaaaaaaagtacagtaaaaatacagtattataattttatgcaaccaccgtcgtatatgtggtctgctgtacaccaaaatgtcattatgcacctgactctaattcaaaacatcagatttgatactttacatgttgtctacatctcatgttcagaatggttccatatttaaaatcatactgcatcatacttttgtaatatgaaaaaaatattaaaagctaatgagatgaaaatatttcaagaatgcctatgcttcacgttaaaaaaaaaaagacccactgttactgttgctgagaatgtcaattagtacagccactacagaaaacagtatgaagatttctcacaaaaccaaaaacagaaccactatatatgatccagcaatcccattactgggcatttgtccaaaggaaaagaaatcggcacatcaaaaagaaatctcacagactattcacgatagcaaagatgtggactcaccctaagtgtctgccaacagacaaatggaaaaagaaagtgtggtatatatacatgatgaaatactattcagccacagaaaagaataaaatcacgccgtttgcagcgtcatggatgaaactgaaggttattaagtgaaataagccaggcaaagaaagacaaatattgcatgtactcacatgtgggagctaaaaaattgatctcatggaggtagagagtagaatgagagataccagaggctgggaagagttgggtgggggagagggctggtcaatggatgaagacaggatggctaatggatacaaacacacggttagaaggtgtaagttccaatgtctgatagcagagtggagggactatagttaacaacaatgttttgtgtatttcaaagtagctacaagacaactcaaaatgttcaccaaacacagaaatgataagtactcaatgtcatggataccccaaataacccaactagatcattatacattctatccatgtaacaaaacaccacatgtaccccatgaatatgtaaaatatcatgtatcaatttttaaaacccactgttgttttatgctttatgcataagccatttgtagaaaacaaggtgaaagtaaatttgattacgtaaagtccccttccccccggggttctggaaacttctctgattccatcccattttttaaactggaatatctaactatctggaaaagaggagctggacagaatgatctcttaaaattccttccaggctgggcgtggtggctcatacttataatcccagcacttcgggaggccaaggcgggtggatcacctgaggtcagtagtttgagagcagcctggccaacatggtgaaaccccgtctctactaaaaatacaaaaattagctgggtgtggtggcgggcgcctataatcccagctactcaggaggctgaggtagaagagtcgcttgaggccgggaggcagaagtcacagtgaaccaagatcaggccactgcactccagcctgggtgacagagcaagactccatctcaaaaaaaaaaaaaaaaaaaaaaaattccttccaaccttgaaatcagttatttttttctcctcttttcttctatctcctcaaaccataataaagatgtgtgttgttcactttattcactgaatgctattttgtgctatctttccttaacttaaaattatgttagaattcctcccaagaaaaaataaacccaaactaatatgcttcatataagactcttttgtgagtagcccttaaaatgtgccccttttaccacattccctaacctcttcaggatattcttccagttcctctttctcccccgcaagtgacatactcattggatatttggaaaataataatttttgtcccaaaagtagagaatttctactagtgaaagtatgcaaccttgaaattatttaatttttccttcccaattttaaaccgtatttattgaactttaacccaagttcatgtatactaataaaaatataatcatacactgtgcatttgctaggtgtgtataaagaaaatatttacatttactttggaaaagttttgtaggactgcagaaaattgattaagagcaaagaacatgcacatcatttgctgtaattttctattatttgttctgttgagaatggcaagattttaatcttggttcatgctcagtaagaacagatgtaatataattctacccatgtgaacaagatgtgacatttccctaaaagctcatgctaaaccacgcagcactgatagcagaagcaacggcgcagtctggaagcctggtggattcagagcagatgaacccagagtctcagttcagaaaatccagacccacgatccatttgtcagtctttgaacaagttttttttttttttaattttctcaagcttgttcaatatatccatccacgttcccttctgccttacatccccccgctccgccttttaaaatgctattacaaatcagcttttacgtgttcccagtagctcccatcagcaaggggaagaacaattaataaacctgtactcatactacaattttggctatgtaaaagcaaatgggatcattcttagtacttgttgggaaggaaaaaaacaagtcccgttcaaaaggatattaaactgaagactgaatactacttagagtcaagaagatcacaagaaaaaggcaaacaatagtaatcaccaaacttattaacaaattactatcaaaacaaagcggtcccttttttctcaatttacattaaggtacacaggattttgctaaagtatatagaattcaaataagaatcttaagaaaattttcccagcagtaaaaagtgacactcttgggaatcttagggcctgaatgctaaggacattagtgctatcagctgtgagatacaggctgtggggaagtgtattacccaaacttctctgaagtatttaagggctctttgcttctctacagttgcccttcctgaaacattcagaagaccctcagccctctgattccagaaaacatctgggcatgttgctggccttatctacgccagtcaaggttgaacgcatttttaaagctaagcgaatatactgagtgggatttttaaaaatctagatacataataaatcatgggtaagatggaggaagagtctgaaggaaggaaagaagaagggagaaaggaaaattaaatcacctcaccacataagcataatctgttcctatcaggatgagatgtcttgcccctgaagaactttccctgaacgtttgtcctaataaatacaaattttgaacaaagattctcattctaatatcaataacacccagtttgctttatttcactcatctgtttgcttttgtataacaagtgaacagaactaagtaacccagagaactaaagcgccatgccaagaaatgacatgttgatcctcaactagcttgtggacagagtgtttcttttctggtcattcctttcagccactgatataaacaaatataattatccaatcaaaattctgaatgatgagaagtttcctatgcagtcctaagcatactggttttactttccatagttcagcaaaaatattactggattactggggctttaaaatggcccaagctgtagcccacagatctgcactagctcacagaatgccacggtttggtttgtttctgactatgatcacagagtaatactaacaaaatcttgctatttgaaggaattattaatttttgaattacaattagaatacaattagattattccacattacccagtgaattattattataggtgccaacattcacagtttaatccaatgaagaaactgagcctatataaaaataaccaccaccaaagcagaagaaaagctacgtgaagaactgaactcaatcttaatggttccttcagataactactcccaattgacccaaataaaccaatttactgggtcaagagagagcatgaaggaactaaggactctgttagaagtgaggaaatatggaattactcgtgcatgtagcatgtataacatacagaacaagcatttctgaaaatgtgagcagtatcaataggttggataactttagccccaaaaactctactactactgctttttggaaataattaaaaatatctcaatacagtttataaactttgataaagtcaatataaaagtaataacatcatataaaccggtcttttgctcatttgaactcctgacatggggattataagccataacagatttcttttttcaaatatctgaaatacaaggaataattttctttaaatgagttgcaatataccaaccagtattgggctggtttctgtgatttcctcttaattggtggtagcagcagtaatcctctaattcttaggatggacaactgacttttgaatatctcagtaatgagatctccattctttgatctgctcaagccaaaagccttaagaggtatcttggactccttcctctctctttcttgcatatttgcatccaacccatcaacagatcctcatgctcctttcctcccaaatatttccagactccaaccacttatcatccctaccaccattaccaggggtgaaacgaatattccctctggactactgcaagtattcttcctaattggtctctccgtttccacccctgcccttcaagaccattcccaacataaaactcactgcaatccttttaaaagcctaggtgggtaggaaagaagctggccttgccgagaagagacatctggcctttgccctcggctagtgggaggtaatctgtgtcataactaatagaagtgtccttgtttagggtgggggttggccacactggatcttagggtagggttggccatatgagaaggaccaatcatgtgatttagggtgggagctctggctcacacgataccagtagacatggtgacggagttcaactttgtgggcaatcaatcaatcaaacatgctatctcaggaagctctaataaaaactctagacaccaaaaatcagaagagattccttggttggcaacattccgtgcgtacggtcacacatcagtaccaggagggtaacaatgcccagcctccatggaagaggagaacggaagattcacattagaaccttcccagactctgccccatggcttcctttggcttcctttgatctgtatcttttccctttaataaaccataacaataagtgtaacagctttcagtgagttctatgagtccttccagcaaattgtcagacctgaaggtggttttggaaacaccccaaacttgcagttggtgtgagaagtgagagtagtcttggaaatcacacctcacaactcacagtttggctaatgctggaaaggtatcagtcagtgtattttttacagttttcttgaaaattaagtaagagtttctagaatacatgtaatcctccttttctgttggttccttctctgcctataaacagggtctacccttcaactcttttaagagaaaacaaaagtaccttgtcttctgtcctcttttctttccattgactgcctctaccctcttcaaatcttcccagtagtctacaattcttaagggactcaaattttaattctaaaattctatcatattcttataaatctgctgacaacatgtctactactcctggaagggaaagacaaatcaagaaatataaaatgttttcaagcagcacagcttcatattatccgagctgcgttagagattaaaacaaacagcaatattttggccagaaccatggtttcatcctgaggcccccaaccactggcacctgcttcaccagtcttgatactgcatactcccacaactgtgctcattttacaagctcattttatcactcagaaagattccacttggcttggccactgttaccaaagccttactgtcttgcttcaggcttccaaattttaaatggcactatttaacatttgggcagattggattccttgccttattagttaattacgggtcgagtattccatactggtagtctgatatgtttaaaactgaagggaaaaatttgtttttaaaccagtatgaccaaagactttataatgtgaatattttaaaatctcattttataaagtgaacaagggacccctctcaagagaaaaaaattaataaagacttcacaacagttgtgcattatcttcaggataaggagccttaatggaattcaagatcctcacatgggattcaagaactatatgcacacaaatatagctttactcttccttcaagaggcaacagctgtttgttttatatacagacacagttttctctggacaatttcagcagtatctcagcacacagagtgtaacaggtccttacaaagcaccatcctcatcacttgcagagacactggcactacagaagtctcaatggcctccctaccttactcaaacctcccacccgtctatttttccactttgtcccactccattccactgcagtcaaagtgatcttactcgaaatgcaaacatgatcttctgtcatcaatggctctcttgcattttcaggataaagctgatcattctaaatacaatccacacaagcaatttagtgcaaatttagatcatgtcctccttctctcctgatgcaatgaaggaggcgcctattctgtgtgaactcaacccttccacctttgcaggagctatttcaattacctgctttccttctctactagtgctttccttttatttaaacacattcaagtctctcctgacttgcaacaaaacaaggtcttgtaaagattttgactttatccaattctctttccactctatgccttctcctgcctctctaattttacatccagtcccttccctcttcaccttttactgtggcaaggtcagaatctgcaccaattctgaagtgcatcatgcttctttgcataggcctttgtcggtttttctccctctgttctgaatgcttttccaacttttgttgatttaactcttcctcactcatcaaggcgaaattcaaataacatctcccctctgcagctttccctaccatctcatccaatgtaaaactatgtctgagagcatgcaacacatcctattctatctccccacctgcctgcctcttcagctgggctgaattcctggagggcagacattacattaactgaaatcataagagtttcaaagatctgtgaaacacctaaaattgcaggcagtattttgtgtatcttaatgtttttggagaaaaagtctacagcaaatatcagtttgtcaaagaggcatgtgaccccaaagaagttaaaaattattgcccccaaaattagcacagtatctaacatatagtagacacccattatctattcaattgtcatcaaaatactacaaagtgactgcacagtggtaaatcaaaatatctattttggggtgggaaggggaaagacaaaatcttgcttacagaagaattctaaatgacgtaggtaaatactccccagtccaggaggtgatgcctaacaccccacccaccacagacacagatgcacacacacacacatacacacacacacagagtccttcagggtaggctacacttaggaacttgcttccaaggaagatgggggaaaaggcaaagagagtaactttacagtaggaaacctggcaaacaggattttaaccaagtgacggagatgaacctcagccatgatgtcatgtgactatcacacatgctctaatttgaggtcatgagagggcacttcacctctggggtattgtttccaaaaatccatagcccagcctaataagaaaaatgtcatactaacccaaattgacaaacatcctacaaaatgcctgaccagcaagcctccaaactgtcagggtgatgaaaagcaaggaaagaccaagaaactgttgcagcgcagaggagacagagacatgacaacaaaacgcaagatggtccactaggctgaaccttggaactgaaggaagacacaaatggaaaaactgcagaaatccaaataaagcctggggtataatactaacataccaatgatggtttcctagtttggacaaatgtaccatggtcacaaacaattttaacagtgggggaagctgatgaggtgtatatggatactctgtgctatctttaagcttttctgtaaacataaaaaacctaaaattattttaaaataaaaggtatgtatgtatgtatgtatgtatgtatgtatgtatgtatgatttttagagatgcagtctctctctgttgcccaggctggtgtgcagtggcgtgatcatagctcactgcagcctcgaattcctggacccaagggatgctcccacctcagactctctattagctagggctataggtgcatgccaccatacatagctaattctttggggtttttctggtagagatgaaggtctcaccatgttgctgggctcaatctcccggtctcaagcaatccttccatcttggcctccgaaagtgctgggattacaggcgtgagccaccatgcctggccaaaatgtttatttcttagagtctcttttatctagttacaaatctctgagattcccagtttccaaacttcaaagaattattagcaaacaggccagttatccaatctccatcaagcggcattagatatgttataaagggtgttacactcaaaccaaagcaaaaatctgttgagtcaattgcaattatgaaaattataaattacaacttaaaagttggtgattggtatctatttcttgatgatgaagcttcaaacgtgtaatcagtgacttttcaattctgaaccacccaacttgctacattcaagcatggtgttgtgccaggcaccgggactcagtgaggagtggggaaaggcaataatcaatcgtcagccataatgacaggggaaatacagtgtgcaatggaagcagagagcagaagcatctaacggtctgagcgagattattatggaaggaccaggaaaaatttaaaagtaacacttagaatagggcctgaaggatgagaagcactcgccaagaaaagaggaagactgagtgtaccagagaaagaaaacagcatccacaaagactacaagcaagagaacatgaccagttgttcaggatggctacagctgaaagtgctaggcagggcctggcaagaaatcagacaaccggattttcactctgcttcaggagctgtgcctagaaacttcgccttgagtttctttagctttcccaacaattatggagcaactaaaaacctttgtgtttacttcattagtcgccattgagaccctgaccaacacaatccctcttatgaaaagaatccacctccatcaatagcaaaaaaacaaaacaaaacgtttaaacacaggtctctgtgctcaattctatttatacaatcgtatatccctccagcatgtgcacagacaggaatggcaggcttctaaatgcaaagatgacgaaacggacagacacagctaacacaattttttaagttctacgcttaggttcaagtacatcaaatgcaaaaatataggcagagataagcctaggagaaagggaataattaccagaacactaatcccaccatactgcatacaagccaagaacataaaatgaacctctcagtcttacccttcctgcaactgaggacccgcttgccggcactcagtaggacacgtgattaaaagtgtggcttgtgaggccaaactgcatggttctgaaacctggttctaccatttacaagctgtatgacattaggcaaattacttaccttctttaagccacagtttcctccttgagacaggtggacattaacagtactagctcatgaatttagttggccgtttcaatgagttaatacacatcagctgttactaacatccaccatatattcccagaggggtacccaattctttggggtctcaatgacccttgtccttcaccctctagaaagcatgtcatcagagaataacaaacattatcttcaacttacttgatccactgctgcatataatttaagtaagtcattctcaaaacttactttactaataacatagtctatacaacccccaagtaatgaccacaatgcagtctgttacgacagctatggcaaatactgacctagatcgcgagagaaaagaacagctgctgtcctcacagctgccccgcctcactttctgctaacagacgctgcttctgtatggccatcagcttgccatgtgctttcaggcaggctggacccatccccattccctacatcagcagcatcagcttcaatcaggaacttgtgaaaaacacaaattgtcagtccccaatccaaactagagcagaaactcttcaggtggggcctggcaatctgtgttttgataagtcctccaagtcattctgatgcagaccagtctgaaaactactgaccaagaaccactgaactaataatggcaactgcgtatctctaagtttagaaatggggtatacaacaattctagccaaggaggggcaacttctagaaattttgcttactcttaaaaatgaacacaaagaaggtaccttatctcttctggcctttagaatgttgttgattagagatatgatgcttagacccgctgcagctatctcatgaccccaagggcaagccaaaagcagatccaccacgctgggtccttgatggaatcaagccgataaaataaccaaccaggaatctgcactacctataggagctgctgatatgtgagatattatcacatttcatcaaatgtaagactcatcagtggttaagatgcatcattattttgttaatcatcgtgaggaaaaaatgttgtcaaacaaactgacacaccatgcatttaaatggaccacgtgtctcaatttcagaaataatcacatatgaagaaaatgtacgtcagaaacaaaaaaaaagtaaattccttattgtttcagccagataagtagggattttctgttgtttgctgctaaaaacatcacaatttatttttttaaaaggatattatgttcaattctgagtagtcaataagatgcagcatatacagatgatggacaggaataatggtgagtctgaagctgagatggcctttatggggaaaaaaaaaaggaataatgatggggaatcctgaaataaaaggaagagacagtgaaatatttagacaaagaaaataaataaagtttagaaggaggcatcataactgtcttccactgtctgaggggctccaatactgaaaaagtagactttgtatagctcagataaagcgaggaaaggcagactttaacctctgaatgaaatctaccaatgtaatgatgccttaaaaaatggttcacaggctgggcgtggtggctcacgcctgtaaacccagcactttgcaaggccaaggcgggtggatcccgaggtcaagagatcgagaccagcctggccaacaggctgaaaccccgtctctactaaaaatacaaaaattagctgggtatggtggcacttgcctgtatgtagtcccagctactcggtaggctaagccaagagaaacccttgaacccgggaggcggaggttgcagtgagccgagatcacaccactgcactccagcctgggcaacagaacgagactccgtctcaaaaaaaaaaaaaaaaaaaagaaaaaaaaagggttcacacattcagaaacagaataactacttcaaaaattcagggtgtggctcctgtactggttgtgaatatgggcccttctaaccttaagatttttaagattccataatattataaccagattagaataaagcaaagttaagaggacttgttaaaacatccagtcaaatcaaaactgccaacaggaactgatctaggcagagtacctggtagaaattaaattcaagaaatcaaagatataggatggaattcaaggaaccaacacaaacgcttccgagtatctccctccctccaatctaaactcctctgaatggggtctagagttatcttgccaccaccagtacctaccttggtaagtcttctactccttcaagtgcctactcagtgtccatatcacaaagctatccataccctctcttcattcctctcctctcctcacctgaaccagcctaattcccgtctagtgcctttgctcatgatgtccctaaaaacctagattgtctttaactcttttcactcacccataacttgcatctcacaaactacaactgaactacaactaaactcagtaggtgctaacaatgaccacaatgcacacatcatccccatgctggggcacactcactcagcagagcatgatttagtgcctggcagttctttctttcagatgttttcatctttctcatatactgtaaacactttcagtggctcctatagttctttactatgttgggagcattttaagtccttagtaaatcttactgattagtcagtcaatcactttggaagctatcacagaaactttcttattattggtattttaatatttaatatatttgtaaaattataaaatatttactgaagtatatcatcaggtacctgcaactcaaaattctggttggcttcactgaaaaagacggaaatgaaagaagggttagcttgcctttctaaagataaattttacttacttacccaggttgtagtgaatacaaggaactgagcaaaatgagaaagaaaaagaaaagaggaaggcccaccagaggaccttttctcatctcgtcccacttcacagagttctacatctagaaagcaatccaacttcatcatattttatatgtaaaaaaactgacccagagaaataaagtgatatgaccaagatagaaagctttttatttgcttacacagggacccacctaattgtaaaaggaagccaaatgttttcaaaagaattagcaaagaaactataatccaagagttaaaggtagagaaagctgggaaagttgaggagaagtggttgctgcccgtgggctgtttaaatgaaacaaggactgatctgctcaccacagagtaaacccaggaaaagccgccttctcccccttggccctgaagagctacactccagcctcccaaactcactccagctttagggccttaattttccaaatggtgatatcagattcaccaaggtcacaacctagagtagagtaatcgtgatcaattgtggaaggaaaaacaaaacaaaacaaaaaaacaaacaaaaaactctcttttttaattataatcaagtaccaggtagttttgtttcaaatttcatttaaaagcagctaaattgcaaagtgaaaattttaataatttggcaggtaaaaattacaaaacatatttccttctccataaattacaaaggagaaacttcactagttgttttgattatttaaaacagtccaacttctgactttctaaaaatttttaaacattcttacaaaaggcctactggttaacccagtaaggcactgaacctccaggttttaagacggtctgtcaggctgacacttgggagccagaaaaagaactttgtaagaagccgaagtgtttcaatttaagccattaccactaacagtgatgtcacctccaatattcctatcctagcatagctacaaggtaagagtgttttaggagttcacagaaatttttgctaattcatcacttaccttattctcagtctagctaatcgttttggaccatgagcctgcaaaaatgtcacttacagaaaaagaaaacagctcttctttaaagagaaacaggttattttatccaattggttctacttgtacaggaaaacaaggaaactagaaccatttaataaaataataccacagtaaacctaaaattattttcgaataaaatcagcaccatttaaaatgatcataaaatccacaaatttaataataaaaattgttagaaaatattaaaccatgctctgtgagggccagtcgtaataatcaccattctttaaacatgagcagattttaaacatatagttttgcataaagtataagcattgcacagcttatattacccagaagaatgtattatcaagtatatttctatttgcattgagttctaacaaatgattactgttgcagggaaaatgtgactggcacatcagagactttatctcttgtcaccattatcatttcccaagtcctcacctagaatcaaaaagctcacaaaatccaccaaatctgcatacaccatgtctttctttcgtcacatctgtaactatttccctgcatccgctggagataggtaactacgacaaaatgaagtcctacaacaaagtctaagggcaaacatttagaaaactaatagtgaataacaaaatatgcactgaatgtggtcgagacactcaggaggaatagaacgcattgctttgttgtttgcgtggtctgctaccccagaccacatttctaccgcactgactttgtgctaggcactgcctgagcacataaactcatttcttcttcctctgaggtaaatgtatcattgttatcacattttacagttgaggaactgtggcaaagagagtagagtagcttgttctacctaggtcacagggctaaatgaagggttggaacttaactttgttctaaatcttctctgtggtccctgccccagccctcactggaaaatacatgcaggccaaaagtagagagagacatcacaaagacaaccatccctcaaacccagctatgtagctaacttcagacacatgcttccaaacagtaatgtgagcatgttttggggggccactctcatgctgatttcaagtgtacaatccccctgcctacagtggggaagataaacagggccaggccagcactacttcctacccacttcccttctgggtctgcctattcactgccagaaagtcagaagtcaatcatcccacaggcttcagcttcaattcaggtagagcagtgaggtttgaaagtgcctcaagcagagcccacagttctctgatcctttacaatatcacactctgtaattgtgtggcatagcagccatgctaggaacgaggtcaattacttaggtactcgctagactttttccttttctccacccctggggtccaggctcttttcccagcacttactcagggctgtcattagccctttctcctcagtttcatcgcccctgcatttacgttattctaagtcttctcccctatgggttcctgtggggaaaataaaagatccgaaagggaaaaaagcagaaaagaatgaaataaagtgaaaattcaagaggttcttgttttaagtccctatcttaaaagatatatggctttgtcactttcaaaagcattacattataaggtatgtggccaaaacacaatcaataaacaaacacacgcagacagatacaactaaatacacacaaacatacatgccacaatagagagggtctttgattcttaggatcccccttttcttttccatccattaattcctaactacactgttcttctctaaccatgtaactatttctcaatatccatttgtcacatgtaaaatattctcaagaccactcctagccttgtatacctgagacctgtctcccataccaacaccatcacttaattaagaaacaatggcactaaagctttgcttacaaatctgtgaaacaaaggtcatcccacctgcctaccttcccacttcaccttactaataggaggtttaaaggagatatgtgcttaagtacaccaaagaaccagaggtaccaacagggttaagatacgccttgaatccaagaaaatcccctgaagcagcatgtcaatactgagtaacacaaccattccctaggctatcacctttttttttttttttttttttttttttgagacagagtgtcgctttgtcacccaggctggagtgcaatggcacgatcttggctcactgcaacctccgcctcccaggttcaaatgattctcctgcctcagcctcccatgtagctggaattacaagtgtgcaccaccacacctagctaatttttgtatttttaatagagatggggtttcaccatgttggccaggctggtcttgaactcctgacctcatgatctgcccacctcggcttcccaaagtgctaggattacgggcatgagccacagtgcccagctggctatcgctattttaagcaaagaactgcaggtgtacttctttagttttagggagaattttaaccaaatgatatttccagtttaaacctggacacacaaggtgagggcaatgagggatgatgaagaagatggcatgctctcttgggcatcggcatccttatttgattagcagaaaccataattataatttactagcaactctttttctagttttcctctactcagtcttcaaaataaatgcagtgtattaactcttagactgtactcctgaaaaattaacagtgaatcccaatccagtatcaaaatgattcatcaaagacagaagtggccaaggaacaccagaaagacaccatacattcttgcatcaaagagcctgaaattcttgttgagatgatcatttctagctcacgtacaatggtagaacttgtcttctcctgcatatactgtgtcctatactatatctcacgttacatgaaggaaccataagttctgaaaaagccacgtgcaatgaccactgtttgatggatacattcatgtatatatatatatatagttttttgggttttttttttttttgagatggagtctcactctgtcacccagactggagtgcagttgtgtgatctcagctcactgcaacctccacctcctggattcaagcaaatctcctgcctcagcctcccgagtagctgggatttacaggcgcatgccaccatgcccagctaatttttgtattttttgcagagacggggttttgccatgttggccagccatactattcactgaagaggaaaaagaccattgaactatccttcattttccagtgaagatgttactataaagttgtatataaaccaaatcatatttatcgctgctttgggtcatttcaggatgcgtgttcacagtgggggaaaaatcccaaaatgtggcctcaaggtgtcatgaagatcacaaggcatctgctatggtctgaaagtttgtttcccagctaaattcatgcattaaaaccaaacccccaagaactgtgagagataaagggccgttgcttatagacaacctagtctatggtgggattttgttatagcagccgtgatggactaagacatcacaaaagatttttcaaaaatctaatatttagtgcatttaatttaatgtttatttaatctaatatttatttatttatttatttttgagatggagtttcactcttgtcgctcaggctggagtgccatggcgtgaccttggctcactgcaacctctgcctcctaggttcaagcgattctcctgcctcagcctcccaagtagctgggattacaagtgcccaccaccacaccaagctaatttttgtgtttttagcagagacggggtttcaccatgttggccaggctggtctggaactcgtgacctcaggtgatccaaccgcctcgacctctcaaaaactgctgagattacaggcgtgagccaccgcacccggcttaacctaacatttaatagggaaaatattaacactagtattcagctaataactataccaaaaatacaacagaaattgaggtgattgccagggagatacaggaagagggtatgacaagtaaggtggcatctgttgcctgcagcgtgtgtggcggtggtagaaggaaaggcttctgtgggtttttaaatggactactgcaagagaacaaggctgactgggagatgtcgaaaaaatgtcagagtagacaattccaagtgcccatacacctccctgcacctaaaccatcaaaaaacaagcaccaactgtcagaactaactttgtcagaactctggaaaacagtgaaatgcttacagcaaccaactgaacactgaatcaagaacttcaaaggataggaaagctttacggcattcttatttgcctttgccctatctcctcccagtgtgatggcagcccatattccaagaatgggaccctggtccctggttccaataggaacaagtagaacgcattcataaatttttagtgactccattccaacctgtcagggatacttgacaaggttcatgcttaaaactcaaaactcatccaggctggaagtggttggcattgcccaaaaacaatccagacacctggggtcaaagagtacaaatgagacatgcaacacatgacctgaggtctgggaagaaaagacgtgaagaaagttaccttaggaaattagggcaatcaaaagcatccatatatatgggtgaaattagaaagccacacacatgctcagaataaaacccaggaagaccttaagctttttcaccttaggctaaatactagcctagacacaagtctggctcactattgaaggagggccccagcaaagagccaacctgcaaaaactggaaaaagtatttttgtttgtttatttgttttagctcctggcattcaaggaaatctctgtcaaaacactaccaggctaggcacagtggctcctgccaagcctgggtgacagagtaagaccccatctcttaaaaaaaaaaaaaaaaaaaaaaccacacacaaaaaaaacagtaccagaagattaactaagaaacagagacttcagtgaccacacaagacaaggaatataatccctacaaaaatagttgggaaaagtcacttgacaaaaaaaagagatacataaaaccaaaaacaacaaaaaaagcaaacctcggtgaaagaggagactctgatttccagagacacaacactgtaattttcaaacaccccattttcaacagcaacaaaatcctaaggcatataaggaaaaagtatagcccattcaaaggaacgaaattaactgacagaacatgtccctgagaaggccagacattgtacttactacacaaagactttacaaagcaactttcttaaatatgcttaatatcaatatgttgttgaagttgagaaggatactatatttgattaaagaataaattcaatcggagatataataattataaacataaatgcaccaaacatagagtcccaaaatataggaagcaagcactgacacaactaaagtgagacgtagaaagctctagaataatagacttcaatacatcctattcaataacagatagaagaacttgacaaaagataaatagggaaacagagaatttgtacaacacataaaccaactagatctaacagacatatacagaacattttttcaaacaaagcagaacacacattcttctaaagtttacatggaatactctccagaagagactatgtttgtccacaaagcaagtctcaatgaatttaaaaagactgaagtcatacaaagtattgatagagaaagttaggtagttagggtaggtccttggcaaaactcctttaaaaagagaaacagcctgaaaaatcaggctgcaggcacagataagaaaactcgcacaaacatccagcccactcagatacaggaacaaggcccaacccagaaatgcctttgttctttgtataaccagtgggcttccaggaaatagtctcttttccttctgtgggcatgtacgcagtgggctctgttgggttcctgtgggcactttgctttccttttttggacatgatttggactgtttgccaagcctctatgaatcatcgcttcagcctctgactggtcccaggacaaggtcccaggccaaggtcctggaccaagctttcacttcagctcctgagtggtcccaggccaagctgagtaggctttctccaagaccagtcagcacattccttccctgcccagtccataaaaaccccaaatctagcctcatagttggcaaccctcttccaggcaccctctctgaggcagagagctttcttcttttgcttattaaacttttaaacttttgctccaagctcaccctttgtgtccatgctccttaattttcttagtcatgagacaaagaacttcaggtgctacctcacaatgagagactgctacattgtggtgcattggtgacactctaacagtatactttgccaccatgatgcactgaagctagaaatcaacaaacaaaatgtagtaaatatctacaggatggaatattatttggtcttaaaaaaaaggaacaaaactctgatatatgttagaccatggacaccttgaaaacattatgctaagttaaataagccagatacagaaggacaaatatcatacaattccacttacatgaggcacttaaaacaggcaaagtcagagagaaattagcatacagtttatcagaggctggagaaaggagaaaatgggaagttagtatttaacgggtacagagtttctgctagggatgaagaaaaagttctggaaatggacagtggtgataattgcacaacactgtgaatctacctcatgccagtgaactgtacactttaaaatgattaaactgtttctttgccttttggctaagatcaagtgcaaaaatggtaaaaatgataaattttacactatatatattttaacacaataaaaatttaaatgattaaaatggtatattttgtgttcgtatattttacaataaatttttaatataaaaaagtggggaaaagagagagagagatgggacagtcattgtgatctcatagacatacataacaaaatttctcttggagagacttgaaaatggaagtctgcaactcctagctggatctgacgttagatctaagttgaacaagtttctggttattagataatgtcttgtactgaaaaaaagaataaatcagagtgctaaattgctgccctttgcagctcctcaaaaagttaaacacagaattatcataagacccagcagctccactcctaggtatatatccaacaaaaattaagactcacatccacacaaagccttgttacaggaattctagcagccttattatgttcataaaagtcaaatactgggaacaaccaaatgttcccaactcaaatactaaaaggatgaacaaaatgtggtagatccatccaatggaatattagtcagtcataaaaaggagtgaagtattgattcaggctataccatggatgaaccttgtaacattatgtgaaagtaaaagaagttaatcacaaaagaccacattctatgactcattaatgaaatgtccagactaggcaactctacagacacagactacaggttagcagttcccaggggctgggaaagggaaaatgagaagtgactacaatggatgcagggtttcttttttgtaggattaaaaatgtgctaaaattagcacatttgtggtaatcgttgcacaactctgtgaagatacaaaaaacaatcgcacaatctaagtgggtaaattttgtagtacgttaattatatcttaataaaactgttacacatcattgctgcccttcaacattctgatacacatctcaagtactgaagcaaaatctcagggggcgcaacaatagcatctgtgcatggagtacattctcaaaattctcctttgctttttaagtctttgtaatgttggagaatattctgagctttaaataatttacagaggaactaggtaactaggtaattaacctttgctgttgtaactaagaatgatactctgttctatcacccttcacaaatgactactccaacatcagaatttagattagcaatcttgaattcttgactcttcctagtttagaaatcatgaaaaagaactgagaaaatgtttcaccatctttatatactttgttcttgaaatcctaaactctgtgttttcacaaatgtcaactgcctggttgggtagaaggacagaactgctaagaaagaaaggatctgctgaagtgtggtccaccacacagccgacctgtatatgaggcactctgtaacatgaactgccattacaaatggtgctgcttttatcattaagtgcacacccacgcatgtgcgactgcacacacacacacagagttcaaaacatgcccaaggaaaaatatcctgtcgtctacttaaccactaattaccagagattaagagttgcagctctcaatgccattactccatgctatagagtttggatatttttcccctccaaatctcatgttgaaatttcatctccagtactggggcctgacaggaggtgtttgggtcatgggggcagatgcctcatgaatagattcattcccttgggtatagggagttaattcttactcttagtccccacgggagctggttgttaaaaggagcctagcccttctggctctctcctgctttccttcttgccgtgtgatctctgcacacacaagccctcttagccttctgccatgagtggaagcagcctgaggccctcactggaaacagacgccagggccgtgcttcttgtacaacctgcaaaatcatgaaccaaatgaacttttttcctttaaaagttacccagtctcgggccaggtgcagtgactcacgcctgtaatcccagcactttgggaggctgaggtgggctgaccatgtgaggtcaggagttcaacaccagcatggcaaacatggtgaaaccccatctctaccaaaaatacaaaacttagccagccgtggtggcaggtgcctgtaatccctgctactcaggaggctgaagcaaaagaatcgcttgaacccgggaggcacagtatgcagtgagccaacatcacgccattgcactccagattgggtgacagagcaagatcccctgtcaaaaaataagaaaaaaaaaaaagttacccagtctcaggccagatacagtggctcagacctataatcccagcacgttgggagcctgaggccagcagattgcttgagcccaggaatttgagatagcctgggcaacatggcgaacacccatctctacaaaaaatacaaaaattagcgtggcattattgtgcacgcctgtaatcccagctactcgggaggctgaggtagaaggatcacctgagcctgggaggtcgaggctgcggcaagccatgatcaagccacagcacttcagcctggtcgacagaccctgtctcaaaaataaataaataaacaaaattacccagtctctagtattcctttaaagcaacacaaacagaccaagacactccaccaaggtacataacgttatatcagtttggccatcttcagggtgttttgttccaaattttagatctgcacaagtaccctttctcaatgatggcttcccatggaagtcactggattatcataatggcattgacctccctgttctgagcagtttccatgcacccaggcctgctcccaaatacaacaggtttggcttactgttgccgggaattggtaatgtagaaaggagggtttttctttactttttttcaaccacagaaaaagcttccacataaatcaattttaaattccaaagcttttcctttactccatggttttctccagatatgtctgcctactcagcaggagcaaaggccagaaagcatgcaggccccaaagaaaaacaccaagaataaaacactacagaagattcacggggaaaacatttacttttacaaagcaaaaccacaagaaagattcttgcaggcaggctggcagcggcgacactgtttcaagttatacattcaatcaattgtataaaatctattatccggtatttaagccattaacagatctataatttccatttacctgatttgggggccaaaaaggtatgagttaaaaatataacagcttccggccgggcgcggtggctcacgcctgtaatcccagcactttgggaggctgaggcgggtggatcacgaggtcaggagatcgagaccatcctggctaacacggtgaaaccccgtctccactaaaaaatacaaaaaaaaaaaaaattagccgggcgtggtggcgggcgcctgtattcccagctactcaggaggctgaggcaggagaatggcgtgaacccaggaggcagagcttgcagtgagctgagatcgtgccactgcactccagcctgggcaacaaagcgagactccgccttaaaaaaaatatatatatatatatacacacacacacacacacacaaatatatatacatatatatatacatatacatatatatatataacagctcccagagaacagagttctgctcctacaagatggcacagcatcgtcagaacatgattctggagccagactgactaaactggaatctctttattacgcggcaggatgctggacaagctgctgacttctgtgtgcttgggtttccacatctgtaagatggggtcaccatgagagttcagtgagtgacacacatgcacagcgttgggtgtcctgtacatgggaaactcccactgtgagggagcagttgttactgtgattccaattacacctggacagcaagcctttttggccagtggtcctgtttaagggttttcttctgctcacaacccacccaccagttccctgatgccactgccgcctcaagagaaccagtgtgtgactgccagtatgtacccacccacaagtcactactagaataaagaattctgctcacagatcacttggacacctagttattagacgggacacagtgggaaaaaaagagggaagaacatgacaacttactgctgatggggttaccctcgggtgctttgggatgaggggagtactttcacaatttattctatgcatatctgtatttttctctgacttgttgacaacatcatgtatttcctttgtacatttgctttaaaaaataaaaccaccactgatcaggtccaactcgattaatttctattaattctattaatccatgcaacacactggctaaggctctgacaaaacaaaatgactacagctgccgattatcacctctcagtgaatgaaaatgagagggaacctcaaattgcattaggaacacacgtggagattccaaacccttcctctcaagcagtaagtcactcactcctctctcttccagatggcaagcgacactgcaacaaaacccacgtatttaaaacaagtgcagaagtgtttattgtacctccctttccaaaacagctgctcaacagaatgtacttgtgcagcaagaaggaaatcagagtgtatgtccagctaatgaaatctttacgagccgagcaccgcatcgactccaacactgggagctgccagctgctgcctaaatactattttccagcatcttctgaaggctagtagttactcaaacagatttttaaaagaaaatgaatacaaaatattgtaattattagaagattattataattagacattctgttctttcctgtgaggcaaggaacaaagcggctgcgactgttacaaagagcaccaagtgtcttcctctggttacttaccaaccacccagaggtcacgctcagttacaggacagatgccctgcccttcgcactttccaagtctagctctcacctggagtctcgggagcacatactagagggcttctcattatctcatccacagcaccagagaagcacaagagaacggatgatcaacggaccccttcaccttttcaaatgccccaagtctgccttctggacaagacagtatttaactaaagttccacagtaatttagaattactaggttcccttttcctctttctaggacaggtacatgaaaatttactttataaaatcacaggggagaggaaactgaaagaatttgttgctcttcccctaagcggcctgaggtgatctgtgaaaacggttcactactcacttgacccagaaaaccctacacaatcatgaaatcaagaggtttaaatcttcatgttcactttacaaacacttgtgacattacccaggccatcgaggttgcatatatgaaaagccaccaggtaactgaaagatgtcactttacagaaatggtatcattctgatgttacaatggtagagtcggtaggtgtgcccaggccaaacagtggggctggacacaggtgaacttttgctgcacgtgcttaaaaatggtgaaagtcacgctgaacttaagggtttccatgtagattctctggccattgagcatttcgaggtaaataaagcacctaagatgcaccgtcggacttacagagctcatggctggactaacccatacgtgggctctcccagccacatcgagatgattcttactgaaaaggaacaaattgttcctaaatcagaagaagaggttgcaccgaagaaaaagatacctgagaagaaactgaagaaataaaaacttacggcacaggaataaattccgcataaaataaatgcaatcaaaagttaagaaaaataaagaatctgtttgcaaaatctactcctcaggtctctctgctgtaaatcctcaaaaacaattaatttctgattatctacctgaagataattacttcattctgaaggcagtatatgatttttaaagcccgtacactatgcttccttctcctactagcccagtgatacctcagcgtggtcaccataccttccaaaatacactacacatccgtccgtcaacagtccccaaggtgctaatcagcattcatcatgatccatctttttttattacaaacagcataatccaagaacaagaatacaggttagcaactttggtcttctcaaaagaaaaacagggaaatgctgatttacatttgaagcctgacaaattaatattaatttctgacccctaagaatgtgatcagctgcaatatacactactctgtgggtgtaaagcaaatgaccttgtgaaactcattttacaaggttcccagcttgtataatgaatgtttccaaaatgacatgatcatcactgacctgtgcttagcatctttaaaacacctttacaaattatcccattttgaaaccggaaaaatctcacaactgtaataaccctaggaaattatctcctcgaattggccaacatatgcataaatcctttgttttgatctttataaccatttctaagatgagtaaaatggttactcttatttccaatttatagaatcagaaacggaggtttagctgagtcaagtggtatgtctcatataataaatggtaaatgaagatctgttacgtgtactatgtcaaaaataaagtcacctaaaagaaaacttaagcatgacaccaatacttgggaaaaaatggtttcaaatatactggttaactggtgtttttattaaaatattcctttatgcaacgtttgtatatatttttaaagaaattatgtcaagccagattttacatcaaattcttttcctaaatattaagatactgctccacagcattcctcatcccccaaaattttaagactactcaagtacagggtgggaggcagatgaagtcggccccagccactctgggtgtcatggtgccacagcctcgaggactcttaggccccatcagcagttagggcatctccctagatctgcagtatcttcctcaaagaaaacccccaccccgcaaagccaccaaatccaagcaggagacctcctctggctgtcttcctggtgacttttaggtagctggacgctgggcaaagtctggcaccctggcagcaagatgcccctgccaccagagcaacagaatccagcagtgccactgacaaccactttcagcgtggccaatgctaagagaaggtggggaggagagggcaaacatgcatgcactggtgacaggacgccaatgtcatctcatccaaaccttgtgctagggaggtagagtgtccactctaaagatagagaagctaaggatctgagaacttgttccaaagcctgggaccatggcactaaggaaatggagaaaaagcaccatgtgccaggttgaaatgatggaaaacgagggcacaccacacttctacgggctttggcacgcaggtaggtgcaacaggctgtgtaacctcccacagctacaaagactctttcctgctctcctatagcgaagctgtagatttgccaacattatgacctgcattacagtatattttcataaacacaaaatgtccttatcttaagggttacctacactcaaacttcaaggaagcaaactgccttcattttttattagtcatactgacactgggtcaactacaaaagagtttcaaaacccattatgctaagaaaagaccatgagtgttatgggctcaattctccctcccaaaaagatagatggaagtcctaaccccctcccccaaaaattcagaacatgaccgaatttggaaatagggtcactgtagatgtagtaacttaaggtgaggtcataatggaataggcaaggcccttaatccaacatgaccggtttccttataaggagaggaaaatttggacatacacgcagagggaaaacaccagtgacagcagaggtagatgctgaggttagacggctgcaagccaggaaccccaagggttgactgccaccccagaagctaggaaggggcatggaatggtcctgctcagaatctcaggggagcagtgccctgctcacgcattgactgcagacttctagcctcaggctctgagagaatacatttctgttgtttaaccccacccagttcctgcgattaaatactttgtgatggtagtcccaggagaaaactcacacagtgagctaatgtcctgctccacctaagcccctttctgacatggaaagcctgaagtctgaggtccttctccactgcaaccaaaaaaacggatcccatcgcacctggtttactaacagaggcaggagattgccacagcacagaaagcagagtgcagggcctagtgaccgggtaggagccgggccttccaaactccaggcagaagaggcacgaaaccacaccatggagaaacagcttatcttaatgaaaactactaagcgtaaaattactgaaaactggctgcaaatatgcattccagtcaaactagtcattttgcactctcaacaacaaatctgtctactctagacaatcagctccggatggaactgtagcaacctcaaggatcaataatagtaagaaactttaaaaactacaaatgggccaaaaaacataaggtattaaaaatgaattatctcatgagtcttatgtggcttcggtcatcaagcggctatgaaagagcaccacctgaattccaaccagaaagaactttttgtacatgcacattgaggttcaaaataaaggacaccaaatgtcctaaccatggagaaatcactaataaaaccacaccaaatttttaagtccaaacatctgagaggtaaaaatatatatatatatatatatatatatgtatatatatatgtactacacacacacacaaatatatatatatatacacacacaaatatatatatacacatacacacaaatatatatatatacacagagataaatatatatatatatatgtatatcggggggatggaggaaagattggatcaaacagaaaatttctaattttacatatggtaggtaacgttggctctatatacaactcacaaaagcaatgacaaagcacttagctgctaaaatatcaagtgaactcttcttcccttttttcttttttttagagacagggtctcactcaggcacccaggttggagagtagagtgcagtggcacaatcacagctcactgcagcctcggtctcccaagctcaaataatcttcccgcctcagcctcccaagtagctagaactacaggcatacacgaccacacctggctaattttctttttctttttttttttttttttttggagagctagggtctcccatgttaccaggcttgtctcgaactctcagcctcaagcaatcctcccgcatcagcctcccaaagtgctggtattacaagcatgagtcatcacacccagccctcttcttttaattcattttgattggtttcggttctgtgagcaccaaacgagtatagtcacccaaaaagaacaagcatctggctagaagacccactgcaaggtggacagctgtcacacacgtagattcctttaggtaactgttaactgacaattttctagtgggtaatactggactttagccaccatacagaaaagacagattaaaataaacctctacatactttcagtccacctaacatttcaaagtcaagagattaaaaccaccatctgagccaccagtccctccaggttggctgaggctattctcaaggtactatcagaattaaatacttccctgatatgcacatgtgtgtgtgtccacaagtacgtttctttatagttacatagccttgtctctcctccctcaaaacactagagtttcagtcctacccttcaacagaagcccaactcaggtttcatcaggggactcctccaccttccaatgtcctcaccaaccatcattcaggtgctcttggcccaattgctcggtgtcaacactgcaggactttcacactgtttgttcacccagaaagataatgctctccaccatatacaaattactgtgcaggagacaaagatcaatcaatacggagcctaccttaaaggagtttaccaagggagaaaacagattataaacaggactttttaaaaagtagcccggcacactggctcatgccagtaatctcagcactttgggaggccgatgtaggggaattgctcaagcccaggagttcaagaccagcctgggcaacatggcgagaccccatcttcacaaaaagcaaaaaaataaaaaacagctgggcatggtggcacaaacctgtagtcccagctacttgggaggctgaggtgggagaactgtttgagcctgggaggttgaggttgcagtgagctatgataagcaccactgcactccagcatgggcgacagactgagaccctgtctcaaaaaaaattaaaaataaaaataataaaaggtattaagtaacaaaagtgctttgtctgggaaaattcaaagtcaaaagtgattatctggatggaatgaacagaaccagctttcacagaagaggtaacaagagagcataaagaatggctggaacctgaacaaagaacaggggaaatgactgtccaggtcaggtttcttaaccatggcacaaggaatgtttggactaaaaaattctttgtggtgagagcctctccttgtatcatagtaagtttagtatcacccttggcctctaccaactagatgccagtagcacccctccagctgtgacaaccagtccctagacatgccacataccctgcaagggtgggggaagcaaaatcatccctggtggagaacaagtaaaggaaacagcatgtgcaacagcatggagacaaatagtacagggcaggagaaggatttggttgaaatacaaagttgtcatgactggacggcacagtggctcacacctgcaatcccagggctttgcaaagcccaggtgggaggaatgcttgggcccaggagttcaagcccagcctgggcaacacattgagaccccaactccacaaaaaaaatataaaaattagccaggtgtggtggcctgcacctgtagtcccagcttctcgggaggctgaggcaggaggagcacaccagcccaggagttcaaggctgcagtgcattatgatcatgttattgcactacagcctgagcaactgagcaagaccttgtctctaaaatataaaaataataaaatgttgtaacaattcattatgaaagtcagggctaaaacacaatacaataatgacatacagggttagaagtcttctggacccacaaggcttcatactttttgtttaaaagtttgggatgtattctatgaatgaagaggaaccaaaaaaggtctttgacctgagagtaacaagtgcactaagacttgttggtaatgttgcttggaaaggatgagaaatggttggttaatgtccatctttggtgaggggattttaaagggttgttgtataaacaatttatactcaatattttcttcatcaactgaagagtggtgaacgtttttcagtcaaaagcttacatatgtatgatatttcataatgaaattttttcttaaaaacttatataagcatttttagattctttggtgctagacaatgttttgacttttagacagactgtatttcagatgacatgcttgcctaattttattcttgaatatggatcgcctttttatacaagcatattatcaacctaaaactagattacaaagtgactatagttttcttctggttccactcaacaatgagaacaattatttcatagggacatatttgtaacttgctttaacattgttagacctttatttggagaatttattaatattttgaacacataagcaaggtttgttttgtatatttatatatgtggaaagaggaatagataaggtatataaaggaagaaaatttggtgaggaagaacctcatcaatgccaagtcaaatcttcaacactgtgggcaggtagtgagccaggcagaaaaagctgttaatatctaacattcagtacgtacttactatatgcatcaagcactattctgagacttggcatgtattaattcttaactcaaaacaaccctatgacatagtatcttcttccacaaagctgttcctgatttttttttttctcttggagacagggtctggctctgttgcccaggttggagtgcagtggcgagatctcagctccctgaaacctccgccttccaggctcaagccacactcccatctcagtctcagtatcaccatgttgcccaggctggtcttgaactcccacactcaagcgatccgctcgcttcccaaagtgctgggattacaggcatgagccaccacgcccagtttgttcctcatctttctaaccaaaataaacactatttacagtatagggttttagagtaaataccttgcccaagttaactggtccatggcagggctagggacttgggctccaaaagggaggaccaggctgttgaccttgctataaggtggtggtgagccccatgaccacaggtgacgtcgtaggatggggaatttgaaagagcactcttctgacttaaaataccacacagttcctttattggaataatttcagccttaatgagactggggttgtctttttaaaccctgtcattacaggcatcactgtggcgcattaacaccaggactaactttgtacctggtcatggtcatactgtgctgtagaagtgcaagtaatcagttttaaagtatttttaggtgacatctgagactggtcctcagctggtcagcgtggccaggacactgataagaggcatatcttgaagtcagatgggtcacctgtgtggatatattagcagtggttttgttttttaagttgggcaacagtcctaagtgaggaagagaaaaagattttgtttgttcgttcatttgtgtgtttcaagttgtagtagagctagcaagaaataaaaacatctagagtatttgtaaaaattgttttaattgtggcaaagtatatacaacaaaatttaccatctgagccattttcaagtgtacagttcagtggcattaaatacattcacaatgcatcatcagtcatttctgcaagtttttatcttgtaaaactggaactctgtgccatattaacagtaactccacgtatcccctcgccccagcccctggcagccccctttctactatgtctctatgaacttgactcctccacggcccttttgtaagtggaatcacatagtgtttgtccttttatggtggccttatttcactttgcagaatgtcctccaggttcatccatgttgcagcatgtgttagaattgccttttttttgaggctgaaacattcctttgaatgcgtcttgtatccattttgtttattcacttgtgttgatgaaggcttaggttgcttccacttttggttactgtgaatagtgctgctatgaatgtggctgtacaaatatctccttgagaccctcctttcttttggatatacagcccgaattgaaactgctggatcatgtggtaattccatgtttacttttttgaagaatcattatattgctttccacagcagctgccccattccacattcctatcatcattgcacaagggttccaatttctccacatacctgttagcacttattgtcttgtgtagctcactgcagcctcaaagtcctgggctccagtgattctcttccttagcctctcaagtagatgggactacaggcatgcgccaccacacctgtctagtttttttttttttttaactttttgaagacatagggtcccaccatgctgggctcaagctggtcttgaactcctggcctcaagtgatcctcccacctcagcatcccaaagtgctgggattacaggtatgagccagcacacctggcttattttctggatttttaaaaattatttaagattacatctgtgctagtcaaaataaactacaatgtgaggttaaccaattcattttttatttgatcttgaaaagaggtcctaagatctgtgttgattaatattactataaggcccctaaatacggtttttggaaagtctggccaagtgggctcatgaagcggaaaggctcaggaataagggtttaaacacagcataagggttataacatttgcagtactatgaacttttggaagcaatgtacatagtagtgtttatctggagcatgctttatacaatgccaacaagtcaggactgtctgtagtctgggcaataatatcccccggctacaacagatgattccactgtaagggcaagactgagccggcaccagataatataagcaaatataacgaaaagtgttaaaactctattaataagatcagctagacaaaaaaattatctcatacatagtgtatatttgacctctaccaccatacagagactgttaaaggtttcagagtatagttttattctaattataatttgcagtttaatctctcaagtacaatagtctgagaagataataattacttattagccacacaggtcacagattttggctttttaagaagaaacaagagccctcatgcagacccctggtacagtctcaactggtggagatactatgtaaaggagcttttaaattattaaatagcctctaaataaatacatattttatatatatatatacacacatacacacacacacacacacacacacacacacacttatattacatttattagtaacctaatttttaaaagcccattaagaatgtcagaaaatgtaacttaacacttggaactaactgaacaggtattttaagacagctgactgttagaaacttcaaggctagaatggtagatttctgttttttaaatattttatggttttctataagaacttacaaaacatactgacctgtttcgatgaaaacatttctggtttggttttacatttaagtcatatttagatatttaacacctttataaggaatttctatagttttttttcacttttgtagatacgggaattcactatgttgtccaggctggtctcaaactcctgggctcatgcaatcaacccgcctcagcctcccaaagtgctgggaatacaggtgtgagccaccatgcacagcctcaataaggaattttcagatcatctgaatccatccccaggggttactaacacacaaaccaaatagaattccatatattttagtatacagcacatcctcaaataacatcgtttcattgaccatcatttagttacacagttgataagaaaaatccattcccaaccgggccactgtctggtggtttttctctctgggtacctgggtttcctcccagacaaagctgggcacattaggtttattaacgcatttacctggtcccagtctaaggacatgggtgcgggtgtgagtgtgagtgtgccctgtgatgggatggcaccctgtccaggactggtgcccgccgtgtgccctgagctcctaggataggctctgaccacctgtgaccaggtggaataagtgggtaagaattatctcacgttgcattaatctttcttaaatataggtatggctcacatttatttcaacgtttaatgctagaagtgttttggtctttacttaaaagtttggtggtgtttttgtgaacagaaatatgccacagaaacttaatcttgtttgtatcaattagcctatgggaaaactggtttccatatacgtagtttcacttcaaattgcagtttctaagaactcactgatgacagtgaagatttactgtatggggttttagagtaaatttctaaatgtacgtacaatttttcacattttttaaatatctatttggtgatctatatattcaacagatgagaatcagtagtcacttttagggatagtttcctgggagatggcacccaataaagtctccaatgatgggacatgattttgaaagagtacattagctgtgctcacaaaccaagatccaatctttcctcaaccagatgaacttttccttaagacctgaaacactgatgagtcttgggcacatggctacaatacttttcattgagtccctgaaggccatttttacctcaatgaaatatcatctaaagaaaaattatttaaaactccagttgtataatttcaagatagtttagtgtatttagtatgactcactcttcattaaacttcacaactatttttaaaagctaatttaaatagttacctgtttgagctgatcgatggaaacagggcttgggctatttctgtaccaccctcagactaagaatgctttttatatttttcgaggggactgtgcatcagaggccttctgtggctacacatcttaaaatacttctttacagaaaaagcttgccaagtcccgaatcaaaacagaaatcaaagttttaaagggaaatcgtctcttgtactctgcaatcaatagcatttttttttatacatacacacacatagacacattcatgcccccccatccccatcccactttaatctggaaggtacctgatctacacagaattctttgagtctctatccaccaaaatgcagtctacctctcctgtgatgtgaaggtgttgcccagccacccttgatctaggtatggtccacggctagttcttcacaatggcatgtgagtggaagtgatgtgtttcacttcacttcaaaccagggctttgagagacagagagagagtcttgctccgttatccaggctgcagtggcacaatcacaggcccctgcagcctcaacctcctgggctcaagtagtcttcccatctcagcctcccaactagctgggaaccacaggtgtgccacaccacatccagctcatctatttttaatttttgtagagacagggtctgcctacattgcccaggttggtctcaaactcctggactcaagtgatcttcccaccttggccttgcaaagtggtgagattacaggcatgagacaccacgcctggcccaagctagagtttttaagaaacagttatactttctctatactttctttcctttctctgactgaatgctgaggtgttgagccctgaggatgtcgaagccaccaccagccataccaccccacgacaaacaatactgttctactgtgttcagtcactgacattgttgttattagagctattgagaaaacaggctgtaataatcactaacatacgcattgtggatttactgcctctcatatttaactaacttctacttaatttggaagttctcccaatcacccttcaaaaagaaagagaaaaaaaccatgaaaacagattgtttagactgcagaaagcagtctgtttattctacccatcagtcttttccttgacaactggctagtgttgctctttttttgtttactgtagctcagatgatttatttaaaacctcactataaccatatttcaaatgaaccaaaatgtaaaaccattcctgcttcatgtgtgttgttcaaataccaatgctgcatcaagaaattatagcatcccaccctatggctaggttttggaggcagaatgtaaaagtggacaaaaatagctccacttcagttctttattgtagacaagggccaacaaagcataagaaaggtaagaaatgtcacttaaccttgaaacactataggatatctcccaaacaagaacttcccaatgcaactgaaacttgacattctcaaaagctgcatcgtgacaccatcgctgattcaaaaacatgtcagaactgctgcaacacatgtctccgggacatggattccttcccacatgactggcaaaatgggaatgacaacagtatcatggagaaggagtgttggttcacgagtggttcttcccagcatgttaacgttttgaagctattgagggccaagattttttcacaaataatgagaaagacttagaaaaaaacaacaaaaaagaaaacaaccctaagaaaaatcagtcatatcaaagcaccttccttttgtgcaagcagtgggcatgggggtggctggtttagtcacctcagtatctgctgggctctccatcactcaatgatggtgtgggggcacatgaaggctacactctgaaacagagctttaattctagtgaaactggcctgcagaataaactaacatctccaagaatgaatctacataacccaggatgaacatgtcccaggataaaataaggcccctacaatcatctgagtataatgctgagcgcaagtttcaaggaagagttaagcctccctgtatttttacttcaactgtcattgcttttgttaaagttccacttacaaagttacatagttttaagtagtctggccttaatcctgtttttttttctacagccctgttatttttagtgtatgattttgcagaatgagaggtttttcaggaatgtgtgtatcacattacagtaggtatgagcccatcgctaatttgagatagtgagttgaaatgccaagcaataagcaaaaaaatacacttcaacctcatcagaccccatccaaaaccaggtaacatgcctgacacatatcacatttaatcataaaggcctgcttgggtacacaccaaccctttcccacattacagctcagaaactacctaaaaattagtatgcagttcctatcaaatagtggacgccccaaacacagtccacaaatgctacaaacacattcaaattctgtttttccaaactcatcatgtgattgtctctaacttcagcttcgttttgacaacttttgtttcatctgcaaactgagtaatgagtcctttattgtagtttctcttcccttccaacccacagccatatataccatcaccctctaggcccaaccaaaaccacttgattgcttaaactttgaacacagaattcctttttggaagacatcatcttttccttcagagttttcttcagctttgaaggcaaagtggcatcttttaaatgtacagtgtagggtgatttattaactcttctgttgactactcaaaagctgtcttccttatgaccaaacaaaatgacagatttggagttctgctcattttgatgcggaatcaccaacgagcagaggatctaaccctccctgccctgtgcaagtccacagaccccaggccccacctctgccagcccagcctctcctaggatttctggccctgagcttctccgttacaaggttctcggattttctcaccatccccatgtacatttctaggtggagtgcaaagggaaggtattgagtgtgcacagatgcagggatgcttgctgatgtgccacactaatatcttaccagtaaacaccatccaactccccctcatcccctctcctggctgttctccccacgaatctatcaagcaaaatgtaggtaggccatttttcttctctgctcccttctttcctgtctctaatgacactcagtatctattaggtcatgtctcctctttcattcaccagtttctttttaggaatcttatccttggcactgattacaacaaatataacatttctgaatttgagacacaaaattcactggattgaaatatcaatttccaagcataataaaatgcctctaacctggcacttctgagcaccaatggggatcatctgtgttcataataatgaccttgaaatacttcaaacttccaaagaaagaagcttttggatcaaaggaatcctcaattatatgtcataattttaatgttaaatgtctttcctgcattctaaatccaggcataatatatggcaacagcaactctttggttaatacagactttttgccaagccactccagctaaaaggtccattcagattgtttaaatactggtaatccattagaatcacctgaggaccttcttttatccattccgcccctctaaatctaagatgcctagtgataaaaagtttaccaaaaacaaaaaacaaattcccaagcaattctaacatatgctccttctccttgataactaactcatagatattggcagaaatcagcctgtacaactatgcttctcatccctgtctgtgtactgcttagggaactttctgaaaacctagattttttaaatatatagattcttgggcccatcccagatctcttggattacagtctcttatggtagatctcaaatatctggctcctcaagtgattctgatgcacagccaaggtttgaaaacagctgctttggacgggtgcagtggctcacgcctgtaatcccagcactttgggaggccaaggagggcagatcacctgaggtcagcagttcgagaccagcctgaccaacatggtgaaacactttctctactaaaagtacaaaaattagacgggtatggtggctcatgcctgtaatcccagctacgtgggaggctgaggcagaagaatcacttgaactcaggaggcagaggttgcagtgagccgagatcgcgccaccgcactccagcctgggcaacaagagtgaaactgtcccaaaaaaaaagaaagaaagaaaagaaagaaaagaaagaaagaaagaaagaaaagaaagaaagaaagaaagagaaaagaaaaaagaaaaaagaaaagaaaagaaaggaaaggaaaagaaaagaaaggaaaataaaagaaaagaaaagaaaacagcttctttatatccttgggatacaactgctgttctcaatgtttccaacaggtcaacagagaaccaacatatttgagtgcagtatttacatgggacctgtggggtatgccaaacctacatattcctttgtgtaatgtggaagtcacggggttgtaaggtgcatctaccctgagaaagagaatggagtgaggtactgaaaactgtgtcctaagacacagacccagaggtattaatattactcagctgtttgattcatcagcagttacaatcaactacaagacttacaagcctaccctaagctctgcagagtttaatattaacacattagactagacatcagaggtctcaaagaacctcagcttatataccaagaggccccagaggttgaagaatatcattcctccatcttcaataagccagacaacaacgtcccagaggtaaagcaaactaattctgtcccgcccacagctctgtgagctctggcttcaaaagtttcctccaccagtgccataggttactttatcactttaagctcacttcttcatctgtaaaatgggcacaaaatgcttgtgaaaattaagtgagactatatatataaacagaatattcaatatagtttcctttcctccttagtaatttctctacgcctcctccactctccttggatttttgtcatacattctaacacactagcagggctcacctcaagtttactgcaagtatcacacacatgtcctctccaacaactaaactaggacatagggggccttaggaggcactttattgatcttagtttctctaaaatgaacacgaagcttaaactcattaactgtttactggcaacccattcaacagacctgataactcagctcctagttctattaataggacagcagtggctatcaaaccttaaaggttagaattaccagggagcctgtttaaaacacatacacccaccaacaacaactacttaataattgattccggcaaggattcccaaaagacactaaaaccataaggtaaacggtatttaggaaaagagacactgatactttgctaacatatgaccccacaagttacctaccgattgccaagggaaaaactacctttatataaagaaatctggcagtcgcaaccttaaccaagggataaaacttagcatcactaatagtgggacaaaacacgtatggggcgcctactgatatgatgccaacatgaagaaagcagtacttctgacaaaaatttgtgcctgaatgtaattcagcccctagatgcaacttcaagtttactagaaatacagagtgcaaacgacacctgcaagagacactcaggaaacgcaaaatatgagcagacaagagaaatggacaggacactggaaaaaagtcaatgtcatgagaaaaaaaaaaaaaaaacagagagggactattctaaagaaacagcaatataattcataaatttttatcaagtccctgattggaggggagaaaaaacccacaagcaaatttgctggggacaactaggcaaatctgagtacaaaacagctattagatgattttacgaattaaggataattatggaaatactcttaattttcttaggtgcaataataatattgtagctttgtagaatgattctaaacatttcatatttgaggtgaagtatttagaggtgcaacatcaggataggatatgtgttaaatacacacacatacagataaatatatctatattaacaactggccaggcacagcgactcacgcctataatccttgggaggacaaggcaggaggactgattgaggccaagagttcaaaaccagcctgggcaatatagcaagaccccatctctacaaaaaaaattttttttttttgtgaggtggagtctcgctctgtcactgaggctgcagtgcagtggcacgatctgggctcactgcaacctccgcctcccgggttcaagcgattctgctgcctcagcctcctgagtagctgggactacaggcgcgtgccaccacgcccggctaatttttgtatttttaatagagacaccatgttagccaggatggtctcgatctcctgacctcgtgatccatccacctcagcctccaaagtgctgggattacagacgtgagccacagcgcctggcctacaaaaatctttttaaacgagtaaagcatggtggcacacgcctcaagccccagctactcaggaggcataggcaagggaactgcttgagcctagaagttcaaggctgcagggggctatactcacgccactgcactccagcctgggaaacagagtgagaatctgtttctttagaaaaaaaattactgaagccaagtgaatggtaacaggtgttcattatactgctctatttccctgtgtgcttcaaagcttcaataataaaaattgagcaaaaatacacactccctggcccaactccctgaggctctgatcctggagtctgtagtaaggcctggaatccgcatgttaatggccccgtgggctctcctaacacaggagtctctgccacacttgaagaaacacagctgaagtgagaaagtcaggcacctgccctctggaggggcctgagttctagattgccctgcctgctcaacttcactggcaagcttcccaagccatgggtttggcatcttcctcaaatctgctgcctttcctcatttgtcctgtctatttaagacggaaagaaaaggaagcatcatggtgatatgaatgttttagctcacctacccatgagtgaaagcatgtggccagggcaaaccgtaattatcaaccctacctttcctccaagagggtggtgaagaaaacaatatgtagctctctgtgaaatgaatactctaatttcttcctagaaatgaatgatgagcacagtccatgctctaaatcagtgaccaagataaaacagaaattgcttcctcatttaaactaagaagacaaaaacactccattcaaaacaaaaattattttttaaaccacttgtttaatatttcaaaagtaaaagaggtcaatgagaagaaattttttgttagaaatctgtaaaataccatagggtgctgtagtatgttttgagctatattaaaataatacaatataccaagatctacccacattagaaatacagaaatgaaaaatctcatgtagaattttatgtagaactatattaatgtcactgtaacaatagccactgaattctctcagcaaattccatctttcctaaaaattcgactagtgtcaaaagagaacttataccttaatctaaacaaacaaaaaaattcacttaacagaattatttcctaaaagagctcaagtgacctgatggtatcactaaaaaaattttttttttacaaacactaacttttcaaagttaaagaacacatctcaaacaacaaattacagcaggtaattttaaggttctgacccccccccccccacaaaagaaattaaccttggtaaacaattcagaaaaacctccaaaatacttggcttaaacagatacgcatatattgctttagcttaatctaccactaaaaattttaaacagattacaaaaaaaagactactgaaaaatatagtttaattttagctgaaattgcaaattcacaaaattagctgataaagtcagcacaagtttctcagtaggtttagtctgccataaattttaacattaactaatgagatctccaaaatgtccctatacataggtgacacaaaatgagaatttgtttaataagtcaaaacaatccatggcaggacttagaactctactccgaatcagcacctaggagacatacacacttgctttaaaaatagattaagtgatcaaaccagaatctgaaattccctctttaaagctattttcaaagcacaaatacctgtagcataatgaacttttttacactgaagggacattaaagatcaatccatttaactgcttgtttgataaatatgaggaaactgaggccagtggttgtttgtaacttgcagagtgagaaacctgacttcttaattccaccagtcattcccttcataccaggctatgtcctgcgcttttcttaagtatctccaatagcggtaagcagtggattgtctttaggcaattagtcaaaagtcaatgaacttgttaaatgaggttatattttcataaattttttaaaagttttactttttaagaggcaaataagaaatccagaattcctgatgagaagaaactagatgaatagcacatcatggggagtaaactaaaattttaaccacaaacttatttgcagacagcacgttgtaaagcaaatcatcctggggtgaaaatggcaacatcagagacacagtttctttttgcatcccacagaatctttccatcccacagaatctttccaacattacagaatctatccactgcattgcataagcctgactaggcaattgaccttatgaataagtctatagtatcaaatgatgttgaagacagaaatgaacaacttgtgacttctagtaagcacctgcctgctagatttcaggagcaccagccttcttacaatacagattttgacactttgtttctggatccttctggaaatactatgctgcatccccagttgcaatttcgctccaaagcatgccattttttcatccccttcccttgaaaatttaccataaatgtcaagtttttagggttactgttcactcaaaaacaagaaataaatctttagagatgttctcttcttattcattctcctggaggaagtatctctgtctcaatttaacccacttaccctcacagctaagcaagtatttctggatttttcagatgggaggagggagaagggaagaaaccaggtgaggcaacttcatgtggttaaatctgctccttcttttccttgatggtaccaaagggtcttgcccactgcaacattataaaaaataatcaccctagtgtttttacagtttaacattttatgtttacacctttcattcttttagcatttctgtttacctaaggtagagattcatttttttttccaaatggatagtcaactgctaatatcatgttaaataattctttttctatccactgattagcaatgccacctttactatgtactaaattctcactaacatatcaatatatgtacagactctttattctcctttgcgaactatctgcttaatttctctgcacattggtctaattattgacacattatagcacatccacttcctgatcaggtaagtctcaacattcttcaaagttttttttgactactcaaacacatttatacttttcttagatcaattttactcaactttcccctcagaaaaatcccactgagtttcttttttttttttttgagatggagtctcgctctgtcgcccaggctggagtgcagtggcgcgaacttggctcactgcaagctccacctcccgggttgacgccattctcctgcctcggcctcctgagtagctgggactacaggcgcccgccaccacgcccggctaatttttttttgtattttttagtagagatggggtttcaccatgttagccaggatggtcgcgatctcctgacctcatgatccgccacctcggcctcccactgagtttcttttaaaccagaattccattaagtttatggataaaatgaaaaaaaaaaaaaagctatttttacaattagattgccacccattaataagcatataaagtacactctctctctacccacacacccacacagcccacaaatgcaagtatacaatctattaatgtgtctataatggtaccctggccccacacaaacgaatctcctcatttgtaggtatctaaatattgaatattaccattcttaaaccacaaaatcttagcattagagggacattacagatcacttatcccaacaccactcataatcccagttatgtttcctcaagcctatttaatagaatcacttcagaattaaacagaattattatacctttcacacgcaacataaacattatttgtatcccataaaaggcaaagagaagtgggctacatttattgaacactgttttgaatttgcgaattctttcagaatgagattaatacttgagctcaaaaagcaaacaaaacaaaacaaaacaaaaaaaacaacaacaacaaccaaaaaaaacagaaaacatggagtaccattagtgcatacccttgagtacacctgaggtacttttagacactcatgcttccaaggtaaagtcattttgttatggtattatccaggggccaaacttaatggtacccgatcattcctttcccaattctgccatcatatttattaagaacacaaatctaatattcctctccaagtggaataagcctgaaatccagttctcaagcgtggggttcccacgtgatcacttgtggttcttctaaaactatgacttcttgtgtcctccccagggagtcttcttcagcaggtccagcagtgcctcggcctttctatttaagtgctgcaacagattctattctcagccagaactaagaaccactcttgtaaaatagtcaacatgaacaaagacccataataaactaagtatccctacatagaggagcagacaggagggcaggggagtgattaaaaaaataataaagcatcttcaccagcccagcaacattcactgcagattttgtagagagctgcatatccaaattccaccagtctcaaatcagaaaacaacgctaaaacagagctgtagaccgctcaactggatggtgccattataaaatgcaaaatgccttttcctttttactctcctgaaggcaaccctctaccacatcccatctcacaagataaagaaccactgacgatcctcttaaatatggcaagtggtataaacaagttaagtaaattccttttactctgaaatagaagggtgcaaacacacacataaaactacatccattaaatgggagattaatgatgtggccatgaaattttggtcaaagaactgttgcttcttgactgaagagaactgacaatgcactaagcaacctctaaaagtaacacaaaagcagagaaaggacaatagcagaaaggaaaacttgcatacatcaatgcaacaggcaaactaaatcacactgctcctaaagccaaaccctccaagaaaatgctctcactctctattaacaacacattgtacaaaagtgaagcccaatgtgactcctgctcctggaataagtgattcacatgccagttatccccacaaaaagcacctgaaaaataaagcacatcaagctgtacagacgctgttacatgtttagtaattagtgggagtaaggcatgcatgaaaaagaccttaatcacacactagtgctctgcaaagcaggttcatggggccacatcattctacagacaaccattcttccatgctccaatttcagcccagccaaaatattttcttacattctgtaaagttatttgataaaagacgtcaagtatttgccatcttgacaggaatggcaagatgcagagaagtgccccactttaatatcgagggaaactaagttttattaaatcggtgttgtgctctgtccaagctataaccaaataattttacattaaaaaatgtaaagagacaagtattcacgggttaatggaatcagttttgacaatgtacaacttcactgacatcttttcttagagatgcggcccaaaccaaatgatagaaatattagatcttaacctttatgttatgtgaccataagaaatagcaaagtttccacagcaaatatgtttaaggcaacaactataaccccaaaagatcttcaataaaaacagagatgatgtatgttcaaacacattgacaagcaattgtttgccgaaagattaaaacaagaattcctctaaagcttttacatatgaatgatttcaacgcaaacaacatggctagcaggtattaaaacagcagaccatgttcctgcagtatttcaagcaaaaccatctaactgggaaaaaaaatttttttaataaaatccttcctcagtaaatactgcttttgaagtatagctatgttagaagaaataacttactaaaattagcatgtcttttaataagttaactttaggaaatatttagagatatattctaatcttgaaaaaagatgtaaaaaaaaaactagacagtaaagtcacaggcactttatatcaatgcagaggaaagttaagatcagaaaaaaaaaaaatactaccctacatacaactacaaaagctaaattgacattttaaatgtacttttcagtttgccctaaaatctggacttccactttgccaagaaacaattaacatttaggtgaatggaggtgggattttattctactccaatttcattctgtctcaaagcttactactagtaagtgtccaggacagattccattagaaacagttctctcaggaattttaacctgacaccaacatttttactgcccacacttcggcttgttcagcagaagcctaccagtacatgctgctgaattctactggtatgttaaaatctctcttccccatactttttgtccctcccctgcttcattcctggcatcttaacaaccagaaaacaacccccagcccccgcccaaaaaaaaaaaggtatctccaataccaaacacactacctttcattcgatatgactttgagtgtgtgggtgtttaggaatttagatttcaaatttaaaacgtatttcagaattttatttgaccccaagctatgcttataacagctaaaagttaatcggcattttcctattttattctctcacttcttataaacttatcagcaggaaacaaattatctgcagacaaatgcagctagaaaaaaagctgtttggttcagcctagaaaggctagtaaacaactctgggtggtgcagggcctacggaaccaccctcacttcccctagcctgaatttgcacgtaaatccagcaggagacaaagttattgcatctactctcatgatttgacttaattcaatcccatgttttctgaaacgtttttatttaaataaatgctgaatagagatctggacaaaccattaaaaagacagcagactttatttcagctaacctgggtatatctgttacctgaactactaaatgcctaaaatctcctactaagcttggagtcagggcagcctaggcaaaatgtcttctcacagaagccatgcacttgaagagcttgtccctgtgtaatttatcttcagtaagatttttttctcttgcaaatgctctcacctacaactcactgtttccagaatacacacaagctaatttaagtaagagggcacagatgtacccaggtgtgaatgggttcatttcctcagtttagccagtgaggcagtcagtgaaggccacggcagaaagaacacctgcaagtggtttgtgagggactgaactgggacacgggaaatttacaaaacgagaaagggccgcaaagccaagcttgcgtcttgtgtaaatataaatcacttacacactggcctggctaccaaaaacatcgtttccccagaataggtatccaggtggctttaactgattttctggaggtgagagttaacaccaaacgctcgcgcccatcacattttatcccatttttacctgtcgctaagaaaaggacacgtctaatccagcaaaccaaaaaaaaaaaaagtcttttttccttctgggaaagcagtggtttggagtcattcacaggggctgggagtgcaggagggggaaggggcgtggaatccaggagtgctcggaggcggcagcaagggtttttccacagggccccacgcaggccactgcagagggagaacgggggaagaggggaggatgtctcacctgggaacaaacccgaatgcagcggctggaggagggaaggctccccggggccgcgagctggggtgcagcccagggcgcccgcagctggttacctcgggaggcagggaaaagggacgcttgggaacggagctctgcagaggggacggggagggcaggttggggcaagagccccgccgagtgcgaagcggggacgaggacgggccaacggcaggtctcggcctccccgggccaaaggcgtggccagggatccagatcaaacgccggtcttttggagacgccaggggcggcgcgcggccggtccctccttcgagccccccgcgctgggccctttcgaggggccgccccgcgaagcaccgggagggcggaggggggctcctcagggccggcccgcccccaccccgcagtgctcttacctccacacctgccccatctgcagcaggtggatgaccgactgccagatccacacggagaggcgacacaggcgctgcgcccccggcgtgggggagaccctcacgcctgggccaccgcgggccgcgccgtggacgtagccggcccccatcatgggggggccccggctggtgagcccctccacggcgcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggggccgcgggaggctgcagcggctggtcccccccgtcggcggcggcgctgcggcgcggcttcctgcccaggagggagcgcaggcaggcggagcggcagccccagtagcacgaggaggtgttgcagcagtggcagatgtgcatcgagctgctctcgccgggctcgctgccgtcgccgccgccgccgcagccgcctcccccgggctccccgtcctcctcgccgccgctgcccaccgcctcgtccaggttgtgcagctgagcgaagcccacccccacgccaccgccatcggatttcgccgccatcttgactctcttcccagctccggaggttgggggggagggacggcggggggggggggaaaaaggcagggaacggggagggggggaaacaaatggaaaggaaggggggcggggaggaagcgggggagcaaacgaacgaggggggagtgggccagggaaccccctccgcttccgggtagttggcgtcacttccgggcgagccccccaatcgcacggcgcccgcagctccccagccctaccctcccggccaagatggccgccctcctgtgcctcagctgctgggcgggggaccggggggttctccccgccagggctccccttcccctcttccgttgaccccgaaacccatcaggttgacccctcggcgtttcagaatccggctggcccgagtgaggcggtccaaagtgatccctggagggggcagtgccagacgttttggggtccccttcctcagcgtcgcagctcacagctttcctcctggagaaacgccccctaacaccctcccggctgctggtggaggggcgggacctctgagggaaggggcggagctagtgcaaagcaggtgattacgtgtcacttccgggagatgggatgacctcattgtgtagttagacaacacccccccccaatcaaaatgtctatgtctcacctctttggctgtttctattttcttttaaatttctcttattcttctcttattttgagggtctttaaaaattacataagtcagattttcacaatcaagttactgattctcacttccatttagacacctctcctcttacctctgttgacctcctgattttcctgtcactgacaacttaaccaccttttgtaataaagtttccatcattaccttaaaaaagcttcaggcaaaattcaattggaaatcagcctggttgggtcttacatgttggagcaaggaatgaatgggcatattgtgaccttgaatatattttctgccctatggaaatatattctaccaactttttttttaatatgcaatttttaaattctgtgatcttaatttggaaaatgcagaactagccagggcttaacctgtatcaattatttgttcaggttatttaaatgtgtaaggagtgccttttagaatttttttggtgctaaggcgctgtgggtaaacattgctttaaataaggaaaaaaatgttatcaatgtgctatatcattaaagtaggtgcaggatacactacttaaacttagctaacaaattacaaaagtgaaacagcactgaatggatttgaattacaatgatcttccagtgaaagtatttttgaagccagatagccaaaatagggcaagctacatggttacagttgttcctgatcagatgaaatgaacattttacagttaaaaaaaagaatgagggggaaaaaaatccctgaattttctcattgacttccctagatttttgaactcatttttgtgattctgtctacttctccattcactaaagtcttctaataatgccaataactgtctttagaatgttaagagtacaaattaggtaatatttatatggctggaggttctatggcagaaaggtgcgtttgacaacttcaatagttactttgatactattgaatactatggcacctatgagttttgggagtggcagggtagatggggatactacattttaggacacagcttttcatgagtatatatgccagtgtgaaatctctgaagactttagaaaaattactaatagtgaatttttactcccatacattgggaagaggggagtgattccaaaatcaacttttagaaaccagccatataactgtatccatgtatttcatgctatgatttaagcctcatactccctatggtatgtaaaactcatactcatatgtaagcctcatactccctatggtagtaaaacttaaggccagcaggtaaagattatttctgcatatagatgggattctgtttctttgctgaatttgaatgaataacaccttacatggcataaatatagagtaggattgcccaggtatgaaccccaatttcactaaaatagtaacatgaataatgtgagcaagattacctcttcaaatctcagttttcaccttgatataatagaaataacaacagtgacttttctgaaaagttgctgggcagagtaaaggtggtaatcctttcaaggatctcaatatgatacctgataggcagctaagcactagagagtaactgctattattattactgttgttattattatgtttgcataatactgacatgtttctacttaaattctatcgctgagtgtatttggtatctctaataaaagaaagcattttgaaatacttctagaaaataggtgcaattaatttgtgctttcaaatatattttctctatttaagctacgaggctgtgaaatgagatacaaaagcgggcagtaatggtgtatttatgattcctatttctgtgtgccctgaaagaacataaactagtgaaattagctaagtaaattacactcgctatataaggctgacaaatgagcttatgagtcaaaagtgtttattacaattgaagtttcaagtagatatgtaagattctcagactgtcaagtgacttcaactttacatttgctgtttcaacaattttgtccttctactttctttggaagaaggatacattatggaacccagaaggctctaaaatcagttacaatgataataaacctctcatgaagactcactgaaaagttaacataaatctggactgtgctttggatggcacacttttacctagaattttgggggtgatttttgttccaagtaagccagcacttagcacaatgctgaacacatagtgggcactctataagtattgattaaattagtgcaaattaattttccagataactgaaatttcacctttaagtgccaaaaaaaatgtattttacgttttatgatgtaaacctccataaaattcaatcattacggagatacctcaaaactttaaagtggggggaaagtgaaagaaatgcattgcccattggcttgtgctctgcacatcaggcagaaagttgaccttttcttgacaacttgaccttgaagtggccttatgctaagaggctctaactatttatgtgcctgtgccggcctgctaagcaccaactgttgttgaggttggtggtggtggtggtagcagtggtggttttttctaacagtattttttaatctctgctttctttgtttattcagttaattaacaactttggcccctgtatttacactttaatatagacagagaagccaaataacaaagcatgttggagttacatgtaaaataatactaaatagatttttagagcctcttctatgagtaaagttaaaaagctttaacatacagaaattgtgacataaattttaaatgtttagaagccctttggggtttttcttcccaattctctattttcagaaaggcacaaaggaaagttagtgttgaatgctattatgtactaaacagtctcccatacgtgactccttttaattatatggcagtccaaaaacgcatgaggattagtattcccattttaatggtctagaaaacagactcgagtctgccaaatgagttacccagagtcacatgggtaaggggagccatagattagaatccaggcaggtgtaattccaaagcctgctacttaccctgccattgtcctgggccaggcagctactggcacttccaaatgaaattagtgttactgtgttagtcagagtagggaccctattacaatgctggtatgcagctaggaaacagaacacctcaattccaatatggggataggcctcagcaaaagcattacaaagaggctgtcttatacatttttcgtaagattttcctagtttgagcctacataaagcttcaaaagagtaggtggatgtcatcctcatcaattctgtgccttgtatcttattgacttctatagaaacaggacttctttgagtgctgaggagtaagctcatagaacccattatccctggaagctacatttctgtattcgatgttaagaattgaagtgttagcaagcactctcatactttgttgctggtggtacaaaatggtaaaatctttatgaaagggaatttggcactacttaccaaaatttcaaatgcaggtaccctttgagacagccatcccttttatgggactttatcttacagataaatacatagatgtcagaaagtatgtgtgtacaagtttattcatgtagcattgcttacaattgagagaaagaatggaaggaaaaaacccacatgtccacccaaaggggaactagttaaataaattatggtacatccacacaacagaatatggtgcagtgatgttgaaaaatgatagttttctttttaatgatatacaaagagttgcaggatgctttgttacacaaaactcaaagtgcaaaacaatagaacatgctgcattttctgtaagaaaggggaagagataaggttatcttttcttatttgtttgtatttgcataaagcaactctggaaagagacctaagaaacaaagtgattacctgtagggtggtggtaatggtggagagaaatgctgtgagtaggaacaaggatgggagaaagataataaatgtttggggggaagtttggggaggtcgcagggaatatgcacccatatgtagtgtcacagagatcggtaagaatcggcgggggtaggtacatctgtattctctaacagcaacatcactgaggagtattttgtgaagttttttgtctcttaaaaactagttataactccgacatctgtgaattgatttaaacccttcttgagcttctttatatttttatccactgtattgtctaagtaaggataaaaagcttcatgtatttactccccaaagagcagagtacagtgtaactttatcatacgtacacttaccgtgtgtggagtcaactaatcatgcccaaccaaaagaaaataaggatcgccaggtgcagtggctcacgcctgtaatccgaacactttgggaggccaaggcggaaggatctcttgaaaccaggagttggaaactagcctgggcaacatagcaagactctgtctttgaaaaaacaaatattaaaattagcctggcatggtggtatgcactcatagtcccagctacttggggggctgaggtgggaggatcacttgagcccaggaggtcgaggcttcagtgagctgtgattgcaccactgcactccagcctggacaacagagtgaaaccttgtctcaaaaaaaaaaaaaaaaaaagaaaatgaagatcaagcaatagcaaatcaaatcatacaggccacttccgagaatgagcatagagcacatgtccccagattgagtgtgagatgggaaatagaacactgtagacctctgttccttagttcctaatatgattgccttcccagacaaagtgggattctaggacttaaagccttgtgtttgtcttcccacatgccctcccaattcaagccaagtcttttctctggtcctcaaccaaagatacaagattgtatctgatgctggctcagttggccttttggccaagtgatatgatgtctccagtgcaaagaaaatttggggtatacacagttcttaggctcagtgcagaccttagatcccaaccaatactaccaggaccctaagtaacatgaaaccccactgtgatgtctccttcaagtttagacacgtatcctggttatagtaattcagaatgtgacagacaccaaattaagtctaacttcattgattctttgcatctaacttcttttggtacaaagaaatataagagatcatttctgcaatgtacagtcctattgaagacatgaaatagacgcccaccaatatgagtcaacaaaatagcattatagataagtcatgaagtgacgctcagatttacagaacaattagtgattagagagtttaacataagagattcatttgtgaacaagtatgtaagcacctactacatgtcaggcatcatgctaggtgctgaaaacaaaacacattgtacatggagctgactctagcggaagtggcagatagtgatcaactaaacatacaaatgaataattataaagatgaaaacaagaaagcatttataaaaggttttttaaaaaccaagaggtttaaacaaaatgggatctactgaaacatgaggaatcaggaagccaactctaaggtgacatttaagctgtaattgaaataggagggactatttttggtgatggcagggtccaaatgcagaaaaatacccatgtcagggcctgagctgtgagctcctcgacctgagggaggccagtatgtgacatcataggcaaaaaggagaggggatccaagggagactgagatggaagaaagaggcattccaattgtgctaaggaatttttattttattctaagtgcaaatggagtggcactggcaatagtaacaaaataattagggagaggagcaggaagagttaaagaaggcattacggggtgcggggcgagttcaccaaaatgctggagctctggacagagatgtaggcaaggggagggatgggtgtgagataaggattccacgggctcccatcagggcatcaggctgaccggagacaaagatttgcatggacaagggatgaggctagagagggaagatgcaggtagggagaaggctagggcaccctagaaagttatgcttgatgctggaggcagtgggagcccctacagtcaagacagcagggtgaagtaaagtgctaagggcccaagggcacggtgttatgggtatgtgctttgggcagtcaggaaggggagaaagggaggagactggtgattcattcatcctgctgaaatgcttcaaagagagaatggactttgttatacttgagccccatcagatctcagccttcatcatctagactttaagggtttcagcctttttagttaaccttacacagaagcgcctctgtcccactgtcagatttcactacacaagtatccattgggtgcctataatatgtccaggactgagctaaacacctggagaacaaataattatataaacattcatgccacaaagctaactttgatcctttctgtgtggtggggtcatatactgccaagtgatggttaaattatgcccttctctgggtcttccttttttaaaataaaaatgttttgtttttcttaatcacaggaggcaggctctatatttaaatcttagctccggcattaactagctatagtatttggggcaaggtgctttcttaattgaagcctccctttgttaaccataaaaagaagcagaataaaatttaccttgcagggtgttttgtgagtgtttcatgaaatagcacgtggaaaaagcacctgctactgatacacagttggtcctggccattcacttgaaggtcttccccattgccaactccctggtccattgatttgtacacatacacattttttcctggttttccagcattgtgtgatgatgtcgctgcgtaggcttcttgtgggcttttgcctttcagcacagcatatgcatgatgcataagcacgcacacagcccccagtctcaattcctgactatgtcactttgggcaagttacttctgctcttaggtttattttcctaatatatgaaatgatgagcacaccgttacccctaccagtttattgtgacttcaatgcctgatgcacacaaagggctcaaaaaatactcgtcctccctccctagtcacttccgctatttgctttctatgactgctgtaacaaagtaccacaagcttggtggctcagaacattacaagttcatctgacagtcttggaggaccagaactccaagaggggtcttacggagctaaaatcaaggtgttggctgggcacagtggctcacgcccatattctaacactttgggaggctgaggcaggaggatctcttgagcccaggagttagagaccaaccctggcaaatacatcaagaccccatctctacaaaaactgtagtccctgctactatggaggctgaggtgggaggatctcttgagcccaggagttcaaggctgcagtgagctatgatcacactactacagtccagcctgcgtgacagagtgagatgtctcaaaaactaaataaaataaaaccaaggtgccagcagagctgtgttccttctggaggctctaggagagaaatccattttcctgccttttctcggttttatagtctgcattccttagcttctgctccacttccatcttcaaagaggggaattgcttcacccaacctctgcttctgcctctgcatctccttttctaactctgacttgcctttctattttttcttatgaggacccacccataatataatttaggataatctccccatctcaaaatccttaaatcaaccacatctacaaagtttcttttgccacataaggcgacatagtcccagatttgggggatgaggttgtggtcatctttaaggggccatgattctgtctaccacaccctttagctttttcctaatgtgcaaacctgaactcatcacccttggcccaaaaatgaaccatctcctccagtttttcgttgttttttgtttgtgctgccatgatgccagcttcactgggtcattgaaacttctagccgatgacacataaattccaagacgagtgagccagaatgaacttgagcacaactgccctgtgacagatgaggaaaaggaagctgaccacagaagaatgtttctattgaaggccacactggttgccttagcctggggactaggatttaaattcctgatatctgggccagggctctttccactacattatgctgatacacatatcttataaagttgcatagcttcctcagttttaatgtttgaaatgtctttttcttaatggcaggaatactgggcttagaagttgtattagttagggctcttccgagaaacagaatgagagagagagagagagagagagagagagagagagacctatcactgcaggaaagccagtggtttaatcagttctttcttgagagagagagagagacacctatcactgcaggaaagccagtggtttaatctgttctttcttgagaactgagggaaggcgggcagtggtgtaaatcccagtctcccagtccgagtctgagggcttgagaaccacagcagcgggagaagatggatgtcccagctgaaacagaagcacatttgcccttcctctgcccttttgttctattcagaccctcagcagtttgggtgatgcccacatgtattgatgagggtgatcctctactcactctacagattcaaatgttaatctcgtgcagagacacccccacaaatatatccagaaataatgttttaccagccatctgggcatcctttagtccagtcaggttgacacataaaagtaatcatccacagaagttaagaaaaaaagtaggtatgagttccagtgacaccgtttaccatgtaccatttaccagctatatcaccttgggctaattcagattgaatcacagttctcatgtaaaataagaatattaatatctcctaaaatattaatatcttctctaccttcctacaaggcttgtggtaacctctcttgtaggcttagtgggtatcttctaaatcagagaggtgtaaaaattttaggaactatttttatccaagttaaggcctcctaccgaatctccccgactatcctcttctttgcccatctagcctgcttaccagcatcagactaataaacctaaaatactataacatcatcctatttagaggagatgtcatggctcactattgcctaccataccaatccaaactgcactccttcattttcagatcttccataatctcacttcaacctacagagccactattagttttcactattggccagaacacactttgctcaggaaaatgtcctcctagtccacatttaccagtgctcattcctgcactggagctcctggtcttactttaattcatttgcaaagtctttcctcctcctcgtttgtcta

SEQ ID NO: 1343 - DNA, 110581 bp, Homo sapiens
caacacacaatagaaacagattctgaattggcattaaatattggaattgtcacacatacacacggaagttaattaacaagtctaaaacatggatattttgagcaataatgagttataacccatgaaataaaataggaatctatgagtttatactgacataaataagtgaataaaggagaaataaatggataagggaattccagtaagtgtagaaaaaacagtggaattagaaaaccggcatttggcaagcattacagcaatacatatgaaatacatagggataactgattaacattaacatcgttttctcttgatgtttacatggtgtcttttttctatccttttacttttaaagctccctatgttttaggtcagtctcataagcaacatgtagttgtttttctgtggtttgataatctttgtcttttaattggatactgaatgttttcatttaacataatttgtgaatacatttgggcttacatccgtgtgttttctatttgtctcacctgttctaaattgctttttctcttctgcttgcctgttttgacgtgattgaatgccttttatccttttattattacttattacttttgctttcaaatgaaattccaacttcatacatagcctacatattctaaacttcaattatctgagcaccagtaatttctgtcctatttccacactgactacttaatttgtttagttattaacatttattccaaaaagaaatgttatattgccacagtaaactaaaacaatcagtaccacttgccatgcaaagtaactagaacatacagaacttgttttatactctactgtgggaaacacttccatattccacaaggctttgccaagatatatacctacaccaccccaaatggtagccattagccacatacagctatttaaaagtaatgacaaaattttaaaactcagtttctcagtcacactggctatatttcaagtgtttaatacaagccacatgaagcttgtattggccattttttggggggcagcatttacagaacacttccatcattgtagaatattctgttgaacagcactgttctagaccttctctctagcaacccccatcccctccacccagtggtgagccatagtagtattttcgtcttggaattcaccaaagctcttttcctaggcctttgcatatccccatccctctgcctgaaatactccttccccttttgctctttgctagcttcttttcattttttaggactcatctcatacgtaagaccttcttgataatctgaagtagtacccaactcccaatcgctacacttatttctcatctcagtcatttggttttttctttaattgcaatcactgcaatttacattttattcatgtctatttacttcccatctttacctaagctactccaattgtacttctatcacagtataaccaggtggtggctatcggctgtaatccgaacactttgggagactgagatggaaggactgcctgaagctgggagtttgagatcatctgggcaacatagtaagatcccccccccaccttttttttttttttttaaacttgagacagggtatcatactgttgcctaggctagaatggagtggcgccatcacagctcgctgcagcctcaacctcttgggctcaagcaatcctcctgcctcagcctccctgagtagctaagactacaggcacgtgccaccacacttggctaatttttgtattttttgcagagatggtgtcccactttgttgcccaggctggttttgaactcttgggctcaagcaatcctcctgccttggcctaccaaagtgtttttttaatttttctttttaaaattagccagttatgatgatgcacacctgtagtcccagctacttgggaggctgaggtgggaggatcccttgagccctagagttggaggctgcagtgagctatgatcctgccactgcactccagcctgggggtcagagaaagaccctgcctctgaaaaaaaaaagggctgggcatggtggctcatgcctgtaatcccagcactttgggaggccaaggcgggaggatggctttgaagccaggagtttgagaccagcccaggcaagaccccatctctataaaaataatttaaaaaagaaaaaaaaatatgaaagaaacagctcaataaagttgagaaagtatgtttacagatgcatgtagaaagttatttaataaaaatatttcaccatttaaacttggattccccagagtgtcattcaaaatactgaaatggaaagatcaacaaaattaatgaataaagaaagtttattggagattattaaagaaaaatgataaaataaggcaagtcctagatcagatttaaatacaatatttagaaagatggctatataattttagctaggaaaatcagtaaaagggaatatccttaaaagtgggaggggttcatataaccttttaaaatagcaagttgaggtgtaaaagcatcaccaacaatagtatgtaccttaatctttacacaattggacagtgaggagcaaagtgggagattctaccaatgccacttacagaacagattttcaagttaataagtcataaaatcctaatgtagtcataggctaggatggtgacgacaatctgcaattactggtcagagtgaagcgaagtgacaggtcagatttttcagcatatcaagttactacttaggtatgcttacaaaactttgttaaataaagttgggtattgttagtataccctttactaaatggtgaggatagctgccaaaataatcaaaaggctaattatgtgttaactctcatttattttggattgcagacatactcttgccctttatctatctacacaattccttattaccagcagctggaatccagttgtgcaattatggcaactggacagacctgagccgtcagttatgagatagatgaccttttaattgtactagcaaacaatttatagactggaagattgtttttcgggaataccagtttaactgagactttaattatggtccaagagcttttatgagaaattcaatcaaaaattttgctttagaaaaattttataggtatatgttactaatactgagaatggttgaattaaaagaaattgagactgaacagtacatttccactggaaacataaagctctgaatgctgtgactgagtgaacaaaggaatagttctaaattttcttttgcaacatacataacaaaaagatttcaaactgaaagacaacaggtttaactgaatgacagatttaactacatagttttcattctataaataaataacttgtgaaatatccctgaagtcagtggacaaatggggaaaccattatttttgtcatattctacaattctgagaactaggattagaaattctaggactttaaatctttgtgctacagagaacaatattatccactaaaatcaggaagtggcttcctgaagggtattcattctctgaggtcatacattttttttttctttattcaaaacacttagtaaaggaaaaggacacaaggaaattctgattaaagtcttctcctgctctgtttgcaattatacatgctttcaaagtcatttgaaagtaagaccatttcctttggcaggtatcttgtataaagtaactttacaacatatgtttcttgaacagaaactttacaccactgtcattatgttacctatagagacaaaactactaacacaagtaatatgggcttacaattataacacaaacctgtgagagggcatgataaaattaaattttgattgccttcttttattattatcactactactgtctgctcacaaattctgtggccagagtccatttcaaatccttctaagagtccacttcatgagttaaacatatacatatagaacaaagcaggtatactgtaatttttaaaagtaaatctgttttacatagtacagctggaggcagtttaatataatcaaaagttatagctctaaaaaatatgatagtagaatattaaacctcaggttacgttaggtttgttaactcttgatttgctttgagtaatttttttcttcaaaagccacattccaagaagatgccttaagtatcaatgagctatatttgaagtacatcaactctgtttaaagctgtccaacaataaggacacaagcagtaaaatatctgaagcatgaaacatgtaatgttgatgactaatgttctagatcatcaggaataagattaacgaagagcaaagtaaatctaaaacaaggaaagggaagatacatttattaaaaataaaaatagtacacaatctctgataacaaaaaaagcatttagggtcaaaagacatccaacatacattgtaacaatgcacacatattaattaaaaaaaagacccatgaaataatttttaaaaaactttcaaaaggaaaaaactattttggcttccttctgctgaaattcgcctataaacataccacgccagctagaccagcattccctttcacgtggtctgtacaacatagtactgcacaatgtgagcaattactttgatgaacacattgtttttgaataaaattgttggttctgtatggatgatccagacataaatccatggttccatttcacaaaaatattcataggctggaagagcagtgacaaccattttccaaaatcttcagttttaacaaaaggcgcagaataaactactaaatctagatgttttcacattattttgcatgagtgtcaaatactatgtaaaaattaacgtaaaatcttaagttggccaaaactagtgtctctaaagatcaaaattcttcactcttttagcatggctgataaatcttttctgcctttgtcactaatgcttgtcaaaccaaagaactttgcaaaagaatatgcactgctgaaggaagacagtaccaaaaataccatattgaacttcggtcttaagacacacacagttcctgttggatactggactgtgaaagtttattatcttcagtcttttcatgtcctggagcatggcaagtagtcttccgcttaaataaccgaagactcaatcgaagtaattcattgtctaccattggagcactcgtgtaagcttgttttatggtgccctatttgaagaaaacaaaaacaaactttaaaaaagatgtacattattagtaggaaagatgggcaggttaacctctacccaaaatatcaaagttataagagtatttcattttggatattaaattagctttattggatttcaaagcaaaattagaaaatgtgtttgggctcaatgaatctttgaaaagaaacttttagagggcacctagtttaacctcttgcttaaagtaggaatcctctcaacaatttctgacaggtaatcaaccggtttttactttatcatttccaatgacaaaacaaacaaaaaacacactgcacgttctgttgttgaatggcactatttcttccatgtgatggaataaaagctcttctatggtgctacactgtaattcaatcttacctttacttgacaatccttcagttctatgaaggtaagtgccatgagttccttcctcacatagtttttccttctgtaagccaaacattctattctatactccttaccaatctttcaatgtcccataaaaagtgagctcgaaaactgaataaatcctttagaagacagctaatcatgcagtatgctgaagaactactacctcccttatactaaaatatgtatctatattattgtgacttaaagttacattagcattttttggaaagttattgtcatagagaagggaccagggaatgttacaaaatacaaaacaaagaaaagtgcatactgaaatcagggagcaaaggagaatgactgtagtgattctgtcaaaagtaatcttgaaccagacttttaagtgaggaaaacttgattatacagtcaagacatgttttaaaaatctcctgttcctcgtatttgtttccattttaatctttggagataaactcattcttctgttttttaaaaattgaatcccccctacccactaccctaaatctgagtatttttctttaatgaagtaatcttttctttagcaatgttatatagtcaaagataattctgttttcctaactgccccaagtaaaaagctagtgaagttaaccattttatcattactctaaactttctaagcaaagaatcacaccaactctcttttgtcatccaggttgagtagtcctcaactgaaatgctttggaccagaaatgtttcagatttggaaatttttttggattctggaatatttgcattacatttacttacccagttgagcatccctatctaagaatccaaaatctgaaattctccaaagagcatttcctttgagggtcatgtcgatgctcaaaagcttcggattaggaatactcagtctgtactacctatacccatccactcaccaccccaaataaaaatcccagtttttttttttttttttttttttttgagatggagtcttgctttgtcgcccaggctggagtgcagtggcacgatctctgctcactgcaagctccgcctcctggtttacgccattctcctgcctcagcctcccaaatagctgggactacagatgcccgccaccatgcccggctaattttttgtatttttagtagagacagggtttcattgtattagccaggatggtctcgatctcctgacctcgtgattcacctgccttggcctcccaaagtgctgggattacaggcatgagccaccacgcccggccaaaaatcccagtttcttaactttaaagagtctaaaatgttttcatcttgggtttaccagatttcattaacagatctcttccaaatctaatttctattcctcttacttctcaatctctttattcctctcaaatgcttatatagagtcgctttatttccctttcttccaactttgtatattctcataaatactactctcataaatatcctcatcactctaagaaatttttttccttgagtttcaatttaaataaatttttgtaatacgtttgcttgttgaaagcttttcacaaaaaacgtttaacagaaatggaatattttaaactttattaaaacaaaattcattaatactgttgaagtaaaataaagcatattatacattttaatggcattcttctttttacatgtataaaagattaggaaaccaaactcataaaaacataagattgcaatctcaatttaaaacaaccaaatgaaaaataggccattcacactattcactttgtattttttccaaggaaataacagtaccttctcatttttaacaagctgctttcgaattgcagaatcccgtctgaagcacaacgccttacaacatgggccaagattactaagaagacttgctctttcttcttttcgtagtaatgcagccatattgagagcccccaattcatgttcaaagagattgtctgcatctttcaaaaaaaagtaaacatgcattaagttttactaaaatagaaaagggttaccaactacttaactgaatattctacaaattttatactttattaaagttagcaacattggtgaaaattatttcacattaaaggcaatatattctctgtgaagcaccttcaacacgtagttatgttggtagtctcaaacaagaataaatattctgatagccactttaaatttacttaaaatataagaaaagcagactgtatgtggatctcaaggtagagcccagggaattttttttttaattttaaacaatttatttatttatttattttttgagataaagtatctctctgttgcccaggctggagtgcaatggcacgacctcggctcactgaaacctccacctcctggattcaagcgattctcctgcctcagcttcccgagtagctgggattacaggcgtacaccaccacacctggctaatttttttttggtatttttagtagagatggggtttcaccatgttggccaggctagtcttgaactcctgacctcaagtgatctgcctgcctcggcctcccaaagtgctgggattacagccatgagtcaccgcccccagccccagggaatttatttaaagaacgtttttaaaggatgttttaaagaaacgttcaagttaagaatcattgaactctaattcagtatactgcttaccatcaactactatttagagttttagatttcaagactttattatagcaagattcaaatgttataacaatattcaagtctgtgacctctaaaaaaattagttaagaaagtgattgttagataacctgcaaactttgtcctagatttggtcaccataaaaacctgggacaatgtattaaatttaaatcacttagttttaagtcacaacatgcaaggtaggggagaaaacactgaacatacaaaaaaaccccagaagaattaaggaaagatagaataaaatataaagaggttaggttaaaaatagacacaaaggaagtcaaaataacagaacaggaccagtcagtaatccaaataaataagagtcggtcaagagtacgaaagacagcaggtactgcctctattcatacaacacgctcaagcaggttacttttacaacccacaaagaaaagcagtaaacgcctgggtaaaaataaaagacacattttactgagaacaaaatgaagctgcaatacatagccgatttcaattttctgggctgcaaagtgtaagtattgagattagatagttaacaagaaaccagtcttaaataacacacctagtcaatagatgtgtaacataagaaaggtgtaaatatatagaaaagcccgaaactagttctcaaacactggagtctatcaggatcagctgaggagctttttaaaaaacattccctgggctctatcaccagatttgcagaatgagaatcaccatagttggactagaataccttaagggaaaaaaggggcagttttttcagatgattcagatataccaatgtttgtaccaaccaatgatatagtcatatatgcacatgattaaaaacaaaaacaaaaacattaactaccattccactacagatataatataaaagaaatgcattgagcctacacccttccttgaaaattgttcattaccacacatttctgtttattgggatccttatttttggctttcaaaatagtagattacaaaacacatacctgcaaacctcctcagggagtataaaacatgactaaatttccagtctctttaaagttttgaactgagcagcaccaaattactcaagaaacagactaaatgcattcttaaaagtttagctcaaaagaacttaaccaacagagagtagaatgatggttagtagaggctgggaagggtagtgggggtggggagatgtgggggtggggagatgtgggggtggggagttggggggatggttaatgggtacaaaaaaaaaaagaacgaataagacttagtatttgataatacaacagggtgactataacaccctgttgtagaaactgttattgtcaataacaatttaattatacatttaaaaataactaaaacagtaattggattgtaatacagaggataaatgcttgaggggatgaatactctattttccatacatgattattaacccactgcatgactgtatcaaagtatctcatgtaccccacaaatatatacacccactaagtacccatgaaaattaaaaattaaaaattaaaaaaaatgaacttaaccttagcgcaattagaaaacagacaaaagcaatttcaatttcagtacacttataaattttctgttttaagctttagttgtttcttttaaaaattatatatgaaatatgattatgttttctttcatgttggtacacttgaatagacaaaatggaaaagaaaaatcagtatcaattatttcataaatatttactgaaaacctactatgtatgtcaggcacttttctgggcaatagcagaaaatatagatagataattagaccttggatatggcagtaaacaagacaaagtctttattcaagataatacatcagttctctaatacaaccaccatagcagcaaaaatagaagaagtctgattgttaagccacatcaccccaccctttacagtgcatattttcactgtttaggttaagtcatcaataagtaagggccgaactgtatttcatgggtagcaaaatcaaaccagattttaacttgaaatgctactagcaaaaggtcacagaaacaaatatctttagaggtgggtaagattttaggggttttattccatcactttacaaataaaattgaggctcacaggagttatttgcttaaggtcacagaaccaaccaaacaaggcagatacagtagggcaagaactaagtcttgggtcatttttcggttaatacacgttaacaattatatgtattttgtacatgtatactctaggtttattgggctatattaaaataaaaaaatttactgcttatgctaatagagtaaaggaagggcatgaattcataaaactcataaaacaatatttttttattttgtattagtgaaaaatttaatactaactaaacttttatgtccagggacatgacgtaaaattgttaattaatgttgttcctttcaccttttacctccttttccttctttttaccatctactcgtccctccccattaataaagtattagtaagttgcaaaataaactaaggtaggtactagatgagacagagacagtgaaaaccaaaaccaaacaacccctaccaccagaatccataagctagataatctggaataactgaaaattgctgcagtgaggtcaaaaatcagcgtgataggatattttcaaagtagcagttaatatttattgggtattactatatgccaggaactgttctaagtgttttgcctgtaataactcatttgctcctaattaccataggaagttggtggtatgattattcctgacttacagatgatgacactaacacacagattaagtaatagccagtaagtggtgtgcctactgaaatccagatcatccggccttacagaccaagctcttaatcactttgttaaagactcaacctacacacctgcatttgggtagatgtctaggggaaagggctgccaaaatacccaatttctttagacatgaaaaatatgtagtctgtttttcctggctctgcttcatttagccaagggcaaaccactgagcactttgatattagaacttattggttaatttgtttttttttttttgagacagggtcttgctctgtcacctaggttggagtgtggtggctcaatcatggctcactgcagcctcaatttcctgggctccagcaatcctgctgcctcaacctccctgagtagctgtgactacagacatgcaacaccacgcctggcctgttaataagtaattttcatacaaaaaggtcattgtactcttttcccaacttttctgtgggataactcttcttctcaaaataaattttaaagagaaactttgaccatgagggttaaataatgattataaaatgatttctcaaaaaatagtttctacacagtgttaagtgctacataagaacagatcagaatccccttcagatggcatcttaaatggttaacagacattatatagttaaagtaaaatgaaactacctttgggtttttctaaaagtctctgacatgtttctttgactttggcaaagagttcagaacctgccaactttttagaaatcccaactcttagcataacagctccaggtgtgaattttaagagtgcagccccaggctctcgtggttcttttggatgctttggcataagaccagaccaatccacatctatcacatctaagggatctgtaaaaagttaaaaagtaagatttgttttacaccaagaaatagcagtcttgttatctacatagacatttacataaatcaaggagaaaacagaaaaaatgaaaagtactttaaaccaaaaatgtcctattcttaaaataaaagccttcccatataatactcagaatctaaggactctgacaaataaaaaaccttcccaccaaaagaaaacaggtaacccaacccacccatacaaataactcattttaactccatgggagatccccaatgaaagaactctattgatttcactcagattgggtctgatcttttgaaacttggtaccagaatccttttaagggttaaatctaggagtacatgtgtttgcagtgtgtgcacacatacattttaatttttaaaaacaactatttcattatgaaatccctttaagagtcagagagtgacaattattaacactgagagcaaataatccatccactgcgaaggaacagttgaagaaataatgttctacttagaaatacctgataccagaaaataacaaagataacaatcatacataccttctacatcagtagaaaaaattgcaaaatataagagcaaattaaaataaaaatttcatattttatataatcaaagaaaagatcctcactgtgatttaaaaaagttgttagtaacaatcagacactaattggaatgattcaagaggaatattaaggggtgttgcttcatggtataatcactggaatgagttccagcaacacacaaagtactgtaagtcaaaataattaccaaatttagaaaattgatagaggtatatagtgttcaaatataatttcaactactgtaaatttttgacaggttgtttaaaaagttggcttgtgtcaccacagttgtgaagctttgtaccatataactaccatgtagaaagaacattgctagacaatcagtatttgtttagattccaagtcatataatatgattcttaaattctggaaaataaactttagaattttgctattttaaatgaggccctttctaattcatagacaatgcctacttaaaaaggagtaggcatataggctataattttcattttattggcctttcaaccttaagtaaaatgtaaaaggaaaaattctaagtgtcttaggtcaatttttacagagtagaaggtaataatactttaatatcatataacagataattttcatgtttaaccacctctgcaaatagttacctggcatcttctcctcatcctgttggtcctccctcttttctgcatcacctgccagaatttcatctagttcgtcatcactgattggctcgtatccttctccagcaccagagcctaatgaatgtgcatcatctaacttggactcgtcatctcctgctaaatagacaaattaatttcagatcaaagacaacattaaagggagaggatgactaagtcaaaccaaaaggtagagggtacacacattataacaatgtgaaaaacatcttttcatcagaaaactgtatctcttaattattcaaatacttgataatatcaaaagaaaacaaaaataaaatttaattagttaaattaaactttaatagcaagaatacaatctggacagcaattatgagaacagcttataagatcacaataaaaatatgacaaataaaagctactactaacatactaatgttgactgtgtattatttttgataatttaaaactttaaaactcagacaaatctaacttcaaaagattttgaagttatattttcaaattttcacaatttatctaaacaaagtaatttaaaaacttgcaaacatttaaaaaatttactcgaagcttaaatcttagttcatattatttagctcattatataaactttacaacagtgaggtaaaaatacaagaagtgtctaattctctctcaacatctcaattcctcctccctatctcaatgatcttcttgcattgatgaacacaatttttagaaaaatgctttaatacaattaaaaataactttgttagttccactagtgtatgttctatttttttattttaccaacttttttcaaccacctatgctaaactttgtctcttggtgagttagttgtgaacttaatcctaaaattacagaatacacttaacgtttacaatcactagctaaccatacatttcactgaatctacaatactaagtttcaaaatgtaaccatatgctttatgggtatgaatttgcagcaaataaaatataagaagttatgagatgtttctagtcattctagtgattttccatgttattaaattctataataatctccccatatcctcactaagtcacttctaatgtaaccaattttagtaactttgtcatataaacatacatctaaacataaatgcacataataggattttcaacttttcaagttgatccaactcattttcctactttgagtaaaaactttacatcacatagcaagtgattcacctatacatttctattctatattatctgtgatcataaccagcaaattatatattttagagatgagggatactgactccaatcacaagagagctattataatgattaattcaattatattcaattatatcccagggttgtacctccatcagaaccatgctttatgatttgatgctatttatactcaaaattgagatgaaaatgtaatgtgaagagatgaatttgaaacagtaagtgcctcgagcagagaaggcttcatcgagaaaataatgtataaattgggacttgaattttgagtaagaaagatgagataaaagaaaaaggtctatcaggaaatggtatgagtgggtacaaagaagggcagagaatggaaaggcatgagtcagcttgtctagtaaatgggggctgaagggtaaagaacagaagcatggagagtgaggtttcacatagctgaggctggctctgagttgatgcggacttagcattcctattctaggactagggagtaccagtgggattctagtcaatcctacattaaatacagttttaggtagtgttattgtttcatatatttgttctcaactgccctagaaaatagggattcactaataattatttgaatccctctctgaactaagaagtcatttcaatttttgtaatcttatttttttaacatctaagaaaaggatgtgatggttattcttcaacatctatacacactgcatctaaacaatcttttatttcatttaggtttatgtgaaccaaatctgccttaatggtactgctaaggggaccacattaaaaaaatatatatatctctatcttacaggccttttccttctgaaatctacttcctctatagaagaatggagaatggagtcaatttgcccattagtgggtgccctttcaaaagaaaatagttgtttcccacgaaatctgaaaagaaataaagcagtatcacagacaacagaggtagcactcaccttccagactctcagttctctcggatttatttgtttcttcaaatccctgcacagatcccagatctttatccattctctctttatccaaggctagagagtctcgggaagtgctttctagatccctttcatgttcaccttccagttttgcttcacagcgtttcacagactctatttgagaactctcaaaagttctgtctctgtctctgtccctgtccctttcaacagaatcagaaattagtctctctctttccctatccaagtctctccttttgtctcgttctctctctcgttctcgttctcgcaatctatctcgatccctgttgcgtggccaatctttatcagcatctcggtcccattctctctgcctcgtatctctcctctctctctcgcgctctctgtcgtgttcatatcgatctcgttcttgaagcctgtctctgctatcaaatgacccagatcttgaatggacctgtcgatctgactctggagaacttcttcttgaactatggcttcttgaatcctggcgatctaaaataaatataccatatataaagagttattagcacatgataaaatagaaacaaaatgcttcatttcaaggtcctttaaaacataatttacctttttccatattctatgtaactttctatgttccatattgtctctatatgttctatatatttctatattctacatatacatttctctctataaatatccaaatatataaatcattttaagaaaaattcctctctcaaagttctaataaataaaaaaaaaagtttccttgtctatttccactataaccataaaatatcttccaagaagtacataaaatgattaggcattaatagaactaatcactccattatttgatctcctcctactcccctatcttattttctgtggtcaaaagaggcagccttgactgcatgaagaatagcaggaaggttaaaatcataggcatcaataagggacttgaacacataaacccttccaccaagacatactactaaaatcctgatattaaactgattaacactactgtatgtatttctattataatgttggtattaatgtgataacaggtaacattttgatagggcagctaaacttttctttaaaaagttgcataaaatttaaggcagcatgtaaagtaaccaatttagcattactttagaattaaaatgtgtataaaatatactaacctaggaaacagtgactagatcacaattcaattttattacctgaagaagtacttcgactgggttctccacgctttaactgatcaatcctagattttctctctcctgtgatttccaggctttttgttttttctctatctcttgagccactgtgcagtactctctttcgaccactttggtcatctccacttcgatgggctgaatcattggatggggagcgaagacgaccagacgtatgactacggttactccgattgctcccgaggctgctgctcctcttttgatccataggcttgcgatgctgtgcatcttctatagtcacgtgaggcgtctctactttttctactcgtgttctgtggcattttctgtgtgagtcttcattggcaaaagtattattggtggtattggtgggggtggcagaggtggaaatagtgatggcagatgtgctgaaagaggtggcggcagcagcagtagtggcagcaagagttgcaggcacagttgtagcagtggcagtagccacaggcggtggaggaggaagaagagaagatagaggagaaggggtactaccaggagtcgtggcggtggcagtatgctctgcttctgtcacctctgtacggtcagggacatcctcatcagaccagtcactgaatgctgtatcttcttttttctgggagtcctctagaataccattcttaccattgcacatttcaaccaattcctctttagttgttatagggggagtccgtgggcctcttttcttcttactttgctgggctgcttcttcatcagaaatatcagaatcacctttggattttttacgttttttttcaatgcttttctttttctgtcctttttttggtgaaaatacttgaccatcttcagatgttgtctctatgttacccctctctattccaacatcatcctctttctttttcttaattggtttcttttgaatttttgctttcttcttgttttcatcatgagctcgatcagatgtctctcgatcttcagactggtggtgtcctataatgtcctgtgcacgcattcttgagctttccaggatttctgtctgttctctctgtttatctacagaagaaactttctccttgagttcctgttcttcgtagcgccttgaactctctttcctttctggtttacgatcctcctctttccatctaccctgtctgtcttctgtgaggtgcgagggactaagagaacgagattcttgaggtcgtacaacttggctcaagagtctgtgtttttcatctatataaaagataaaagcaatcacactctcaccaggttagtaaccactgcatggtacatatagattataataatttctcctcacacctgtaatcccaggactttgggaggccgaggcaggtggatcatgagatcaagagatcaagatcatttaaaaacttttaaaatgacaataattttagtaaaaataaaaatatggctttactataaatagtagaaaatgacagtactctaacacatactttagtcacaaaaggagatatttagaggcagcaaagcaagacaactttttaaaaatcttaattcatcagttcctactagtatgaaaggatggtttcatggttacaaatgaatatgaatatagagagacagaaaacagagtctgcttacttttatcatctccactgttgtaggcatcactgtccggagaatgttcacgccggcgcttcggggactgtctagggctgggactcccttcatttctatagcgcttcctaaattggacaagcaaacacaatttataaaattctagggggcaaaaaaagagatttttttgtttttactagtatctctttactataactggaacatataattgtaggaaagcaatattgccagagtgtatcatacaaaggatattcagtgtctttaatacaaattctttacttcatttgctaagaattgtgaacttaaaatacacaacatttcttcttcttcttcattatacatgtagaataactcaagtgaaaattgccagatttaaatactgtaaggtggtaacatgcagcacagaaaccaatatattaatgtaccctctgatataaacattcagcaattttgcattcttatgatataaaaatgccttatgctgcagagctgaatgagaaaacctaatattggctttgaagtaaaaaagctatgagttcaacttataactacattagttattacgcagccttaagtaagttccttgaagtcactgaaccttagtttctcatctgaaaatggtgggtggggctgaatgggtgggaaatgagagtccatttcataaaattgcagtaaggaataaattagttatgtcataaacccagtgccaaatatgttgtgggtacaccataaaattagttcctttccccttcatggaaatcactttcttgctgacaaattaataaaataattcatacgttcattatattttttgttccttagttgagctttaaatgagtagcgttttatatctcttgggtacttaaattattctagtgttttcccccattttcattaaaatttgactacctgttttttcactaacattgtttgtttataaatactatggtcaaaagttaagaaacatattgtatacatggaccaatggaacagaatagaaaacccagaaataaagccaaatgatcttcagcaaaagcatacaaaacataactggggaaaggacactctatttactaaatggtggtgggaaaattggcaagtcacatgtaaaagaatgaaaccggatccctctcagctcaaacaaaaatcagctcaagaaggatcaaagacttaaatctaaaacctgaaaccattaaaattctagaaattaacactgggaaaactcttttggacactggcctaggcaaagacttcatggccaagattctaaaagcaaacgcaacgaaaccaaaaataaataaatggaacctaattaaactaaaaagcttctgcacagcaaaataaataacaaagacaacccatagaatgggagaaaatgtttgcaaactatgtatccaacaaaggactagtatccagaatctataagaaactcaaataaatcagcaagaaaaacataaataatcccatcaaaaagtggataaaggacacgaatagacatttctcaaaagaagacatacaaacagccaacaaacgtatgaaaaaatgctcaaaatcactaatcatcagggaaatacaaattaaaaaccacaatgagatgccaccttactcctacaaaaatggccattaaaaagtaaaaaaaacaggagatgttagcatagacatggtgaaaagggaatgcttattcactgctggtgggtatgtaaataagtacaacctctatgaaaaacagtatggagagtccctaaagaactaaaaggagatatttgatccagcaatcccactactgggtatctacccaaaggaaaagaagtcattatatgaaaaaaaaaaacatgcacatatatgtttatagcagcaaaattcacaactgtaaagatatagaaccaacctaagtgcccattggccaatgggtggataaagaaaatgtggtatatatacaccatgaaaccatggactactactcagccataaaaaggaaaaaaataatgtcttttgcagcaacttgttctcacctgtaagtgagagctaagctatgagtatgcaaaggcatacagagtgatataatgggctttggagactcagaagggggagggtggaaggggagtgagggataaaaacgtacatgtttggtacaatgtggactactcaggtgacaggtgcactaaaatctctgaattcatccaggtaaccaaaaacctcttgtaccctaaaagctattgaaataaaaataaaacaaaaacataccagcacatgtatatcatagacagctcctttatatagatgaacaaccatgtggagaaggccccaggtgtaatatgacaactcacaggcccaagcttgtgtactactttatccaaagctcctctcccatcaataactggcctatttccccatttttcatatctaatgacttgctatgacaagagaatgtggtgaaagtgacactgtgcaaatgtgaagaggattcaggaggccttgctgcttcagcttctgccctcttgttgtttctaccattacatgcaaagcagagtttagactactgaaggccagggggtcaagtggaggagaaacaagatgccctaattgccagacacatgaatgagacaatcctgggcctccaggcccagctgcattgtcagatgtaatgttgatacaggagttactccaagtgagaccaacagaacaaccactctattgagcccaggcaaaactgccaatccacagaatcatgagcaaataaatggttgttgttttaagctactaacttatgtggtgatgtgttatatatcaagagataactgacagactggaataaagtgaaaatttaaaacatgagaaaaagttatttcaaggaaatacctaaataaacacaattagagtaaaataaatacagcaattaggcaaacgttctacataagagcagttaaaaaaagtgctggataaattgaactactgagatgacaatacagttaatgaaagattaagatattaatctcatgtaattagtttctgttatagagttattcaacttctaaatttctggggtcattgtcaactcttagattgtctaaccatgaaaaaccagaaaaacttttgctattataagcagatatcagaagcatgaaaaaaatacaggttgcgtatcccttatccatgaaatgctttaggttttgaatatttgcattgtacttactggttgtgcatccttcatgtgaaaatctgaaatgttccaatgagcatttcctctgagtgccatgtcagtgtttaaaaaacattagattttggagcatttcaaattctgaatttttggatttgggatgctcaatctgtactaatgaaagcagaggactgaataaaagataaataacaaagatttcagaattttaatcttagaaaataaagaggtcagaaaagtagcgggtggggagggtgggaatatgtacctgtgcctccatgtgttaaaaaaggtatctctgaagtttatgttcaggtaagatttttcaaaatgtaaggagagggaagcaggaaagtaatccaaggagtgtactacagaaaaccatggctgtagattaaagaacagccaagacctaagggaagaaagttctacttctgtgctgtgttgtttggccctaaccataatccacaatagtgaggatgaaaaaagcctaaagcagggaccctgtattcgccctgtggcaaatgagttggaggtaagagcaagaaaattgaagatacataaattattttctcagtatgttttggcaaggtaaaccacagtgtttatcccagttggaggcaaaaaagtagttaactctagtaagtttggttttgtgcccacagaacttcaaaattgaccaatctgagtctagaattctcatgaacactgtgatcagcttagtcaataactgtctcctcaccaactaatgagagccccaactcagagaggactgctaagctgacagggacaactctggggccatcttagccatcatatggagaaaacctttctgagactgaaattaatacagagggaaactggagagatggaaactgctaatgctttgtttgagaatctggatatagccacatcagaacaagcaaaagctaatctccaacttcctagatatttgagcaataagttcttttctggttaaaagggggtgaggtgggagaatgcccttaggtatatcagatgccaagaacacattttttgaccccaaagaactactccacagcacaagagaagacacttccttttctctcatcttcgaaccatgcagtgattacaaggattccctcagttccaagacattgtgaatgcttcctgtagcctgggggtagtgactccataattacaagcacataaaagtcatgaaggatcatcagaatggcacaggtgatatcccttggtgactagtctaggggatgtgatgggatacaagttcactgattcctgtcttaatttaaaaattattttttctagacaactgaaaaaactttttttttttttcctgagacaaggtctcgacccaggctggagtgcaatgacataatcttggctcactgcaacctctgcctctcaggttcaaacaatcctcccatctcagcctcccaagtagctgggatacaggcacgtgccaccacgtccggctaatttttgtattttctgtagagatggagttttgccatgttgcccaggctggtctcaaactcctggcctgaaggaatctgcctgcctcggcctcccaaagtgctgggtaaaaaaactttaaacaccgatacatatactaaatttgaaaaacaggaaaatatacagagaaaaaaaattaacaggaaattaagagtatattgaaaagcattaaatgaaactttgaattctttcctgaaatgtaaaatgttattaataactgataattattcttactttgattttctttcatcatgtccatctcttggattcctatcttctcggatctcttctcgcttttctctgcggtcatctcgtcctttgtctttgtcttcccaatccctttggcgttctcgttctttatccctttctctcgctctttctcgttcccgttctcgctctcgctctctctcccgttctcgctctctctccctctctctctcttctctttctcgttcccgttctttttccctgtctcgttccctctctctttcccgctctcgatcgtggtctcggtctctatccctttcacgatctctctctttttctctttctctctcccgttccctagcacgctctctttctagttctctctctttttctctttcccgatcccgttcacgttccctctctctctcccgctccctgtctcgttctcgttcccgatctctctctctagccctttcatctctcctatcatccactctgtctactcttcgttcctctcttctttcatcacgctcaagctcgtcattccttccctgatgtcgaattggtgagcttggtctttgatctacaatgaaaatcaagttttgtcagtgattaatttgacagataacctattggtaagacagcatggtaaatcttaaattttatctgtgatagggtcacactggcaacaaattacaaaccaagtagcatatttaattttaacttaatatccaagtaacaatcgcccctagaccttaaattttttaaagataatttttatttgccctctaacgaccatgtttcctgctccccgtcaacccccttcccccctcccactgatcaatctttgatctttctctgcatgctccctaccctacctccagcccactgctccaaccccactttctgccatctctacccttcacctctgatcttctctgtccccccagcaggacctgagaacactggtggcaaaggataggggcagcaggaggtgtagaacataggagctgaaggaaaaaaaaaatttccctcgtaagtcacacctctaatttcaggccaaaatatatacacatcaaagtgcagctattatgtgaggaaaatatagtagaacaaaacatatgtcagaatttgttgctgcaatataacatgaactgtaatattaagggtactgatgtctagcaatcttgaaataaatgtaaaaagtgtttcatattagtgatatatatttgtaattaataaccaattactaataaattagctttaattacataaatgattactcagatgaagagctgttttcttaaaatgttaactgataacctcatcacattttatataaattttttccatgtacacacaaatcacataaacacagagtaaatgaatgcatgctgcccaaatacccagttgagcagaaaattagtctgggataaaaaaacgtttaagaggatggcatgaactttttcaaagagacagccatttttgaaagcaactactgcggtctgatctaggatactgtgatgtttccatttacatactatatatctactggtttttgataaagatcatattataatcaggccaacaggttggtaagtggaacatctaacatcaactcattaagcagaacaattttaggatgtttctaggaagggttcaatacagtattctggatttcccttcctaatcactgattgaaaagacaagaattatcttatctttactattttagaggttatagacccagatacaaatgatcatagcattttaaagctgaatcaaaatgaaatcctacacagttgcttctccccctttctatttaaaaacagaaattatggtccagagttgtcttcccaatgtcacagagatggtagatgcattagaagtcagttttcttaaaccctttcacttttgctgaaaccaacttaaagtggttcttctgtaccatactttggattcctagaatgctatctacccatcttttgtattgtctgaattcctggtttggaggagtcataccaacatcataatcattacaagataacctgaaacaaattcaataccattaacttatagcaaatcatactttaaatttctaattacagcaatatcagcaaatagactattcagacatgcttttatgggagatgtattttcccaaccaaaatatcaatgctactttcttcaaaggaaaatggaaagaatataagaacatcactttaaaatgtctaaattatcttcccctatctttcccccaaaatgtgttattcaaagatgtgcttctacttacatatttccttattttaataaatgacataccaattcattaaagctgacaatctctgggttgtctaagcctcatcatatccaagtacaatcaacttcacttctaaaatatttctttgttccttttcctgtccccatagctatagttattaactcagaccttgatcaggtcttcttagatgcctatgtcatcaacagtctaactaattggtatccttgttttcaatctttcccaacacccttaatatgtttttgatgaaaattatttcttccaactgtttaaaagtagttatcttgtaggcagtgaaaggcaattaaaatcaaattttttagcctgactaggctaaacttaggtcatttactacctggcctatagtctttcatcagtccttttccctggtttcttttctaccttgccaattatagcatactctgactccaatctcataattccttactactccaaagcacatgtttctttcagttctggtgtctgtacatgctgcaccctctccctgtaaagtgctccttctatagtttccttttattcttcaggccctaattcagatgtcacttctttaggcagctttcttggaattgctcagaattgtgtttgctcctttgtcttctcacagaacttttatatacagtagtagcattttatcacactttgtttttttgggtggggagttcttccctctccccattaaattctacaaggacaagaaattattgtacctcaagtgcctagcaaagtgcctgacatgggtactcaacaaatatttgtaaaatattcattagcctccaaaatatatttttatttcaatcatacatctcataattattgaagtagttacagtaaaattaaaatagagaactgaacttctggtcagaagacctgagtttgaattccagctctggaacctacttctctataatattgtaatcttactactcttagatctaatccccaaaactgtgaaaacatgaattattttatcatacctacacttacaaggatattgtaaagactaagtcagaatatatgtaaagcaactatcaaagttcttggcacctagtagaagatcaatacatgtggttgaactaaccataagattgaaaccaaatgttactattgaattcaggcatgagatgagaaaaatctgagcaaggatatgaaaatagaaaaaaaggaaaaaagaaatttaaaaaaaagcatcaccagttctaaaagtcccagggaagaaaaaatttcagatatcaacacagaacatagaaactccagccctatctgtaactaaggaaattctacacatcttttaaccaaaatgcattaggcttaccttataaactcaacctaatcaattctcctacttctgatcctatctatgctcccaaaagtagatgatgccttagaaactttattcttctcccactactaaccaatcaagatataatattacctctttgattcagcccatagtaaagtatcaatattcaattctctgggccatcaagtttcatgctatattaatctcagcattatagtgaaccttacttcagccaaggttagtaagaccttcataaaatttttaatgtttaaaggccctaataagtacagaaataaaagcttgccaaagaaagtatttacaacccttcttaagtgcttcctagtaatcttgcttcaaaattcatttaagagatcacctgatagatgaacagaaaaagttttagcttaagacatataagaacgtaaaattagctaaagcaaataccatatcttctcaggacagaatacaaataaaatatttctctaaacaatccccagccctatcattcagtttttttttactgttcctttctggaagtccttataaaattctattgatcatagcaaatgagtgagtagacaggatactcagatgtaaaggtttaggtatttcttgaatcagaattgcctggaatagaacccaaccatctacattctttaaaggtttgtaagctatttgggtaagatgagaaacacacagtagggcacccaagtttttgcactttgttgccagtaggtactggtcactagctattgacataatccctcctaaaccatgtgaacaaagattatatgagtatatataatagtttcaaatgtgtcatcgagcacaagccttaaagtatattttatattaaaaagtaaattggtaactgtttgaaaaaacaattcgcccaattgatattgttcactatttaataaaattctgtttgacaaacctctctctctgttgtcacgacggtctcgctctccatgtcttctctcaaaggaagaatcccttgcttgatctctgttgtctctttcaggatatctatctctttcaggatagctacttcgagtttcccagctgtcatgatagttgctattactactgtgactatcaatttgagaacctcttgagcctcgacttcctaaacaaaggatagacacacaaatgtttaccacatacactttattcaacaaatttcatcagtcataatctttcctcctaaacatcactaatatatatatttaatattccaaagtgtggtaatcactcctgaaaagagtatcaagcaatgaatcagaacaaccaaggtgtccaatgactgacctgagtagacgaagtcccagttttccctacctatataaaagtcatatgataaaatcataaaataataagattcattaaaattaacctgtccccccaaaaaaaacaaaaaataaaaactatttcttcatatttaattcacagatatataaaaataatgaaagaaaaaaatgggtacgtattattgcttaaatacagtttacagtgaaaacattccaacatagaacaccaaggttaatgacaacattaaactgtatgtgaaaattttcattaacagatgtgggaaacaaatgttcacagtggctttgttgataacagccaaaacctgcaaagtacactaatgtctttcaatggatgaacagttaaacaaactgtggcacatgcatgccatggaatactattcggcaataaaaatgaatgaccgatatatgcaacaacttggatgaaccccaagaaaaaattatgctgagtgaaaaagccaatctcaacaggatacatatagcattattccatttacgagacaattacaaaacaagggacacataagaggttgccaggggttggggccaggggccaggggagggttgtggctataaaggggtaataaaaaggaatcttaggatgttatagatgagtatcttgactatggaaatgggctacacatatgataaaactacaaaaagctacatacagacatacacccaagtgcatgtatactggtgaaatgtgaataaactctatggattgtaccaatgtcaattgtttggttttgatactatgctatagataagatgttagatgttaacactggagaagttggggtaaggataaacaaagtttccctgtacatttatttgcaatctcctgtgaattcctaattacttcaaaacaaaatgaaatttaaaaaaaagctttttttgagcagtgagggttaggagtagagaaacagtactggggctgtgataatttaggaatatctggcaaaaacaaagacagaaactctgagggccctgccctcaacctcatagaattaccatggataaatctttgacaaagatgagttcactccaaacttaaaagaacatatgatgatttccaatttcatccatgtccctacaaaggacatgaactcatcattttttatggctgcatagtattccatggtgtatatgtaccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctgactggtgtgagatggcatctcattgtggttttgatttgcatttctctgatggccagtgatgcatcattctcagtaaactatcgcaagaacaaaaaatcaaacactgcatattctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatgacacatgtatacatatgtaactaacctgcacattgtgcacatgtaccctaaaacttaaagtataataataataaaataataaataaataaataaacaaataaataaaaaagaaaaaaaagaacatatgacaaactaacccacccaaagacagaatcaaaaggcacttccccaagatttaaaaaacaaacaaaaacacaaagaatacaaatgtaacaggcttttgagacctaaaagaattacagcatgattctacgggtattttaataatcaaaatagctgtgaaaaatattttaataattaaagaccaggaagaaaaaatttaaaacatttttacagactacaaaaaggctacatataacatctaggaaagaatggattaaccatcagattagatgcagctaagaaaaaattggtaaactagaaggtaagcctgagaatatgacctagaggcgaaacagataaagagatgaaaaatttgaaagttaagaatgaaagaagatacaatgaggagatttaatctgtctaaaactatatgttgtttagagttacatttaaaaaaaaattaagcctgaaaggatggaaaaagatatatcaaacaaatactaaccaaaagacagctgccagcaaaacaatcttcaagaaaaatacaggctgaatgccctttatctgaaatgcttgggaccacaggtgttttggattttggaatatttgcattatattggttcagcatccctaatctgaaaaattggaaatccaaaatgctccaataagcatttcctctgaatgttatgtcagctctcaaaaagtctggattttatcagttgctagtggctatagaaaaaacaaaaaacaaaaacaaaaaaaattacattaaaaagttttagattttggagcatttcagattagggatgctcaacctgaacctggcataaacagtcattctataatgaataaagaaagaaataactcaatttacgtgtacctaatagcaaagcttcaaatattcaaataaaaaaatgatcaaactataagtagaaatcaacaaatctacaaattccacaatcacagtggaagactgaactcacctctctgtaatgacagaacaaacagactaagaaaaattacatgtagatttgaaagtgtagttaaaacaaactttatcttagagaaacattttgcattcaaccattacaaatgcaactcctttgaaagcatatgcagaacacttataaaaacagaccactgagccacaaaataagagttaacaaatacatatcccaaagaactgactttcaacagagtattttctgacaactaaaatggggggagagaacttaatccttaacacaataaaaagtatctgcaaaaaatctacaaacaccatacttagtaataaaatgccagcaacaatcctttaaaatctgaaacaaagcaaagccccttctacttatatatatatatttttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaatttttttgtatttttagtagagacggggtttcactgtgttagccaggatggtctcgatctcctgacctcgtgatccgcccgcctcggcctcccaaagtgctgggattacaggcgtgagccaccgcgcccggccccttctacttatatttaacactgtattgataaagatgctcagaaggttactgacagaaaattaataatcagaaaagaagagccaaatcagtgtgttcctaggaacatctgttaagagaatctaattagatcaagaaaatacagcaacatcatttaaatgtaagattaatacacaaatgccaattaccatttccaggtaccaacaaagcattagaaaatgcaatgttttaaaagacaccatttagtgacatatgtacacagttattcactaaagcactgtttgaaagagataaagattggaaaaccaaaatacccagtaatgcagcacttgctgactttatggtatattctacaatagagaacaagtaccaaaagaagaaaatagctgtttaccacaaagaaagacatgaaagatatttttactagttgaaaatagtaggatataaaacagtacatagttttttccagtgtttttaaaaattagttttgtaaaaccagaggggaaaacaaatggatatatatttgcttgtgtaaaatgttttttgggaagaatacatacaaagctggcaaaagagtggtcagggtacaacggaggcttttcactatatatccttttatacattcaaaattttgaaccatgtaaatacataatttacatcttacaaaatgtaaaagtactatttaaaatggcaataaaaaatagaggatacacaggaaaaaatgtaaaaaatattaatgagaaatattataaattgattaagttgatgcattgaaataaaaatccaacagtttttttatgaaattaaaaactgttttctaaaattgatatgaaaaagtaaaaggtcaagaaaagacaaggcagctcaaagaagctaaaggaccctcaacacaaatatgaagctgtaatactgaccaaggattgactaacagaccaatggaaagaataaaagtgatcaaagttctgcagcagtgtttggggagaggggagaaaagcaggtggaggtaaagagaggtcatgataattaagtctcagcagtttggaaatagttacaatatatttaagtcatttgggtgatggcaaatactttttatgaaaagaaaaatggctcaagataatgacgtgtggcagtttgacagggtctgaagcaagtacaaatactgaagaatacacaaatcagtcatttctgatgccaacaattctgaaaacccaccactttaatcctactttaatttaatgaacattttatcatatttatacctatttaacagaaagcaacttcctcgtgattctacttttttgtctgatagtgattttcttagtgttccacattaatcaagatgataggcatgactggatatacttagggggggtctagctcaagctccatttatcttttgctattttaactagtaattccaattaggaatttataaggaagactacaagttcaattaattaaaaattactgtgacaaaatgataacaaatgtaagaaacaacatattagaaatcttaggagattttatactttctatataagatatagttcatagacaagtcaaaaaccttacccttttcaggtaactcaggaaccctccccctacttcggcccattcggtcatttctaatttcacttcgagactcatttctggactcattccttatttccgtacgagaactttcttctctcaaatggtttcggccataactccgggattcttctggatatgtatcctcctttcgatgagtatctcgaccttcacggtccctgtagtcatgggcatcacgagtggaccgagaatctctgggatcacggctctctttggtatctctgctataatctctcatctcccttgagtcccgcatgtctctggagtctcttagttcccttcggtccctagtatctctggcatctctccgatcccgaccatctcgaggttctctgtcatctctgtggtctctagaagagctctgatcctgttcatattctcgttcttctcttgagtccttttctctgtctcgtttgcccctagtatctgtaatgcaattttggaaattgactgtaattgcttttacaaagtttcaggaaactagaaaacatatttaatacagaactttaaaaattttattataatgacaattcgtgttctttgcaaaaaataaagaagctaaaattccaaagataattaacacctgataagaatgttcttcattagataaactccgaacatgaatttcctctgccccaacttacctatactgccccaactcaccccaacttaccagatcctaaacaactgaaacaaataagttcatctcctatcattgacggcttacttttcagaaaccacttttagatacaaagacacttcagttactttaatcttttctatcaactattaagttaggctaaactagaccatctgtgacctcctcaaatgtacttaagcactttagggtagcctatggttagtaagctagctggttgagtgatactattattcactctcttttcctgcactgtttaatggtataacattcatgtgtgcaagtctttaaagctttctctacttagagcattttctagctgggtgacgtggcatgtacctacagtgccagctacttgggaggctgaggtaggaagatcacttgaatccaggagtttgagttcagcctgggcaacataggaagatgagactttttctctttaaaatgaacgaacaaaaaagcatttcatacaaaaaaataaatacttgcactttttaaaagctgaaccacagtgattatctaaacaaaccatgtcattttataataaagaaatagaggcccaaaacttagatggcttagtcaaccccataatttgcaaagattagaaaccactctttacatatatttagaaagggcacaaattgattataacaaatctgatatgaagccaaagaattaacaagagaacctcaaaggataaattctgccctttttatcagattcttctgcaaggtgctcttatactctggaattgccctagtctaaggctattttggcaactctagcagcctcatgcccaaaacattataagtttacctccttttctctttgtccctaatggctaggcccacagactttctcatggacccaaacatcttgtaaccacaaggcccttagaccctcatcaataacctatctcccccaccaattcctttgtccatatatccatatccacaaaccctgtttaaggacaaaggcaagaggcaaagatctgacatatctccatccctttctgtgaatatctttcacttctattcctcccccaataccaactgtgcctgaaaatgtgttcacttagtgccagatctttttctcatgatgcgcccatctgtctttacaaatacgtctaggtactgtattttcttctttacctacctccctatccttccaccgaaattatccttatttcagaaaatgacatctaaatagagaggaacaattgcctgctaaatctcccgtatggaaagttaaacagacatcttccttacaaagaacttaaaacgcctatgatttaagtcccttcttaacacaagcattcctatgagactcaattgcttattattttcccttccttagtatgtttaataatgttaatggagttttcattcaataagtagtcattaaatatgtactatattcctggtcaactctagttgttaaatatcttattaaaatttatagaaaggtacaatataagagaattttcccatcttaccaatgtttcataaacactgctgtgctgacctagttccaaaatcatacatacaaaaaaaaaattctatcaaataggtgctttctccagtccctgcctattttcttgaatatcattctcatccgccattttcttgaacaaaagaacccgactgattattgcttgcattgttgataggaagagaatactaaattcaacatgtttcataggagactgccgtactccactcaccaagaggcgcttaaagtgcatattaaatataaatgttgttccaagtaagcatttcctgagtacttactatgttaaaaaatgaacacaggagaagttagaaaacagacttattaagttgaatctacgaagaccagaagcttagacaagaagtaaagaaagagatgagagctattaaacaggctttattgccaggtaacaataaaatctcagcttgaatagggagtagcaaatccaaagttaacttaattctcagggatctagaaaggaaaactgcttcgcttacttctttattatgacctagaaatttgatgactcggtttgcaatgaccttctaacaattccccccagccctcactcctttatcaaaacacttctgatgctttcaaactacgctctctgatttgttgcttttcttcccttcacctccttgttttcaaaagacattaactcagtgattgaaaaggatgctctaagaatcagatggccaaaaatttctagaacttgagagtacttactcagcagaacatcttttattattattattattgttattatttttgagatggagtcttgcactgttgccgaggctggagtatggtggtgcgatcttggctcactgcaagctccgcctcccgggttcaagcaattctcctgcctcagcttcccgagtagctaggactacaggtgcatgccaccatgcccagctaattttttgtatttttagtagagacggggtctcaccatattagccaggatggtctcaatctcctgaccgcatgatcctcccacctcggcctcccaaagtgttgagattacaggcgtgagccactgcacccggccagaacatcttaactaaagaaagcaccagcttagtatacctgtaaataccaacttgtatacacctaacagctaacattcccatgttgttaagcatctcctattgccctcaaaaattctagtctgtgtgttacagaagacttaacatagcaaagtctttctccatctcttagtacaacaataaagctggatgttcaatttttcaattaaaaaaatcaaagtacagtacacaccttccctcctttcatggcgtcgatcatgagactgtgaagttcgttcatgatcatgtctccctttctctcgcattggagagcgatgtcttggaggactctgctttctctggggagacgacaaagaatgtgaaggataaggagaggcagagcgtcgtaaaggtggagttagtgtccgctgataagatggtgaaggagttctttttcgacgaggagaaggagaatgtctttgaatagatgatcctgattgtgaggaagatgagtgatgtctagaagatataggagaatgatgctgtcctgctggggaagtagacctacaagggaaaacaataacaataaaacatgtattcaagagcttcatttctagccaaaggaaaatctttaaaaacaaaaaagtgaatatgaaagtatagacaataacttcagaataaattttaattcacaatgctgtaaaattctaagtaagtcacttttttaacgacgtgacttaactttaagtcaactagaagcaacagttcaagaagagatatgcagtgcttttctcccaggctttggtgccaaagtacactgcattttccaacatacaccatctaccctaacttaaagtatggaattcactctgataatctctgaaagtgtgaacaaatacttagagggagaaaacccacaaactatggcaaaacatactactgagatctagagagaaagtggctttgagaatgcctgtaaattcatggctatggtaaaaggggaggtagcatcagctaaggcaaacaaaaagtccacgctgcatgggttgacatttaggactatgaaagaatcctagaattaaggaaaggataacaaaatatatactgtctttaacttaagtaatctgccttcactgtgggcagcacaaactgagagttagttcatagttcttggttcaactaaggcctcccctattcccttcaaatcattttctttcactgctaccagagaaacaacacataacctcatgaaacagatgtgatcattaagcacatctgaatcactcctagagtctattatacctgggtcctgtccaaacttttgtgcaataactaagaagcagcaggaaataatgtttaaaatataatattctagacatgcccagataaatattcctcaaagcaatcatctcaagagctaaaagcttattcaaaaaaattctgattttttaagtcaaagtatttctgtaattatcttcagtgtctatgataaacatttttttagtatgtgcagtgatggcacaaatcattactaattctaaaccagtttctcaaccctagcactactgacattttgtactgggtaactcttcggaggagggggagtgtcttgtacattatatataggatgtttaacagcatccctggcctcaactcactagatgccagtagcatccctcccattccaagttatgacaataaaaaattactccagacattgccaaatgtcctctaccaggcaaaatcacccccagttgagaaccactaccttaaactatgttgtttataaatgatgccttagtaaaccttttatcaaaaaaaggtttcaatctataaactatgttactaagtcaggaatgtgatctaatatattagaaagaatatgcagaaaagaatttaggcaaataaaaatacctctgggtgacagtaaatgaaaagtcagctaactagaacactacactcacttaaacatcaagttttctgtgacttgattaaagctttatacttttaataaaatagtgattcctttctaacataaaaagataagccataagctactaaaatttaattgactctaaatagaaatttattaacttaacagctaatatgagtggaaatactcaacgggtcttagccaaatttggaaaaccatttatgatcaatgcccatctaaatgcatcctactgaacagaaaaatcactgcaagagtaaaaattagagtcagtattgtctggttgttttcaatttcaatgtcattaggttctagtaaatttttggggggatgggcggggggacaaggtctcgctgtcacccaggctacagtacagtggcatgatcatggctcactgcactcttggctttctgggctcaagtgatcctcccacctcagcctcccgagcagctgggactacaggcacatgccaccacactcagctactttgttttattttttatagagacgaggtctcactataccccggttggtcttgaactcctgggctcaagccatcatcctgcctcagcctcctaaagtgctgggattataggcatgagccaccatgcttgatggttctcgtcaatttaaaaaactaaagaatgaatggttctccattgaactgatattttggttacttctgtgtttatttctggggtatacttaaaattgtttcaagaatgtctacaatagccttgagttattagttcataaaacttaaaaaaacaaaacagttcacatatactacctttaaaaaacacattagggtccaatcatgtttctattcaacttgatggctatagcatggaagaaaaaacttcaaacttaggataatcgggctatcacattaaggtcagaacactaatgggttgtcaaataatggcttcaactttttaatcatattttctttttactcaaccttcacctacgtccattctgcatatataaaaggtatgattctaagcaacgaaactgtcttgaaatctggtgaaaattaatagtactttggctatagactattacagagctatagtaaagtacatttccacttagaatagaagtaacttcagattaattcgtcttatgctttataattggctggtttcttatctgagggaaaaaattagtgaaacttgaaattcaaataaagaaaaaaggaaagtttatttaatgaagagaagcttaataccttaaaacaaaaacctgtataatgtaatcaagagcactgtgatttattgtatccagggaaagttgatctttggtctgactagattccaatcaaacactttttagtgctgctataattaggatatgatgtggtgtggaatgagaatattcagggtatatttcattttgggaaaaaatgtgaaaagttaagaaatttaaaaataaaaactctcattcaagatgcaagtaatttcacctgcaaactaataggtttaccccagacttacttaaaaatagtaacaccaatgtttctttcaaaaaatggtttctatttctcaaatatgaaaatatgcttacataatgcactaacattcatattttaacctttaaaatcatgtaaaatgtatacatttttaaaacacaaaggtaatatgggcactaccaaaatcatctctgttttcagtgataaaatacaacataatacacattttgcaagtagaaatatttaggttctattattttacatatgaagtttatatttattaaatcattttaattcactcaacaaatattaagtgagcacatactaagctccaagcattatttttggcaatgaggatacagaaatgaagagaacaaaaccactaacataataatagtaatgacattaataatagcaagtaacgtatattgctactatgtgtgtgacactattttaagtgcttgtcatatattaactcacttaatctttatgacaatctaataaggtaattgaatgtcatggttaattttatgtgtcaacttaatccatttatgcctagtgttccattattggaatactaaacttgtgggagttatttatatcctactgctcaaggtctcatggccaaggtctgatttttcacaaaaaaatttgcaacttctgacataactgggttaactgggtcatggaatggcccagatatctggctaaacattatttctgggcacgtctgtgagggcttcctaaaagagtctggcatttgaaatcagtaaactgagtaaagcagatggccctgaccaatgtgtgtatcatctgatctactgagggcctgaacagaacaaaaaggtgaaggaaggttacattctctgcctgactgcttgagctgaacgttgatctacccttgcttctcaggtcttacactctgaatggaggcagctttctacctctcacgcttctgaattacaccaccagctttcctgggtctccagcttgcagccagatcacagggctttatagcctccataattgcatgagccaattccttaagtaaatctcattctagacatatcttctactggttcagtttctctggaaaaccttgactaatacatcgagggaggactggaaaccagtctatctagtaacagagtctatggtccagggagcaaaccaacaatgacaaagcaagacaatttctgctaattaatgtaacaacatttatacaaaaggacaacaaaatagaactgttaggtccaaaaaaacacaaaaagtatgtgctttttacttttggagtttaaaaacaatctacatgtgtgtggcaggaataccggctatttgtctttttctagcccttgatcacaaaacacaaaaaactatgtcagggtgactactctaggttgcttggtaaggaaaggacccttactagaggatatatttgagccaagtgctgaagatctgaggcaagagctttaggatcaataagcacaaaggaggtaggagggatcttgatgtataagaatagaaagaagccaagtggaaccacaatttatgagagaacagagtctcatgagggaatcagaaagcaggcagagccagatgtgggccacaggtcatggtaaaagtctggattttattctaagcatgagagaaagcactggagagtgataggtggttaagtgccatttaaaatataacaagatcttactcgtctaaataaacctgtaagatgaaaaaagaaaatgcttctgtgtgatttgttttacacctagtagcttgctattcttttgcagcaggctaaatactccctggaaagggaatcatttctaactgaacaatcttacagaactaggaggacacttgtctgtgggaatcttttaaaagatcactcctccataaatacataatgatacttgtaaaacagatttgattaaaaaaaaccctcatgtaagttctagataatacaagaaaatattcactaaggtactaataattttgttcagatttcatttttgcatgcacaaacgcagtatggttgactcttgaacaacacagggtccacacttacgtgtgagtttacttctgcctctgccagccttgagacagcaagaacaacgcctcctttttgcacttctagcctcctcaaagggacaacctttataatgatccatttccacttaatgaatagtaaatatattttctcttccttatgattttcttaacattttcttttctctagcttactttgtaataacaatacagtatataatacaaataacatacaaaatatgtgttaatcaaacgtttatgttatcagtaaagtttccagttaacagtgggctattagtagctaagtttggggggagtcaaaagttatacaaggattttcaactgcacaggggttgaccccctaccccttcattgttcaagggtcaactgtaatttccaaagtttcaatctcagaataaaaaatgttaaagacaacccttaaattaacccatcctttaatgctattcaaatccagaataatttaacaactaatacttttatgaaacgtggttcaaggtaagagccttacatagacttattcaacaacatggcttgaactaaaagctgtacctaccaatgtgatcaagggttagaaaaagacaaatagctggtattcctgccgcacgcatgtggattgtttttaagctcccagagtaagagaatcgatatttaaaatacaataaaacccagaaacaacacacattggcataagacaactggctccttccgcttggtggaaccagttaaagttactactttctgctggggatagggtagggtggcaagaatatgaagcagaggaccaaaccaggccaagaaacagtagataatccagttttggaagaggaaggtgcagaagtccccaatctgcatttcccagacataataccttcccagatcaggccactgggtgccaagcaagggagatttttgaaatccctgccaatggcctggaagtcccatctagtcacaggagccaaaattcttcttacggtcatttaactatcagtgaaaaaaaaaaaaaaaaacgccaccacctggcaccagaccacagccagattaggatggattttgacagtgcaggtagaggctattttattaatgtcattataacacagccctacattctttacagaattgactctatattatgcatttctgactgaatcaattattggaataggattaaacttccgaaccaccagctgctactaaaaacctctctgaaaatacttgagaacagccttcctcaagtctccaattttgcaaagcaagttggacaaaagctaaaagtacaattatttagggtcataaactctttctagatatgagtttctctcctgaattcaacaaattttcccaacatcacacctactaaagacagtccaagccttggttaatttgactaaatgtgaaaggcttcttttttatcccttgtgaatgagttgttttgatgtttataacatgatttcattcttaacacaagcctttcgtaagcttagtgtgcaatataatcatgtttggctatattacaaaccccacatatttggaaacactattttacacacatacacccacaccccacattattctacttgtactaacaaagcttttggaaatatttttgcccactgctgcaataccagctttagaacaggtaatcaagtaactgttggatgaataaatgaattagcacttttacttcagcatacctcctcctagtaagctttctgaggccccaccagcagcagatgctggagccatgtttgtacggcctgcagaaccatgagccaattaaacttcttttctttataagttaccttgtcccaggtatttctttatagcaatacaagaacaacctgatccaactactatcaagtaataagcagatttctacactcaggtaattgtgttggaatgattgtgtttttagttagctatgctctgagtactattttttcatttgaccacaaagtcctacaacctagcattatgattaaaacatatcacctgtcagcagaatcatactgaaaccaaaatatctggcagaatgagctacatgcaattgtcagataatttttctgattattatccaagaagattttgtgtttaaacccttgttcctaaaatactactaatgtattagtttactttcctgatttagcatgggaaactataaagaatatatactaatataagtgagtacactgataaaagcaagtattacatctaccaaaagatcattataaatattcaatttaggattatctagacataataggttaggaatattgacacagagtattcccttcaaaaattatctttctgactaaatacctaaaataaacttaatttccctttgatttacatctcttctaaacaatttacaggaaaaaaaattagtttgttgggttcccactacaataggcccagcttacctgctgttttgctttccctggtcaaccacagtccaaatatactaatggaaacttccagaaataaacaattcatatgttttaaattgcacacagttctaagtggcacagtgaaatcttttgtcgttccactctaccgcaaccactatacactgtatgcacttgctcgctgatcactttgtagccatctcagttatcagattgacttgcagtttggcaataacagtaattatgcagttcgagtaacccttattttacttaataatgacccaaagtgcaaagaagagtgatgctggcaatttgaatatgtacaaaaaaaaaaaaaaagccataaagtacttcctttgagtgaaaacatgaaagttcttaagaagaaaaactgtatgctgaggttgcaaaaatctacaataagaaggaatagtctatacatgaaattatgaataaagaagaagaaattcatgcatagtatatacaaggttcagcactatctgccatttctggcatctactgggggtcttggaatgtattccctgaggataagaggggcagaaatagtattttactattctctgtagagtaggtcacggaaagtttattttaaaaaaatattatgggaaattgctatattttctgaaagcacagtaataaatccataaggctttttctctgcgtaaatgagtagtactcaggttttgatcaacattgaataaataaatcaaagctgagtaaagttaagttggaagacactgatgacattcatttaagggccgaagtctccaaattattcaattaaaaattaaccacatgatagaatttcgtattaaacttacaaatactctgggaagagtacatttttaacaaacttgatatgccaatgacagtttgggaggaaagtactcaaatccttgacatcaggttagtgtcctaggcttcaagaatgattcataattctaacatttttttggagaagggaaaatcatgaacttttctagaagggtatgggcactctccctcaccaaaacacatacacaggcaaagttttatacataactcaagaaacttgtagacccctaaaatccaccagtggacttcgggttagaagcacctgatacagaacgttggacaactgagacacaattattatctattatgagtaatggataattcagtaaacattaactgttacaatttatttttgaatttggacaactgagacacagagaacagctagaaggatttaaagtcagaggatcgtgtagcattgttgcatctcctatgccatgtgtatgcacacctatgccatgtaaatgggtaactcaatagagagccatcctttaagaaatgtaagcaaccgcttatatccagtaagcctagtgggtcatacttgaaggaaaaaaaaacaaacccaaagccaaaacccacgtatttggaaacactattttacaaacacacacatacacacacacaccccatcactatattacttctacctgtactaacaaaacttttggaaacacttttgctcactgctgcaataccagctttagaacaggtatttaagtaactgttggatgaatgaattagcaattttacttaagcacaacacctactagtaaacaaaacactactaatacgcccattatgacatttaaagtatttttaaagggcaattttttccaaaaggaatttagacattaacctttaattacattccttatcaatctgaagacagtgacaaagatactgtttagttttaaaattaatacaggtacacctcagaaacataggtttggttcccacaataaagcaaatatcacagttaagtgagccacacaaattttttggtttcctagtacacacacaagttatgtttacactatactgtagtcttttaagtgtacaatagatttatatctaaaaaagtacaggccgggcgcggtggctcacacctgtcatcccagcactttgggaggctgagatgggaggatcacaaggtaaggagattgacaccatcctgactaacacagtgaaaccccatctctactaaaaatacaaaaaaaaaattagctgggcgtggtggtgggcgcctgtagtcccagctactcgggaggctgaggcaggagaatggcatgaatccaggagatggagcttgcaatgagccaagattgtgccactgcactccagcctgggtgacacagcgaaactccgtctcaaaaaaaaaaataaaagtacataacttaatttttaaaatactttattgttaaagaaatgctaacacccatctaagccttcagagagttttaaccgttttgtgggtaagggtattatcttgatgctgatggctgttgactgacgaggatgaaggttgcaaaaggctggggaggctgtggcaatttcttaaaagaagacaatgatgaagtttgtcacaccaattgactcttcctttcgcaaaagatttatctgtagcttgtgatgctgttcgctagcattttacccacagtagaattttcaaaactgcagtcggctgggcatggtggctcaagcctataactacaatgttttgggaggccaaggcaggattacttgagtccaggagttcaagatcagtctggacaacatagcgagacctcatctctacaaaaagattttaaaaattagctgagtgtggcaacgcaagcctgtaagcccagctacttgggagggtgaggtgggaggatcacttcaccacttgatgggaggcggaggctacaatgagctgagatggcgccagtgcacttaagcctgggtaatagcgagacacagtgagctgagatcacgccagtgcacttaagcctgggttacagtgagaagaaaaacaaaaaacagcacacacatacacaaaaaacaaacctggactcaatcctctcaaaccctgctgctgctttgtcaacaaagtttatgtgacactctgaattctttggtgtcactgtcatttaaaaaaatgtttctagcatcttcaccaggagtagactccatctcaagaaaccactttctttgttcatccatatgatgcaactcctcatccgttcaagtctgatctgagattgcagcaattcagttacatcttcaggatctacttttaattctagttctcttgctatttccaccacatttgcagttacttctttcaataaagtcttgaacttctctaagtcatccatgaacgttgtaattgacttcttttaacttctgtaactattaatattttgacctcctcctgtgaatgacgaatgttcttaatggcatcttgaacagtaaatcctttccataaagttttcaatttattttgcccagatccatcagaggaatcactatctatggcagttgtggccttataaaatgtattttttaaataagactcaaaagtaaaaattagtctttgatccatgggctgtagggtgccttttgtcttagcgagcatgaaactattaatctctcctgacatcttcatcagagctcctgcgtaaacaggcacatcataaacaaacagtagtattttgaatggaatcttttcttctgagcaataggtctcaatagtgggcttaaaatatttagtaaaccatgctgtaaacagatgtgctgtcatccatgcttgtttttccacttaagagcacaggcaaagtacatttagcataattcttaaaaatcctaggattttcaggatggtaaatgagcactggcttcaccttaaaacccccagctgcactggcccctaacgagagagtcagcctgttcttcggagctttgaagccaagcattgacttctcctctctggctatggacatcttggatggcatcttcttccaataaggctgtatcaactacactgaaaatttgtttagtgtggccaacatcaattatcttatctagatcttccggataacttgccgctgcttcttcatcagcatgtgctgcttcatcttgcacttttgtgctgcttcatcttgcacttttgtgctacggagatggcttcattcgttaaatgtcatgaagtaacctctgctaacttcaaacttttttcctgcagcttccttacctctttcagcctcgaaagaattaaagagagttaggaccttgctccagattagactctggcttaaaggaatgttgtggctgatttcaactgtggctgctttgatcttttatccagcccactcaaactttgtccgcatcagcaatatggctgttttgctttcttcccattcatgtgttcattggagtagcactttaaatttccttcaagaacttttcctttgcattcacaacttagctgactggcacaagagatctagcttgccacctaagttttcagtatgccttcctcactaagcttaatcacttctagcttttgatttaaagtaagagactcttcctttctacttgaacacttagaggccactacacatagggttattagttggcctaatttcaatattgttgtgtctcaaggaatacagaggcccaaggagatggtgagagacaggggactagccagtcagtagggcagtcagaacacacacatttgcagattaagttcactgttttatatgggtgcagttcacgacaccccagaacaattacaatggtaatgcgacaattactgatcacagtccatcgtaacagatacaataatgatgaaaaagcttgaaatatttcaagaattacagagacacaaagtgagcacatgttattggaaaaatggcactgataggcttgtttaatgcagggatgccacaaaccttccatttgtaaaaatacacaacatctgtgagcttcaataaaattggtgcgcctgtaatttcttcattcagagtaatggagacaaatgaaaataacagccccacctaagaaccttggtaattaactcttcctaaaccaaaatgtctttttccaatgtcttgtcacatatggctttagaactccagtgcgtgcagatcaggtatttacataatcttccagtattcctagctctgttgtttcatgtccttagatgaaaaaataaaaaataaaaataaatttaaaaaccaagttcagatttgtctacatactaaataacaggtgagtcctatgcataccatttagggataaccaagggagaaaaactggaaaatgaaggataagcctgtgtaatattcaactcctcataacacaaatgtttttaccatttaaatgataaactacctagcaacaggtgttaagaaccaactctcagagacttcttagtcaaaataccaaaataaaagtacaaagaaccattagggaaaactaaaggctttactgatagaatgtcaatcaccaaaaacatttattactgatagaatgtcaatcaccaaaaacatttacatgtaattttcacaaacacacctgctggactgagtaaaatatagagtatagtctaagaaaacatacttaagaactctgaagtcttcagttaactgttctcttgcatgtcaagaagacacaattaacagagtgaaaaaaaaaaaagcaacatatggaataggaaaaaatattttaaaatcttatctctgttaaggggttaatgtccagaatatataacgaactcttagaactcaacagaaaaaaaatcaaataacccaattaaaaaatgggcaaagaattggaaagacatttctccaaagatgatatacaaatggccgacaagcacatgaaaggatgttcaacatggctaatcatcagagaaatgcaaatcaaaacctcaatgggataacacctcacctcaatgagataaacacacctattcgaatggcgactataaaacaaacaaactaagtgttggtgaaggtatggagaaactggaacacttgtgtactgttggtgggaatgtacaacagtgcaactgcattggaaaacagtaggcaggtttctcaaaaaaattaaaaatagaattatcatatgacccagcaattctacttctgggtatatatacaaaagaactgaaagcagggtctcaaaagggattatttacacattcatgctcatagcagcactatcaacaatagccaggaggtgaaagaacccaaacacccatcaaatggatgaatggataaataaaatgtggcatatacatacaatcaaatattattcagccttaaaaaggaaggaaatcctgtcacatgccacagcaagaaggaaccctgaggacattctgctaagtgaaataagcctgtcaaaaaagacaaacactgtatgattccacttatataaggtatctgaagcagtcaaattcacagaaacaaaacaggatgatagttaacaggagctgggaaaaggtggaaagggggagttattttttgacagatacagagtttcagatttgcaaaatgaaaaagttctgcagaattgtttcacaagtgtgaaaatacttaacactaccaaactataaactttaaaatgatgaagatggtacattttgtttttttaccacaataaaaaattgaaaaataaattgtaaaaattaaggcttactgaattatccatgactcataataataattattatgggaattattaaaataaatatacacactattgtaaacaaaactaaaaaacccaatatgctaatgcccaacggcttctgaaaagtaaatattctatattctacaaaagttaatattgttaaaaacatacaatcctacttaccttggcttgtctctcttttctctttgtcgttcaaaatctcgtcctctgtcctttccatctcttgttttttcttctatcctgtcttttactttatatttttctttgtattttttccccagagcgatatcttctggtataggagggggtggactaggagtacgtggtcctttctttttactttggttggtttttgaatttctgaaggtaacaaaaagctatcattagaggttcaaatatgccaaaaggatattttttaaagccttcttaaaaacagcagcgttcctttacattacttgccctttattattttgtatactactaaccaatatcaagaagaaaaaaaaactaacagaaatggctgaagaattaatttacttgatacttattttgttaacactgcttattattatataactttaaaggggcaggtttctgagaaaagatagaggtgaaataggaagacactttcagaaaagatgttaatacaatgactgtttaaactgtttttttttaagacagaaaagtagacaaagaaagtaaaaatcacctataattctactactcaaagagaactatttttaacatcttgaatatttacatacttttgccatatatcttactttctctgtctattcatttaaaactgggtattcacatgcaaaagaatgaagctggacctttacattgcaccagatcaaaaattaactcaaaataaagacctaaacataaaagcaaaaactataaaaatccgaaaagaaaatatagaagaaaagcttcatgacattggacttggcaatgatttcttggctatgacaccaaaggcacaggtaacaacaaagcaaaaatagacaaatgagactaaatcaaattttaaaacttttgcatgtcaaaggacacaatcaacaaagtgaaaaggcaacttatagaatgcgagaaaatatgtgcaaatcatatatatatatagtcacaactattttctctcatcattggaaatggtaactctgtgtgtgtgtgtgtgtgtgtcacatacattcatgggatatcctattacaatattttgcaaaattttcaaatattgaacatagacatagtgtgagcatctttctgtaacaaaaagtagatttaggttgggcatggtgtaatcccatcactttgggaggcagaggagggaggggtggatcacttgaggtcaggagttcgagaccagcctggccaacatggtgaaaccctatctctactaaaaatacaaaaattagccaggcatggtggtgggtgcctgtaatcccagctactccagaggctgaggcaggagaatcacttgaacccggaagaaagaggttgcagtgagccaagattgcgccactgcactctagtctgggtgacagagtaagactctaactcaaaataaaattttttttaaaaaagcagatttaggtaatcatttttattgactgtatagaatttccctgaatagatgctccaaaactttctaaaacaatttcatagtttttcaggtggcttccaggttttcatcattattcaaaaaacacaattacatcatctacaaatgaaatatcaaccactgtcagtatatattcatcataaatttctcaatcttatttaagaaatttttaccaactctgaggtcacaaagatggtctcctaaaattttgtaattttgcctttcacatttgtctttaatctacttgtaattgattttggggtacaaattttgttctttaagtgcctctttttggcaatttaagtaattttaagtaaatagtataactttgatcccatacacattcaaaactggctgtctttgcctcttactttaacaatagtttaattgaatatagcattttcatgtcaaaatccttttacctcagagctctagttaaaatattttgtaacatttaacgttgcaggtcagaagtccaaagaaaatcaaattttttactattcaggtaagctggtttttctgttggcatgcttatgaacattatcccttgaaaattactcactggaaaaagattttcactaaatccaggtattttcaaaaaatcttttccagcactaaatggactgtttcaatctgaaacttcaaactttttactcaatttcttctattttcatttcaaaacttttccttatgacccaagtctctgcagttctctttattacacagttactgtatctcttggatctctcctccatgttagatgtctctgtcatttccatttttcctgcttttccaggatcttaaatctgtctttatattcagtaatttttaaagtagtactcattttgctaattctaaatttggcaatctcgttgttctgctattttttgatttcttcttttttttggagacagtgtctcgctctgttgcccaggctggagtgcagtggcacaatcatggctcactgcagcctcgacccccagggctccagtgatccccatgcctcagccctctgagtagctaggagtataggtgcataccaccacaactggctaaatttcatatttttgtagagacagggttttatcacgttatccaggctggtctcaaactcttgggctcaagtgatctgtccacctcagaccactgcatctgtcctattctatgattttccatttgaactcttttctcttttaaaatattgttgttcaggctgggcgacgtggctcatacctgtaatcccagcactttgaaaggccaaggtgggcggatcgtgaggcggtcaggagttcgagaccagcatgaccaacatggtgaaaccccgcctctactaaaaatacaaaaattagccaggtgtggtggcgcacgcctgtaatcccagctactcaggaggctgaggcagaagaaccgcttgaacccaggaggcagatgttgcagtgagctgactgcacaccagcctgggtgacagagtgggactctgtcccaaaaaaaaaaaaaaaagttgttcaacctggcaccaaccagatcgataaactggctcatctgatcttgtagcccccaccaaggaactgactcagcacaagaagacagcttcgactccctcggatttcatctctgacttgaccagtcagcactcctggcttactggcttcccccagtctccctgctgccccgccaccaagttgtcctctaaaactctgatccccaaatgctcagggagattgattaataaaactccagtctcctgcaaaaatataaaataaaataaaataaaataaaaatatagttgttcacagtttttttcccataatcaactgcttttgtcttctaaatacaatatcctcacaaattgcactaaacttataaatgaatttataatttaagtttgttcctgtttactgtattaacgtttctgtgtaagccatctgctcagagtgttcagtctggtactaggtttgcaagtaacccttttcatacatctggtgagttttcactatctactaatctcactatctactgatatttataaatgaagacctaagcctaaaatcctagaacttatttcctatcatgctgaattctcagaattctcaagtcccaagagttcttagccatatatatatatgagatagtatctacctcaaaattgctggcaatattttaaaagcacttgactcatagcattgagaaaatgtagctctcttagtcctcatccctatgtcttattatcactcatagcgttaaccatgtaaacaagtaggaaattactaaaatatgacgactaaatctagttttcatccttgtcttctgccaacaactatattagccacatatctcattgcatattcatgagatgactcaatcttcttatgcaccctaacagatatgtgataaatatctgtatttctggatacttttctactttaaagataaaaacggatcaataattagcatctgtatcaaaattatcttttaaaatttcatgattaaacaacaaaggaattcttgacacaaactatttttacattatcacctgtgacagagactagcagggggtttaccaaacttttcttctgagcacagtggtaaaccatactatctacactttcttgaaattaagcatggccaagtgaccaagacctggccaaaggaacgtgagtggaaatgatgtataccacctccaggcccaaatttcaaagggctctcatatgccaggcaattgtaaactatagagctaaataactgcaatactcaatttccgtttttctttgtacatcccgttctttggtttccttgaaaacccaagaaagtggaatcatggtcagaaggagcctgggttactcaatctccatatataggacagccatctgtcaatcagaaacactcattttgactttacgtgagaaataaccttctgttgtgttaaaccaccgacattttgggacttggctataatcacaatctggactattctaatatacttactaaagtacagcatttcttcacattaccatcaaaattatatgtggttagaaaacacaattacgttacagtgctttccaactgaagaggccaaaactggttttgtgtattctgaaatcaccaagatcttcaacatttaaaaagtcaactaattgttgtttcagtggcacagagcctacttcagacttgtggcaaagagcccacctgtttacttttatcagtttttaatcttttctctctctcttcaaaactattgttttagattagcttttgacatacttaatattctctgtacaaagagctataaagaaaaattcacctaataaaaactaagattaaaagtgcagatggacagaataggtaatatatttatgattttagattataccatatctcatatatcaggacaaatcttactatcagactatatctcaaaataaatgtcaaacaaagaaaaatgccagctttcagggaaaagtgtaagttttaatttgtcagtaattatatctttccattcaatatgataacctagtaagaccaccaagaaatttgtttacctgattatcacacctcagttggctgacactggttaaaatactccactgagttttaactgaaattctaatccttacatgtgcttagtatgttctgagttgatagtatgatccagcaataaaattaaaagatgattacttgacacactctaggaaatgtaaactgcataaatgttatactccaaaaaaaaaaaaagaaaagaaatgctatactcaattaaatgttttctttgtatttttaatatactgtttttccaggtccttttgcttttattattaaattaacggtgcatcgtaaagtcaacaacatagtagaatataagaaatacagtaattaaaccagtgtgaatgattattcatgacaaatatttataataggatgtgttactaataaagaagcaaaagagattgtatgtaaaagatgaaactaaccctttgtctaaatagttatcaaaactttctatgaaaagattaagtttcaaatattctataaacagaacagataagacaaggaagaaagggtatttctagtatgcagtttattggggaaatgaatagaattgagggaaagttacatagctggttagccaagaggataagagcaagtgaagtggagcgtatcactctctgttcattcaacttcttcaatatacctttgcaatatttactcaattgcatgaacaaaggataggatcaactcaactttactgagcgccttattaaaatgcaaagttctatgccaagtaggcaatatgagggagaggatcaactcaactttactaagtgccttattacaatgcaaagttctatgtcaagtaggcactatgagaagacagaactatgaataaccaagatcccaatcttcaaggagcttaaatttaataaaggttataaaacataagtcacagctgaaatataatgcaacaggcaattattatcaacatggaggtataagcaaaatctgataggtacctaaagggaacagaacttatgttccataaagagaaatgggaaaacttaaaatttgagctagagattgaagaattgagatagaagggggtagataggaggaagctggacaaaaactactgacaagaaagaaaagaccaaagtgtaaatgtcattctaaggaatctgaatttcattctacagaatgaaaaaccactgagtttttcaatggtataataaattaattggaattgtccttttaagatttctctgacagcatctacaaaataaatgggttgaggtagctgaatgaaaatgttcacctgtgtgggtggtgggtagaaactacataaagtcaatatagttagtgatataataatctaggcaaaaagttaagtagagtctgaaatagggttagtttctaggaactagaaggagggagataaatatgagtttcattacaggttcaaatagacagggcttgttaactgattaaatcttaggtagaagatatttttagttcattttttttaagataaaattagggtatggactttaattaaaataaaatataaatagttcagagtgaccttaaatgaaaatgtatcttctccttattcttagtccctgaatataatcatttctatttttacttcttcaactggcttctacagtaattctaagttataaagaattcaatctcttgataatatatactgaaagacaaaaattttttgtgtataatttgtagcagtttaaaaatcggaaacaacataaatgttccacagaaaagcagacaaatttataatataaatactaagatgaatgaactaaggttatatgtatcaatataaacataaaaaatgttgagtgaaaaagcaatgtgcagaaggttatgatatatccctattacaatagatgaaagcaatactatacattgcagaacacatattagttaaagtataaacacatgcacaagtatcataaacaccagatttaagagaggaacaggaaatgtatcttgtatttttatttcttaaaaaataaaaagctctgaagcatatgtggatgttacacagatgtttgttttattgttctctataattgtctttttaattgaaacatttcaaatttctttttagaacaaaaaagcttacattaaatataaaatgtactaaaagtacccttttataacctactaattctttttagtatcacttcagaaaaagctattttctcgatactatttatcaccctactgacctctgctggtccaacaggggagaagatactgcagatgtcttcctatctttcttgctagctgaagacgacttcgggcttgattttcgcttcggagatttgctagactttcttagagaaggtgacggggacaattttgatctaaccacttctggtgaaacctttaaaaaaattcagtaagtcaattcagaaattcctccacttatggtacaacaagacttacagtattttagaatcacaccaaacttcagattaaaattaaatattattgccgggtgcagtggttcacacctgtaatcccagtttctcgagaggctgaggtgaaaggattgcttgaggtgaggagtttgagatcagcctggataacataaaaaaaaccctatctcttatacaaaaaaaaaaaagccaggcatggaaggtgcctatggtctcagctattagggaggctgagatgggaggatcccttgagcccaggagttcaaggctgcagtgagtgccactgcactccagcctgggtaatagagaaagatctcatccctacaaaaaaagtttgaaataaaaataaaaataataaaattataataaccactatctgttgatattagtctgactcctgaatccatgattttaagcaatataactgtcctaacatataccagtttcaataaagtaaattaaaatcataaaatttcaaaatctcctcagaaaaatcataaattatatttaaattaactgtatcttcactttttagaaaagaaacaaggcattctagaaatagcatgggcctgaaacagacataggcagattcaaaccccatgttacattagctggtgactctaggcaacaaactcttagctttgctcacctattcaataacataaatatttgctacttatctaatagaataatgtgaaaattaaatgaatatatatggagtagtacatatacagtgggttgatcaatatatcagtatactaatataatttaagatgtagcaagaagctgagttatctgatcaatacaaatgctgctattaagtactaacatatttattgcaataaatagcatacctcctttttaatgataatttcttctctcttctccatgttttcttgttccagcttcattaattccctctgtatcttctgacgcttcatttccaatgacaattcatgaacataatcataattaatatctccattgtcagaatctttaaaataaaattgcattactgttagaaactagcataattatctatgccaaaaatcatacagacttttttcaactaatttcttacacaaatctaaatagcagagtctttcatcaggatcacatacttctaaaagataaaagaaatagataccatttctataaaggattaaaatcaccatggttgatttcttcatgaaaagccaaatattttggaagtttctgggttttctggaaacaattttgggttgtttggaagttgggttttttgttaggagatggaattttaaaagacaaaatgcactcagctgaatttctaagccttaaagataccaaagccttcaatatttcatgctgtatacgatgcgactcattatctccttgattttcctaaagatacgctactaaaatacatcatacaaagtgaggttatattacgtgtgcaacattgcttccataggcttttcagttttaaaatttgtgagacaaatgattaatatctaaaactaaagtaattttagtactaatgtgtacataaactaatttttaaaggatttatgacattttctttacaagtgatttgtactatttccttagatcacaactgtccgtctcaacggatctgatgccatatttctatttccatttatattttctgatgaaaagctatgaagattggttaaaaaatcaagagtggtgtgtagatctatttcattaaaatacatagaagttgctggcactagcacccaaacccatcacgctcatttgccataaatgcccaggagcctagaggtgggaatttcattgaccacgatggacttgactgaccacaaactgaggtgccttctcaagatatacttctagcactttagatcatatcttaaccttgggaaaagaaataaaatgaagaactaaaaaaacaacaaacataagaagtcctacttgactgcttaaaacccaagaaaatgaacatcactgttatatattgctcaaatgcattagaatgacaactatccattcatgcttggggactgagagggtaactatatatattcactacctgtgtgactaagcttgattactcatcttatgttggagtacaatgacaatttctcagtaaatatatgaaataggctaaagcatgtttttcagtcagaaagcaattactaaatatttaattaagggcaagtagttttcactagataaaatgaagacactgaatttaattaagtgaatactagctatctccagttattattttgtactctattgagatactttacatcagtgaataataggagtcaatgttctggtttgattatgttcctaaattcaataaaattccataaccaaatacccaggtaaaacaacggaaagagtagttaattgagaagaatgattaacagtgtttctgacggtactgtattatcagtaaggcactgccaatctaaaaattcgcaactggaaatatcaccaatacagaacacataaaagaaagaagaagctggctttcagttctcaattttcaactatccaaccaagggggagaggcctgagcagttaaaatatatgtgtaagtcagccaggcgcagtggctcacgcctgtaagctcagcactttgggaggccgaggagggcggatcatcaggtcaagaaatcgagaccatcctggccaacacggtgaaaccccgtctctactaaaaatacaaaaattagctgggcgaggtggcgcgtgcctagagtcccagctactcaggagtcagaggcaggagaattgcttgaacccgggagacggaggttgcagtaagctgacatcgtgccactgcactccagcctgacaacagagcaagacttcgtctcaaaaaaaaaaaaacaaaataaataaaaagtctagtcaatgtagtaaatataactaatatagtttgctcagaagaaaagctctcaggtctttattctgaaggtgcttattttacgcatataataaaaactcagatattttcctaacctgtaagagatggactacaagataggcacattgcaactgacagtattttgacaacaaaagaaaaaacaggaagtacaaaatacaggatggaattcaaaaacaagagtctgaagccagttaataaatttagaaaatgtctctcatgtagcttcaggttatcactacaattttgccttataaaaattgattcacataaatgattgttaagtcatcagaaaaatatcaagtataattagaaaggtatatttaacaaggtagatatttttaagaatatacaacagaaaaatatatgcaacacataagaaaaggttaagattctttctatataaagaattcttactaattaacagaacaggtaaaggacattacaaggcaattcacaaagagaaagaaatgaagaaagtatacacatattttttcatgtattcaggagccattttttctaattataatattaattgttggtaaaggtacaaataaaggacatactcattctctggcagtagcaatgcaaactagtacatctatcttgtaaaattatttgtcaatatgggtaaaagccttaagaacatcaatacataactttaattttaatacagcaactttttttaaaatttatttattttactttaagttctgggatacatgtgctgaatgtgcaggtttgtaacataggtatacatgtgccatggtggtttgtacctataggtacaggttgatgtacctatcaacctgtcatctaggttttaagccctgcatgcattaagtacttgtcctaatgctctccctcccctcaccccccatccccacaacaggccctggtgtgtgatgttcccctctctgtgttgatcagcaacttccagtaatttattgtataaaaataatcatagatatataaaaggtttatgtataaggattaaaaactataaatacttgtgaattgccttgttacatcatgctaattatatttaacctttttccaatgagttagtatcatttatgtgtatcagtttttaacctcaagctgtctgagacgttttctaaattcattaactgatttcagacacttgtttttgaattccattctatattttgtactttgcctttatgatacattctcattgctaaagtcttaaataattctgaatacacagagtaaaatatgaaatttcccttatattcctcctacagccatccttactccagtgataacactgctaacagtttagtgtcatatgcatgaaaataatgttttacatttttccctttaacattcaacactgccctataaacaagatctttccaagtcatagagttcaactatcttcattttaacgtctgcaaagcatttcattaatatgatcatactttatcgtagcttacttaaaagagtttccttcttaaagacagatgaactgtttccagtattttgctgttaaaaacaagacttatatgaacattttgatatatactttggttcaagtgcaagtatttttctatgacattatttctcagactacattgctagactgaaaataagtataatttctatttctaataacaccaaactgtactccaaaactcctttaccaatgtaaacccccacttgaaaacattaatgttcttcatttctgccaaacgaatgggtgagtaatcatatctctttattttcatcagtatttccctgcagtaagattgagcatttattggccagttctatttctcctgtgagttacctatctgatacatatatatttttactcattttttaactaggccgtctttttcttatgtatttgtagaaactcattatatgtctatatagtatctttactaatgcttacacgttacacatgtcaagtattttcttttaccatttcatctgtttttaacttctgcatttagttacacagaaactcctagttttatgtaatcaaatgtttgtggcttctgggttttatgccctatttaaggaggatgtactaacctccaagattaccaaaatattttcacacattctactgcaatgatacttttactttttatgttacttcattggtccttaagaacacatgatgaacaaatacaagaagtttaaggaaccaaataaaaaccacagacttcggagtggggcctggaaatacaaagagtaaccagataatcaaaagttttataggcgtagttagaatttgtacttgctcctgaaggcaatgggaaattagggaatttgaaacaggaaaataaaatgaacattcaatttattcttttaaaagactgttctgcaactcatagagtgggagaaaacactaacaatatatttatatatctgataaaaatctcatatccagaaaacataaagaattcctctaattaacaagaaaaaaaaaacaggtaacacaatagcagaacggcagacatttggaacagacacttcacaaaatagggtgtacaatggtcagtgaacatgtgaaaaagttttcaacttcattaggagaatgcaaactaaaaccacagtaagatactactacaaaattttagaacagctatgatgaaaaaggcaaaaacaccgtatggttaactggaacaaccatttttgatctgaaattatctactaaagaggaacacattcacactccacagcccagcaattccacttcgaaccataaactcaagagaaattgatatgtgtctgtacatgtttaccaaaaaatatgtttaagaatagtaatagcaccttattatgcataatagcaccaaactgggaattacttgaatgttcatcaacagtagactaaattatggcatattcatacaataaaacactatatagcaataagaatgatgcaataacaattaatgaatgatatgtgaaataaagtacaatctcagataatactgttaacaaaagaagctaggcacaaaaagagtacatgctgtcaattccatttatatggagctcaaacacacaaaactaatcaatggtgctagaaatcaggacagtagttacctttgaggggtgagggtagggaggagtgactagaagaaaacacaaggggactatgggaaactagtaatttcctacttactgatttgagtggttttacaaatgtgttcagtctgtgaacatccaatgggttggacacatgtattgtgcattcctctgaacgtatagtatacttcagtagaaaaactttgtaagaaagattattcttgctttaaagtgggggattaattaggagacaagactataagcaagggatgggattaggaggttattttggtaaaatctatttataggcaataaataaataccttaagaactagaatattagtagtatatcaagagaaacagatggttttcaatggtattgggtacataaaaatatctatctggtaatgcctgggtggagggaaagaagtgtcagtgatgactctcaggactgttggtatctggtaggaaaagtgatgcccttaagatacataactcagatggagatgcccagttggtcaatgctaaattgagagctccagattttggagtcactacacgtacgacgttaatgaagcactgggtgcatgatttcatctagaaggaaaaattgaaagtgagaaaagaagatggctaggtaacaggaaaacaaccaagttttaaaagctgttcttacagacaagtgattctcagagagtggtctgaggatacctaggaggtccctgagacaatttcaggagttctacaaaatcagactatttctataacactacattgtttgcctggtgtactcattctcccatgagtagatagtggagtttcccagaatatgtgatgtggttaacaggtggaatgtagaagcaggtaagaaaatctacctatcaactattaagccagatattaaaacaatttgcaaaatgatgcaaaacactgccacctcctcacaattattattttttgctttgcaaaatagttatttttcataaaagcatataatggatttttatatgtcattgttaaatgaatgaatacataaatattaaaaaattttctcaggttcataatatggcagttatggaaacataaaatacacaaggataaaagttatttgggggttctgaaaaagcatataaaagtggcctaaaaaccagaaagtttataaatataccaattttttctgaatccagctaaaattgttattccagatagaataacaatgcagaaggtaagtctatgaaaccagtttagtctcactatccagggagtggggcacttaactcaatgcttcaatattccctcaacagatactttcaaatcacagagatacacaatggtcaaaaactgtgcgtttcaatcaaggaaaagcataagaaattcttattaaagacatttacactcaccttttaaaagaatttcctatataaaaggctcttgaaataaaatcactttagattttttaaaagaatatagttaagtgcaaatccttgggaatcaacatttaaggggcacacagaatacaaggagcctccgtgtaagactgaagggcttgaacaggaagatacaaaactgaagagtgataaatagaagccaaaagaagagtctttttcaagaaaacaggagctcttgatgtgtcaaatgctgcagacggccatttaggatagtaacaagtacatctccatttattctgcaatgaggaggtcattagtgactttgaaaagcagttttagtggagagttgggtcagaagactgaataataagtatcaggtgaaacagtatcaagtagaaacagtaaggcacagaactgttttaagaatttagttgttaagtggggataagcaggatagtgactaacagtaaaatagggaggagagaaaatggatgttaaagatatagaagagagtgtatcacaaatgaacaagattgctgaggcaggaggaaatcagatctacaatacaagggaattattcatcaaccttatacagcaggaaggaggcctcttacacagaataagagggaagtaaaaaagtttaggcacaaataaaaacttagtttgaaggtgtggtaggaggaagttgagggaattcctaaagatttccattgtctctgcttagtagatagcaaaaaagagaaatgaaagcatagatttatggagaaggtttgacatacctaccaggaagaaaaagaacagacttgggcttttctgaaccttttatattttcaacaactactaattattgtaatgacaactgaaaatattttaaagataagaagtatcaaatacattttaaaatgttttttatgcaaaaaaattaaaatgaaaagaaaggatgcttgggtgtgttaaaaggtaaccccttagtatttaggaaaagttagctctccaaacttgaacagttatggtttataatattttatttaaatatactagtcaactaaaatgggagagtatagctgcctttattgctattttgtagaagcggtattaggttggattatgaaatcctgagtaaccataaacaagtttcctatttgttcttagaagcaattttttaacagcactgtccaaagatggaacaggtttcctttaagtactgatgtaacaattactggaaagatgtatttacaatactttacaactgttagtctattaagtcttcagagataattctgaaatatagtagttaatattgtagtcttgtagcttctcagttctctgtcataaagactcgacttggccactgtagctcaaaagcagccacagacaatatgtaaccaaatggatggacatggctgtgttccaataaaactttttttgcaaaaaccagtgactggcccacacactctagttttctaatccctggtctaagttttcagcttctcactgaaaaagttgcttaaatttttaagatctttagttttgtcatctgtaagtagagtaacaaagctattgaaataataagacaattatataaattacattaaattgtccacccccactcaatgcatttaacaaatacaagttctctttctctgtgtttggtaatatgacattacagtgcccatctttcagaacatcaaagaggtggagaaaacattcaaggggtggaaaataaatgcttattgatgactcaaaaatgattttgctcccacctcagcttcccaagtagctgggatcacaggcatgcaccaccatgtcaggctaatttctttgtttttttgtagagatggggtcttactttgttgcccacactggtctcaaactcctgggctaaagtggtactccagccttagcctcccaaagtgctgagataacaggcaggaggactgcttgacttcaagaggctaagctgcagtgagccatgattgtaccactgtcctccagcctgggtgacacagtgagagcatgtctcaagaaaaaaaatttttttgctaattttttattaataaatccaggtctctatcttaatctgattttgatttcttctgaaagataaaagtcaaacatttcttggaaataactttcccaagtccttaagatttaaaaatctcatttataatattttatgtaaaacaaatatagatttcattttaagcttagcgttaggaatttttaaatttacatatgcaatacaatcctgaagggctgtaatgctgcacaataaagttctagagggaaaactaggaagggaaaataaaaatatgcaatgcaaaccactttctctgcctttgtacagctactatatgccagtttttgccttataattcagtaagatagaaatatgtcaataaaatgattctgaaacgagagggatcacagtcgaaaggtgttctgaagcccacgaaaactctagaaagtaaataatcaagaattcgccatttaaaccaagattctgaaactcaccatctctattagtttcccattctacattttcttcttcactttctggagttctttccttagtgatttttatgtcttccttttccctatgtctccctcttgaagattctttctaaaaaagtacatacatacattcagattactatatttttaaaaattatgaggtagtttattgtaataagagaacattttaatttcattcatctctgtttcatcaaagaatcagttttgtaaatagtcacttatccactaagtagagaaagtgacaaattctagtttagcaccacaatgaaaagactatactccattttactaaagaacaaaaactactaaacaacaaaaactaaaagagatgtagactatactacatctattttactaaagaacaaaaactttaaatattaaagagtagctaagatgtaaaaatatacaatgcaaatctaatactttaacaaacttgtgacattcagctacacagtaagtttccacgtgaaaaccactggggaaaagacagtttaaaatgaataaaatacaatggaaggatttgtaagtgattatattttaaaatgtcaaaaaagggctaaaccattcaccacagacttctaaaaataactgatctaggacttgtcatatattcaagtaattgtcattttcctagacacccaaggataaatccaaactcatttaatagtattataaaggtttacaaaaatatattttacccattttgatgaaaccaaatggtacctaaaatagtaaattagtcctcactactgctgctaaaaaacaggttttacattttattccaggtataaaagcagcttacacacaaaaaaggacaaaattaattcagattataaaagtcaattaaatgtcctattacataagaactccaaatcatattttactaggtggtaagaaaataaaagtaaccagtgttatataattgttatcttccaccacagcagaagtcttacttttactaacattgtaaatactatgaaagacacttacacacaaggatattaagtgctcaaatttctttctgagcattactaatcataaaatttggctgcttaaaacacaaattaatttctctttgtagttttcttcttaaagaactctagtatatataactgcccctaaattctacatatttaggcatgaagtcatactgtaaatattactgacaaaatttggatttgattgctggtaagacaacagaggctgacgaaaataatttgtaagttatatgagaataaaacctgccatgaaaaaaatggtgaagagtcaagaaaacagaaatgggcctctacttgaacagaagacaaaaggaagaaatataatttacttttactcttaaaacatattatgtggaacatcaatgaagaactatcctacatcccaaacaatttttgaatgttctgtggattaaacccactgtaaatatacattactgaataactataccaaaaatatttaataggaggttatctccaaattattaaataacatattctgtgctttctgtccacttaaaagtatgtaaaatccaattgcaagtctagttaaaaagggtgtcagagcagtagtgctggtgctgcaaaatcaatctataaatttgtaacattttttatcagatttagagccagaaatgttgtatcaataaatgtcattaataatgatgtctgtaaatatttcatatttaccctaaatattaaaattataatttttgaattgtccatgttttccaatatgactctgatgctactcccagagatcatatataacttctattattaggtactagagactgaatgcaggcttaaataggtgatggaatttcaagttcttacctcaaatcataatataggaaattattttggtaacatttattaagaaggtctagctaatttaaaaaataccttatttcctaatttcccccacttcaacaatgtgtaacttgtttaggtatgttatgccttttatcaaacaaagttattcccccttttctcttatactcaaataaatagggtatggtattactcgtccaatgtagtgtagcacggtctactattccaccttgctgtatttcttgaacagaatggcttctcatcttctcttaaatccaaacatattaattaaaagtataacctactgattactatgtgttgtaaattagtcatcctggaacatctaagtcttgaaatacttgaagaaccacagtattttagccaaaacccttgggatcagatattttaagagttcagaatttttttttttttttgcatttcaaagcatattaagtagtactactgttccagtggagtctggaacagtagcctgtgaccaaacatactaacatttttgcagcaaaacacagaaattcaccacttgtataaaaactgtaattaaatttatttcaattaagaccaggttttgctcccaaatgtctgtgtcttaggaaaaatgtttgaagttttttgaatttcagaaatgtaatacatgattttagatgtttatattactttcatttccactctcatatgcacatttatttcttgaacattatatgcgtgggcagattatgttcatcattaattttagataaaaagcaagcattacaaagaatatgaaataggaagtgtcaaggctaagagagttgagaaccattattagtaactagagtataaaaatggttaggaggctgtgtaagtaatataatccaacctcctaccctatgcagaacaattttccacaatatttgtatagctatggaagccctctattacaagactcttgggggcaaaaatcttagctctgtgctgttgcaccctttcttcccatttccagacagttctaattattagaaaattatttcttatgcccattgcatctttcttaacctctctagaggttctacctccctacaatttctactgattgggaatagttctaacctctggaattatgcaaaacaaatctaatacttctttcacgtgctagccctttcttcatcattctgtcatcttctctgggcatattaatcggctagtgtgcttcaatgaaacatgataccccaaattaatctagtcttgtcagaacagcataaagcatacagcttccaactcccctgacttagaattgaaattatacttgtattaatgaagtctaacttgttttagcagagaaaaatggagcttcaactaagaaactataatctcctaaactatacaaatttgaactattatttcacataaaatgaagtctatatatagggtaaacttcaggcctaagtgacttagtaacagtgaaatcatcaaagaccaaatattcactcttgttttcatttatcacagctccgctctgcctaatgttgacttcacattaaagcttatctcttaccataataagaagcaatctgggtctcctcagtgtatctctcccacaagcacaaataagaattccttccttcagagtgactaggccaacttcagtcacatggccacctatgaatgaataactatcaaggtaatagccatgggataaatggcttaggcctgcttcctgaatcaattgaattagcaaggagaatgggattattctaactggattcgactaatcaaggcccagccatgaaagtgggatcaattccccaaatcacaatgctgatacaaaatgaaaaagtggtggaacgggttctggggaatccaaagtgatctgcctggcacttcatagtacacttcacttcctcatggtacaatgctacacttttgataacttcaggctataacaagacagaatttccaacttaataaaaatttctcctttactattcacatttccgacccttcttctaaggtctttttccatcttcctgatgtatatccttttaaatattctctatttagtgaagatctgttggtagtaaacactctcaattttatttgaaaaggtctttattttattctcattcctgaaagccagactttggtacatactttgggttgataggtttatctcagtactttgaaaatattatttcactgccttttagcttccattgtttgttactgatgtcatcctgttgcttctttgcatggggatttgtctttctgtatctagaggtttctaggattttctctatgtctctgatgctttgcagtttcattataatattctatctctcatgtactgcacatctcgtatctgtagatttgtggttcatcaattacggaaaattctcagctactatttcttaaaatgttgcttctccaacattcttttttttttttcttctgggtttccaactagatgcatattgaattttctaagtatttcccccatgtttttaaaccttgtcaatactttccataacttctctttatgtgatgaattctggagaaattcttcagctggcaactattgtcaggtcaagtcaccctattctacaccagtgcaattaactttctatgcctaaaatcaattccatgtttatccctaacagtttctgagcttcctatataatcacacctcttatattggatttacttacatctttccacaattacttggagaaatttcctttgaagttaatatacaaaaattatctcagaacatttagtcaaagaatgactcaattatttgtatgtcaataacattctcacctgctactaatattcacttataaacatctacacaaatctatccactactaaagttatcattcaagtaataattccatatttattatattgacatcagaggattttaaacattcaatgttttacgcaaaactttgttttcttctcctatcatccatctatctacctatcttattgatcttatctatctatcccatctatcgatctatctacttgagacagggtcttgttctatgatccaggctgaagagcagtgacgcaatcatagctcactgtagtcttgacctcttgggctcaagcaatcctcctgcctcagcctcccacagctggaactactggtacataccactacgcccagctaattaaaaaatttttttatttgtagagacagggtctctctatgttgcccaagctggtcttgaactcttggactcaaccaatcctcctacctcagcctcccaaagtacagggattacaggcgtgatccacgataccaggtctaacctctcattttattttaaaagaataatgctatttcaaatcctattgctctaaaaataaacttagtttcaaagaacactaacattatcaaccaattcctggattttctttgagcagctctagaattaatgttaataccaatttttcttctctgttatttactgtcatgtggtatcccaaaattattaacaagtgaagcaactattattaattttaaaaagattagggttttcgaccttaatgttttcaaacctttataattggacacatctgattaaagctaaaaaaaaaaaaaactttattaatctagtagaatggttcattgttgtgctttggcctgaacgttagaccaacagcctgctcagtctatatacagttttagaatatatatacctaatattttgaaattttgaaattattcacagatctgcagtttcagatcctttcaatattatagaaacaaagagagtaatttagtcctacacttaatgaaactgtagtttattttgtttatactaaagaaaaatacccaaataggattattggagaatctttttatgaagtgctcatataaattaaattagctcatctcagaaaaaacaagtaagaaatatacagataaccaaaataacatcatctctaaaaagtacaaaaagaattaaaatgaaaaagaaatagttaatacttctgtatctatgtacctaataatacagtagtgaagagcagaaactataggatatggagtaaaagagacagaaacctactactaagatactttaacataatgttctcaaaccaaaatagatcaaataaagaagaatcttaaaaatataggatgcccaaagaatagatgttttatatatatttatagaacctaaaaaccaagaactagaaaatacaccttttttttaaagcatgggtggaaaattgagaaaaagtgactgtcttaggctacaaagaaaatctcatcaaattcaaaaatatgaagaaaaacatgaaagttactttttaaaaatcaaaagaaaacacacatacacacgtaaaaaacaaaaggccctccaacctgaaaattttaacattccattaaacaattcttagataatgggtggaatccaaatctaaagaggagaacttcccgaaaataactgtcatagtttgacatatgagattcatgagattcagctaaagcagttatctgatgagaacttacagcattaaagaacataaataaaaatgaaaacaaatgttcaacaaattcaacaacaacaaaaaaataagcaaccaaagaaggaatttaaagacccagaaataaatgttagaaagcacaaagaaggaactaatatacaaatgtaaaagctgattctctgaaaataaaccactggctaacctaaacaagaaaaaagggagaaagcacaaattcaaaatcctaaatgacaaagtaaaagtatctctaagaacaaagcaaaatgaaaaaataaaactatgaggtgttttttatttttttttattttttgagacagggtctagctctgttacccaggctgcagcacagtgcgcaatcttggctcactgcaacctctgcttcctgggctcaagccatcctctcacctcagcctcccgggtagctgggactacaggcacacaccactacacccggctaatttctgtacgttttgtagagatgggagttttgccatgttgcccaggctgatcttgaacttctgagctcaagcaatctgcctgccttggcctcccaaagtgcgggattacaggcatgagccactgtgcccggtgagatactgtgtctggtgagatttctttacataactctatgcaaacaagtttgaaaacttacatgaaaaacggctgaaatttctagaaaaatactatttgccaaaactgactttaacagaaccaaaagtctacatcatttttcaaagaaaaaataaagccagttaaagaactccttcataaaatagtaccaaacccagtgggttttgcaggggaattttaccaatcctttaaagagcagaaaatctaaatgcatttaaaatatcccagagtaaagaactgggaatattttgttattatctgtattatagatgaagtagtatagtgctgtttcaaagcagacctgaattagctgtaaatgtacattgtaaactctagggtaaccaccaaaaaaagtagaaagaagtataattgatatgctaaaaaagaatgaacaaagaatcacataaatgctcaattaaaaccacaaattttaaaccaaaaaaggcacaaaacaagtgagaacaaaaacaggaacaaagaacaatggcaatgaagagaaaacagtaacgaatgttgtagatattaattcaactacatcaacaattactttaaacatcaatggtctaaatacaccaattaaaacacagatattctcggagtggatggaaaaacaagacccaatggtatgttgtctacaagaaacccacatataaacacatatattaatagattaaaagtaaaggaatgaagaaaggtatactgctaacactaatcaaaaaagagtatgagtaggtatattaatttcagacagagtagactctagagcaaggtaagttatcagagacaaagaggagcactgcataatgatacagacgtccagtctgcaaaaatacataacaattcttatgtgtatgaccctaccatcaaagcatcaaaatacctgaggcaaaaaccgataaaattgcaaagagaaattcactcttatggttgaggatttcacacccttccatcataaatggaaagattcagcaggaagtcagtaaaaacacagttgaactcaacagcaccatcaacaaaattgatataattgattatagatggctttatctaacaacagcaaaatacacattcttctcaagctcatacagatcattcaccaagacagatcacattctgggccataaaacacacttaacaaatgtaaaagaaatcatacaatgtctgctttcagccacaatgaaattaaactagaaatctgtaacagaaagattaggaaaatccccaaatgcttagaaattaaacaacacaattttaataaacatattggtcaaagaagaaattgcaaaaaaatttttaaaatattttaaactaaatgaaaataaaaatataacttacaacaatttgttggatgcagtaaacactgtacccaaagagatatttatagcattgaatgtatatattagaaaagacaaccaaaaatcattaatttaagcttccaccttagaaaacaacaaaaagaacaaattaaacccaaagtaagcagaagaaaataaacttaagaattagaatgaaaaaagtcaatgaaatcgaaaacagaaattcaatagagaaaaattagcaaaaccaaatgctgttttctttgaaaagatcaataaaatttatcagcttctagccaggctaattaagaaaaaaagagagaagacataaattatcaataggagaaacaaaggtagggatctcactacaaatcccatgaacattaaaaatatgataaaggtatactatgaacaactcatgaatacaaacttgacaacctacatgaaatgggccaattcttgaaaaatacaaggtgccaaaactcacacaaggagaaacaagcaatttaaataggtatatatctattttaaaaattgaatcaataattaataacctttcaaaacagaaagcaccagatggtttataggtaaagtctaccaaatatttctggaagaaattataccaattctctataatctcttcagagacagaagagatggactacttctttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgagatggactacttcttaactcattctatgaggtcagcattatcctaattctgaaaccagacaaagacattacaaaaaaactaaagaccaatatctctcatgaataatagcaaaaatccttatcaaaaatattagcaaatcaaaaagtaactatataaaatgatggatatggaaatctgcttgactgaaggaatcatttcactatatatatttgtatcataacatgttatgcaaattagatataattttaaaagtcaaacttaataaaaagctagcaaatcaaatcccacaatgtatataccacaaccaagaagaatttatcctaggtatgcaaggctggttcaatattcaaaaatcaattaatgtaacccaccacatcaagagactaacaaagaaaactcacatgattatatcaatagctataggaaaagcatttgataaagtccaacactcagactaataaaaactcttggtaaattagaaacagcggcgaatttcctcaacttgataaagatcatctacaaaaaaccctacggctaacgtcatacctaatggtgaaaaatgagaagttttcctgctaacatgagaaacaaggaaaggatgttccctctcactattccttttcatcatactgaaatttctatctaatgcaataagacaagaaaaggaaataaaaagaatacagattattaagaagaacaaaagtgtctgcaaaagacatgattgtctatgtagaaattctgaaagaactaacagaagaacttcaggaattagttcttttttcaagatcttcctataaagttcaagaacttcaagacttcctataaagctatagcaatcaagactgcgggtgggcaaaagaactgacaaatagattagttcaggttgcagaatacaaggctaatacacataaaagtcaatcactttcctatatacaacggtaagtggaatttaaaattaaaacaataccattttcatcagtatagaaaaaaatgaaatacttaaggataaatctagcaaaatatgcataagacatgcatgaggaaaattacaaaattgattaaagaaatcaaagaactaaataaatgaagagttattccatgctcttggacagaagactacatatctgtcaagatgtcagttcttcccaaattaatagattaaatgtaatccccaccaaaaaaccccagcaagttactttgtagatactgacatactcattctatatggagaaccagaatagccaacacaatactgaagaacgaagtcatgagattgacactacctgacttcaacacttcctataaagctatagcaatcaagacagtgtgggacgggcaaaagaaatgacaaacagatcagtggaaaataataagagcccagaaataggctcccacaaacatagtcaactgatttttaacaaagaagcaaaaccaattcaatgaaaaaaggatagtcttttcaacaaatcatgctgaaacaaccggacaaccaaatgcaaaaaaaataaataaataaataaaaagaatctagacatagacctcacagccttcacaaaaattaacttaaaatggatcatagatcttaatgtaagacaaaaaaaataaaactcctagaaagtaacataagagagtatctagatgaccttgggtatggcaatgacatcttagacacatcatcaaactataatccatgaaagaaataactgataactggacttcattaaaattaaaagcttctactctattaaaaaaaccatcaaaataataagacaagccatagactgggaaaaataagctcagaagacatatgcaataaggactgttaccaaaaacatacaaggaactcttaaaattgaataataagaaaacaacctgtttttaaaaataggcaaaagacctgaacaatctcaccaaagatatacagatggcaaataagtatatgaaaagacgctcaagagcttatctaatagggaaatacaaagtaaaaccacaaagagataccactacacacctatctgaatagtcaaaattcaattcactgacaacaataaatgctggcaggatgtggagcaatcgaaactcactcattgctggtggaaatacaaaatgatacagtcactttagaagatagttggcagttttttacaaaactaaacatattcttaccatatgatccattaattatactcctatttacccaaagaagttgaaaacatatgtccacacaaaaatctgcacacagatgtttatagcagctgtattcataattgccaaaacttggaagcaaccaacatgtcctttggtaggtcaatggacaaataaacagaatagccgaactttacactgtggactatgagtaataataatgtgtcagtgtaaggtcactgatcgcaacaaatgcaccactggtgtgagacactgatagtggtgcaagtcctgcatatgctgggggaggaagtgttatgggaaatctctgtatttaccattaacttttgctgtgatcctaaaactgtataaaacatagtgtttttctaaaaccagaaaagtgacaagtaaaattatctgtacttgatatcttaagtaaaatattttccctaaaatacagaatttttaaaacagagaagaaaaagaccaaaaaaaaaaaaaaaaacagagaaaatgggcaggggatacagtaaattacctgtaaatacatgaagatgcccaacctcactcacaagagaaacataattaaaactatgatgaaataacatttttttctatgaaattggcaaaaagacaagtttgaaaacacatactaacaaagcaaagataaagtaatttggctctgtgtgctgctggcaacaatgcaaatgtcattatgtagtaagattatgtaggcatttaccctttgacacagcaattccatttctagagatttatatttccctaagacacagacacaaaaatgcaaaataacaattgcatatattccctgtagctctgcttttagtggcaagactgaaataacctaaaatctccactaatagaagactggttgaataatgtaccatacaatcatacaatgaaatactatgtaactataaaaaagcttaagatatagctttgcatactgctatagaatgatctctggtacagtgttaagttaaaaaagcaaggtgaagaaaaatgtatacagtaatgctaccttttatctaagaaaaagaaaaaaggtgattatatatacactaatttgtgtgcatatatatgtaaatattaaatatatatatgtgtgtattaaaacagccggattacccaaaaactaataaatgtggttacctacagggaaaagggtacagcaatcatgggacagaagttaaagacttttctgaatgtaaaactgttttgtaaatttagctttgaaatcatgtaaacgttttatgtaattagaaaatgaaagaaaaaagaaatctaaaaacttcaaaattacttgtaattatctgattatttcagttaacccaactaagtatcaatttggtggtttaaccacatagagaagacctgtttcaagtaacttaaaatgtacgaatttgactatatattcctaatagacagatttaacaatattatcttaataggatatatcttaagaactatatagaaaccttaagttgagctcagtataacactattagcaataatatagttgctattctgaaactattaaatgtaatgtaaggtcaggcaaatgaataatgtcaacagggaccaaaattttcagcagaagagaaaaatcatacaactaataaaatcaaagttaagtaaaagtcctgcagtccaaatctgaattatttgaattcatgtttgtctgttttaaagagaagatctatacgcatttcctaggtatgcctaatgaaaagccccaaagacaatgactaatctagcggtaaaagctttcaagtactctcagtaaaaggaaccaagttttttgaggaaaatggctgattccacatatatagtatgaaatacacaatgtgctgggaatacgtgatcttcagagaaacaaagaaactacagaggattactaaagtggtctcaaaacaacatgatataactggacttcattcaagttgaaagacattttgaaagacaccacaaaaaaaaataaaaaggcaggctgcacactgggaaaacgtatttgcaatacatatatctcacaaaggattggtatacagaatattaccaattggtaataggacaaagagcctaatttatgagcaaaagatgttaacaaataaacaattagccaataaaagatatacataagatcagaaacagccaataaacatatgaaaagatgttcaacatcactaaccattaagaaatgaaaattaaaactactatatacccactagaagggctaacatgaaaaagaccaacaatgccaagtgttggtaagaatacagagagaaaattattcagtgtaggtggagatgcaaaatggaacaaccacttcagaaaactgttcagcagtttcttataaagttaaaaatatacataagacacagttctacccctagatatttaccaaaagaaaacttttccacacaaaaacatatatacacatgttgatagcagctttattcttaataggtgaaaactagaaacaactcaaatgtccatccactggagaatggctaaacaaattttgatatatccatctaatagaacatgaatcagcaataaaaggaatgaactactgacatatgcaacaatgtggttgaatctggtaagtactatgctgaaagaatcaagacacgataatatatatgattccattacagtgacagatcagaggttatcaggagtgagtttgggaggcgactgatgacaaaaaggcatgaagatatgttttcggttgacagatatgttctgtatcttgattgtggtggtagttatacaggtggcacatctgtcaagactcaaactgtatacttaaaatgggtgcatttcaatgtttgaaaattatatttcaataaagtaaatttaaaaaaaaggctcaggatccaatacaaagatcacccacaagctaaggaagggacatctgggcataaaaatactaatagtgggaatggattacagttagagaaatcagtaaaaactcatggttagcttaatacagataacagatggtcactagaaatatttatatataccagttagtatacacgcatatatttatttgctctgctagctgagaggtcctaaaagaaacaataccccactagcacaaacacagctaacgcccaggttttggttactaataccattctacaataaaagaaaccagggcacaagcacatgctcattcccttgctgtgtgtgccagtgtgcatgtgtctcagaatactaacccttggaattcagttatcaggctgtgaggaagcccaagctatccaagggaagagaccacatagagacaaacagaggcctctagctgacagccagcatcgactgccaaacaggtgagtaaataaaccttcaagtgattccagcctacgtgcttccagtagattaactgaggcccacagatcaagagaaaagacatccctgctgtgccctttctgaattcctgacagaatttgagcacataataaatggttgttttacatcaaggaatagcaactggaacaactcttaatgctatcaaagaatacatctgcagatcatactaggctaaacttaaaagttttttccatataaaatgaaaatatatagctatgttggaaaatcaccataattatctccgtactacatattcattaccaaatttccaccaggtggtagatacactgtacctctacttatactcttatccttctaagccttttcttttgaaataaacaaacaacactcatttgatctatttacccctacagtgatcagcttcctaaatttttactttggtgactttctactatttctattttgcatttaaactatgttttattatttccaaagaattttatacgtacttcttcatttggttctcaccataacttgtgataaactggggcaggtacatctatcctacaagttaaaagacaaagtcaagagacttactcaagatatagttagtaacaatgttaaggccttctaacttaaaagtcctccactgcaggagtcctgctaattctaacagctacagtattatcccttcctctagagtcagtgccatttttttttctcatctagacagaaatatcaagatggcagaaaaagaacaaggtaaggccaagtgcagtggctcacaactgtaatcccaacatttttggaggctgaggcaggaggattgtttgagcctgggaggtggaggctacagtgaatcatgtttgcatcattgcactttagatcgagagggagagcaagactccgtgtcaagaaaaaaaaaaaaaaagaacaagataggggatgtcggggggcagtaagagaactgaggaggcaactgtgaaacaaaactaataattgcatgggcattctaggaggtacaatttccagagacagtaaacttcatactagaaatacattttcaattcagtaataagacacctggaataggtttaaagttggataatcaacttgagatccacctatagactgagaattgaaaaagtaatttgagtgtagtcatcttaaataaattcaggataaatatcaagtctaaacaaatgatctgtttgaaggtaagcaattaggttggggtggggtaggaaacataaacaaatgacagaaatggtcctttgaaaaaacagtggacaagggaaagagaacaacattgtgaagtctcaaaagaaaaacctcgaggtggaaaagaaaaaaaacaaaacctctaaaaattactttttaggaaccagaaaaagttattaaaataacaggtaaagaaaaagtatttaaccagttgaaataattaacatttagaaaattaacatcagttaaaatattattccaattgtcatttttgttttgttttgtttttttgagacagagtcttactctgtcacccaggctagcatgatctcagctcactgcaacctccgcctcccaggctcaagtaattctcctggctcagcctcccgagtagctgggattataggcatgagccaccacacctggctaatttttgcatttttagtagagacggggttttgctatgttggccagtctggtctcaaactcctggcctcaagtgatctgcccacctcagcctcccaaagtgctaggattacaggcgtgagccaccacactcagctatcccaattgttttaatattgtatatgaggacgaataaacaacaacaaaaaactaaacactttaaaaacaaagatcatgaaaaagttctggaaatgaatggtggtatcagttgcataacagtgtaaatgtacttaatgccaataaactgtgcatcaaaaaattgttaaaatagtaaattttatgtgtattttaccacaataaaaaaatgaaaataaaaacaaagatcaataaagaaaaataaacttagaccactgctcttgcccatttgctctgatgtaagacttaggtaagcaatactcatagggcacctctaactcctaaattaggtatcttcccacagtgacaaattatctaattctttcttgaatgcagccacaaagcttctactaagagataaggatgccctacagcacctgtatgtctccgtcatcaataaatgcttgaatattcttcctgactatatttaggggtctaattttgctttcaaagctaatttatcttttgtgctcaaattccataaaataacaagtctctgcaatataaaatgaaaatacaattccattttaatctgaaaacctctactgattaaatgcaactatttcctactgactacctcatataagcctctcacttttcagttccaccgtattaagtctgattcacatcacctagaccagccctttccaacagaaacatgatgcaagcacttaagtaattttacaattccttgttgtaacattaaaaagaaaaaaagataaaggtaaaattaaaatactgataacattatttaacccagcatatccaaaatcattgtcctctcaacatataatctacattttaaaatttgagatattttactttcttttcatactaagtctctgaaattcactatgtattttatatttacagcacacttcaattcagactacccacatttgacagcacagaccttacatcagcagggtttctcaatcatggctgcatatcagaaccactttccattaattcagtaagtgaacttactagttccagggtctggaggtaaactggtgagcaagacagatctcagcatgtctcttttctctattgctaaactgtgagtttggcacacaagaccactgataatctggtcctaatctacttcagccttcatctcacgtccacgttatcatttttataacctaggcacacagcttcacaagctcctcaaacacattagtcctttaaaactccttacagttcttgtgttggttttctcttcttccctcccctctgacaccgcgtcgatccttcaacaccagtccaagtgtcattttccctgaagaggtccctggttctccaggtaattacttactctctccattgtgcattttgctcgtatctttctgacacactatcacatgctacagaattacaagttatccatttatgaatttgataaccacaagatcaagggttaccaacctcataattcaaacacactggagttgacatcagtgacagagaagaggaggaattacagctaatttgctgaaaatcacacccattctatcttagctatgcctatgtaatctattccacagttgcccttacctaacataggcctgatcttcctagagaaattcattacatgaagatcaacagtcatgtgttgcagcaagaatgcaccataaaaatgatcagtatctgttacctgtcaaatataacactaaaaataattaataccttgctggtggctcatgcctgtaatcccaggactttgggaggctgaggcaggtggatcacaaggtcaggagttcaagaccagcctgcccaacatagtgaaaccccatttctactgaagatacaaaaaattagccaggcgtggtggcacgcacctgtaatctcagctacttgggaggctgaggctggagaatcgcttgaacctaggaggcagaggttgcagtgagcagagatcatgccattccactccagtctgggagacagggtgagactctgtctcaaaagaatactaataaataataattaatatcctggtgtcccaggttattaacagttctgtttaagtttagatagtgtattacctaaaacctgatcactgttgaaatttgtaactctatcccttaggtatacacgatgctcagtgcctttgagggctttctcatctagggaaagcaagaatcaggctttaaatttcttaacaaaatgccaactttactgtactaactttatttgatgaacataaaaacccttatgataaacaacacacttacattcagttaactgtcaacaacctaaatctccaaggctgatgttcatcttctataagagcctaaagacaatttatattagaaaaagctaagtgccatttcaataccagtatataccatttattacgcatgtgtcatcatggaatagtaaatcatttacatgtatattcttcacagcaacatggacagcctgcatttccattttacggataaggagacaagaagaagagtttaacaattcctaaagtaatatgctctaaatatggattccagatgtttgctccttatactaataacaattcatctagtagtatgctagagtcagtctgtactgactcataagagctgatttaaatttttaggaattctggaagccactgttaaacacagccatgattgaacaaataaactgtattaaaaacaaagataataagtactcagaactcatagtaaattttacttctgaggttatttacattttgtgtgtctgtttataatatacataacgggaacactgtatacaatgtcacttagcatctcttcccaactatgcatctgtcagtgatgtctttgaaagcttgaaactgaccatggtgggagtatttacataaaagaaggggcaaaccctagaaagcatggctttctttttttcagagtagcggtacatttactggcagaccgctgaggcatctgttattctgaatcaataggttatttcaaaatgtaatacacacgcttagccccaacccagaaattctgattcagtagattaggggtggaatattggcatgtgtattttgaaaaagatcttccctcaaaaggaatgttgataaaaacctccagctgagaactatttaagatttttaagactgtatcactgtataacattagacattagaaaactaaatacttaaaactgtattgtaagaaataagtttcacaaattataatgctgtcagggcttttttaccatgggtcaaaaacagctgcagaaaacttctacataatttaagtgatcaaggaagttgttgcttccttgattcagttacaattcagtaactttcataaaaagactataatagaggacaactggatatccacatgcaaaagaataaggctgaacctttaccacatcataaataaaaattagctcaaaatgtatcaaaggcttaaatataagagctaaaaccagaaaatgcttcaaagacaacatagacgtaaatctttgtgaccctggactaaacaatagtttcttagatgacaccaaaagcacaaacaagcaacaataataacaaaaaaaacaaaaacaggtaagtcagatttcatcaaattaaaaatgtgtatgctttaaaggacaccatcaagaatgtgatgataacacacagaatgggagaaaagatctgcaagttacatatacgataagggacttgtatccaaaataaagagaacacttgtaactcaataataaaaagacaactcgatttttaaaatgggaaaagaatctccaaagaaaatatacaaatagccaataagtacacaagaagatgctcaacatcattagaatccaaaatgcaaatcaaaaccacagttagatcatcatttcacacccatcaggatggctataatcaaaaagttagataacaaaagtgttggtgatgatgtgcagaaactagaactttcatatgctgtcaacaatgtgaaatgatacagccacttaatgaaagtctagaagttcattaaaaggttaaacacacagttaccgtagaacttgtcaactccactcctcaatataaacccaatagaaataaaaacatatccatatacaaacttgtacataaatgttcatagcagcattatacacaggagtcaaaaagtagaaaaagcccaaatatccatcactgatgagtggataaacaaaatgtgatattatcaatacaatgtaatattatctgacaaaaataaggaataaaatactgatgcatcccatactctttcacgaaccttgaaaaggtatgctaagtgaaaaaagctagtcacaaaaaatcatgttttattattccatttatatgaaatatataggcaaatctctagagagagaaagaggatttagtggttgcctagggctggtggctaggagggcgactgctgaaaagtttggcgtttctttacgtagcaatgaaaatattctaaaattgactgtgatgatggtttcacaactctaataatactaaaaaccactgaggcgtacacttttaatgagtgaactgtatggtatgtgaaatatggtatgataaatttctagaaaaaaattagctctgggaaagatttccattcctgacaaacacttttcttttattcaatgaactacattataaattttatttctcttggcttcactgccaacaaattcacagctaaaatttgtggtcatatgtgctttcttttacctcaactttctagtgcagtttgttaaccccatgtgttttgctttcattgttttcatttgtaagtgttctactgcaagccacttcaatctttcttggaagcagatgtgatggctggctgaattctgaaaacttaaagatactcatgatcctcgtcaaggatccctactaagggatccctacacaaaatccctactaagttcagcttgagttctgccaactaatccctttcatcttaactaccataaagaactgaaccaatcacagttttcccaggggactctttccctctaaattacattatccatatagaacattataatgccgtattacacatttaccatatatttagcacacaatatttaaaatgaaactcaaattaacaaatcactactgaagttgaactttgttttgggaaattcaatcctaccctaacaggtgaggatgactcctctgtatttcgtttctggggctcagtgtccacgtcttggcgcttgttcttcattctttctctaagatcccctgtaggtctttctggtgacctttgaaccaaaacacagaaacaaaacaaaaaacgaaacaaaacaacaaaaatctgtatttatatattaataacattttataagaatgtatttacagaaataacctcacaaatctcaatacactttttctaactgaccttgactcctgaatttctgaaaaatttcaccttaaatattaatatgcaaaacacgagcaacacttacagtttttctcccaataacaatcaaaatgtatatgttaaattccacgaagtggcaggtactggtgatgtgaataagaaattatatgtgaactgagaaaaaggaactaatagcttgacttgttttcctattaatcacataaatatattagttatatgtgggagcaaaatgtagtagtaacacaaagttttaaactacaaagttgcaaaattaatctagaggtagcagcattatcatttatactgaaagatataagaagatattacaagaaataagtttcttgtatacacatgcctgtggttggatgcaacatcaataactgagaaaatattttatgtaccttaagtaagaatcaaagcaaatataggagctttaaaatttatcttaaattttaaattatttcagaataaagataaaggattcaaggcaattttacaacagtgattttcatattctgctgtaaattttttaactaaaggaaaaatacatatttatactcaacagtggtaaggctttattatttatactagaaatttgacagtatatggctatgcaattattttcactatcagtgggaaaaaacaaaggagagatggaaaacagactgcctttaaagactatttctacaacacctttaaaacagggcaaaagaagttaaggaatgctctgttcctctttgactaccaaaaagtactatatataaaaaagatataaacaaatcacataaatattcacatctatttcaagcagtcattgggcaatcaaatcagttccttgattttatgaatataaatcataaggttagtaaagaaataatttgagttaattcactttaaaggatctcattaatgtttacatgcacatgtaatagatttatattaaatgttttaacagttaaagctaaacttgaaactggaatctcttactaagaaccagtacttaagtgctctaaattataatgatgtacatgtaaatcctatgtgccctggtttcctttatataataaaacactttagtatgaacttgtttctatcctaaacagcacccaacagaatgaatgttttacacacagcgaattctcaattaattatgtaaaagtcttgtatataaacatataaataagcattctgtaaaatacattgcttttcttatctttgactcgcattatgaactatgtttttcctcccgacaaaaaaaatgcacaaatacgaaagaagttatcagatggaaaatcatacacaaaatagcaaaattataataaatattctttattctaagtctagcaatgacattactttttcccattttagacaaatttctctgaccatttttctcaaaatgatttcttgaataaaaattctgagtcagctaataaatttcaaagataaattttaaaatgtatcaaaagtatagtattaaagcaaaacattaaaagtatcgaaatagtttcaccaggtatgtatctacgtgtatatatacaagtaaacacacatatacaataaacactaatcttcccacattaacggaagtgacaaatgacaatctaaatacaaataaaacagtattcagaatcacaaataaactaaaatgtacaatgtttacgtgaaaaagaagttggctaatgttgagggtttgaattttaaattctcctaaacaaaatctacccatacactacccccaaaaaaatcattcaactaaaaaaaaaaaaaaaaaattccaattgctaatgttcagtttttatagtgttgctatgctatagccaaaacaatcagtgtaaccaattttggatctaggtaaattatttctttaccaatcaagttaaaactgtttttgtgacaaactttatgtatattacatctttaaataccataaaataatcatcatgagggaaccaaaagaaaaataaaaggtctttattaagcaagtttaatctagccaagcctttattaaaggcaaaacgatgttcgaaatatggagcatattcatccacatataaatacatattttcattaacatactgtgctaagggatttggcaaatgcattttaacctatagaatttgtacaaaatttgaattcagaacatcttaaacagctaaaattataccctatttgaattttactattttaagagttaaaaatagcctcactaaaaagaaattcagacaccatggaattctgctgtcttaagcagcaatttaatacataattaggggggaaaaagtaagccatacacatactacaaaaagatctactgtcaaaacaaataaataatgaacaaataagttaatttgaaagcaaacattttattaatcttgaaaataacaaaaagatcctgtcgatcttcaattactggtaagactaccaccaatatagaaaatctgaccaaatatatggttgtatttcagatttttatactagataaattacaaaagccatcttctaatagtacatgaacaatacaaagttctcagtttaccttctataattgctgctataacctttaccacgaggtgaagggccatgtacgaatctacatgtgtttccatagaggcagttgccagtcttcagccagttacggcactgtgtctaagagacagatattactatgtaaatttcatatttatttctggaaaaaaaaaatgctagcgggacaaaattaaaacaaatgctaccaaaattccagctaacctgtgatatattactccccaaataataaaaacttcaggaaaaaaatatggaaaaacccataaaccttatcacccttttcacttctttttataaaacacactttaaaaaatttactgaacaaacattcctacaataaaacaacctgttcacctttatgatacaaataagcatttcaataatagaattctaagagaacccctgtgactatactagtgacaactcacctctgctgtactgccagtgctgggtccaagcctctcaaatacactgggtcttcgggatgtgctatcagatatagtcttggtattttccactgtgaccttccttctaatttttgacattttgtactacttcaaccaaaaaagaaagaggcaaaactgtaaaattcctcagttttaaataactgagcccacagcttacaagtagataaaactataggtaacagtgtaaaattacaggagattttccttgggagattaaaaaaaaaaagcataggagaggtcacaggtaaacagagataatatcttctaaaacatgccttactggtgaatttataacagctgtgagatctgttggctagaattgtacctcttctgcagagtgaacgaatatgatcctactcacacagtgaagttttcatagtacaatcaacctcagaagatacagtacaaaatgtttactttataaaagttacttacaaaaattgcttcaaaatttagtaactcaaagttgttaaccatcaactggttaactgaaaaagagttatgctaaagaaaatggaaaaataaaattgggtgaaaattttcatagcagaaattatgtttcataagtttaagggacaacagcagttatgttccaaaaatcaggttgagaaaaatgaatgatattttagtattttctttgcctgacagaagtcaaaacaatctgatcaagcatatttattttccagtaacacaaaaacaaaacaaaacaaaactcaatgttgatagaaacaactttcaaaacaggacagactgtagaactagaaaaagtcgaggtgtttctataatctatactacactgacataaaattcaaaggtgttaaaagtaattatcagactattttaccattattagtaataacaaaaaaggcaaattgtaaaaatatttttattttattttacgtttaagctctgttagatttgatgtaaacataaaaatattttttaagggccaggcacagtggctcgtgcctgtaatcccagcactttgggaggccgaggcgggcggatcatgaggtcaggagatcgagaccatcctggctaacatggcaaaactccgtctctactaaaaatacaaaaaaaaaaaaaaaattagctgggcatggtggcgggcgcctgtagtcccagctactctggaggctgaggcaggagaatagcatgaacccaggaggcagagcttgcagtgagccgagatcacaccaccgcactccagcctgggcgacaaagcgagactccatctcaaaaaaaacaaaaaaactctctctatatatatatatgtatgtaaataaaacattcaaaaactgaaactatagtaaaaatctaatccaatgacataattgggtaattcaactagatttgcaagtatcagataatgacagtatattatgacattagaaaacaatattaaattctagaccaagatacaatccagagcatacactactgtgggaagagggtagaaactgcctcataaggggaaggaaaaaaaacaccatactatatcccgctttatacaaactaaatattagttgaaatcttatcaatcatcaaaagttactagaatgaaccacagcagctaaaaaagtttcatttagtctctataaagatcacaaatctttaatgtggtttcaaagtaaagacatatcactttaaaggaaattaaatcgtggtagtacctaattgaaacagcaataaaaaattataaacagtgtttggttcaatgaggtacttcaggtcacacttttaaaagaatccaaagactaagaacaacatttgataaataaaagatggtgcatcaaggaaggaaaatatgaaataatatatggtgattttaaattggaaaatctatatttttatcaatataaaatgtaataattcttttgatataatagcaattaatttttagtgattttaaaaacagaattacttcacagtaattataaatttaagaaccagtggagagcatcacataaacaataatttgctgcaacacaaaatcaattaaatattaattgttctccaagtaaggaactacacaccaattctacatactggtgttagcattataagataatctttgatttaatttttcttagactcattctcagctgaaatgtgaacatacggaggagaagctggtaaaatttcctatgtctatttgatttactgagcacgaaaaaactgaaagctaagagaagtggagctgagaaagatctagaaaatgtagagctttgagaaaaacttttttaacaatatatatccaagcatgattcaataataagtaaatgtatcacaatgtataagaagtttgagaaaaacataaagtttcattatatattgctacattaatatacaaatatagagtaatcctcaaccaataattcaatttttaaaacatttcttaataaacaaaattgaataggttccaaaatttccttatttgctagttatgtagaacttagaaaacaggcacaaccatcccaccacactgcctcaagtggactaacactaattttttatttttccctccactgtcactggaaatgagttagttctgcccccaacatctctactacccccaacatgcctccactcccagctcagtctccttcaaaaaattcaatggtaatggtttccagttaggacgacaggctatttattatcgtacttattatacttaaaacattggtcatctatcatctcctttctttttactttttgagggttccaggtattaactctacagtttctttttctggtctgtcctctgttgcctgattcgcactactctcctcccttgacctattgctttgctggtctgagagcttctctccaatcctagactccctaaggcaaactttgaagatttcgccgggcgcggtggctcacgcctgtaatcccagcactttgggaggccgaggcgggcggatcacgaagtcaggagatcgagaccatgctggctaacatggtgaaaccctgtctctactaaaaatacaaaaacaaaattagccgggcgtggtggcaggcgcctgtagtcccagctactcgggaggctgaggcgggagaatggcgtgaacccgggaggcggagcttgcagtgagccgagattgcgccactgcactccagcctgggtgacagagtgagactccgcctcaaaaaaaaaaaaaaaaaaaaaaaaactttgaagatttcaagggttggacttgctatgaaagacaatcaagtgaagactaatgatccacctcctcacctccctcaccctacgcccatattctttccacagagacaaaattgcttttaccagtgacatcaagaactattcaagattcacctacatagtaattatcccaggaatttcacttgcagctactactgtactgagtctcccaatttagcgaagaaatgaaattaagtaaaaatgtggccaagcgcagtgactcacgcctgtaatcccagcactttgggaggccaaggcaggcggatcacgaggtcaagagattgagaccatcctggccaacagatcgagaccatcctggccaacatggtgaaaccccgtctctactaaaaatacaaaaattagctgggtgtggcggtgcacgcctgtaatcccagctactcgggaagctgaggcaggagaatcgcttgaacccgggaggtggaggttgcagtgagccgagatcgcgccactgcactccaacctggcaacagagggagactccgtctcaaaaaaaaaaaaaaaaaagatgtactctactttttctcagactccaagagtaccatactttgtcctaaagtaatacagcatctgagtatgcggtctgggttacagcaaggtcctggactgaacatttaaaacaagaataatgacaacaataatacacacacacatattcttaataaaatgttctttaatgtgatatatatatgtgtgtgtgtaaaacgtctggtgaaaaaagaaaaaagcagaaactgaagatttctaactgaaaaaattcttctgatcatccatgtaaaaacttccacaagtagtcaacaataaaatgttacttaaatattactaatgagacattcatgaatttgaataaacaaaatgcttcatgcttgtaaagaacacaatatataactttaaaaatcccatttatctaaaaatatacacactatctacaatacagcagaaaaacatttcctttttcatatattaaaactaaatgttaccaactaatgtgacaattagaattttcaatcctatttaaaactttgggcccgtaaaggaaaatgaacaccacaacagttaaaatgtagattttcggggcgggaaactttttcaaattatgtatgaacaggctgaacatgacaagtaaatgcttcaaagtatatgagaaaaattagaaaccataagataaaaatgtaaatactaaagtctttcctatcatagagaatagaaatcaaggtcataccaataacttactaatttactcttctatgaaggttttcctccatttttgttttcaaattattatttggtttaagttgccatcacacttccacccacatcatcaagtctttctcaaacacgagcattatcaaagacagagtggcactagtgaaagcctatttcgttattttcctatttctcctctccatttgcagagcaaatgaatatctgaagtctttataatctcttttcaattaaaaaagaaaatggaaaaagaaaaagaaaatccgggacacaaagtttgagtctattaataaagacacaacaaaagagggtcttaaatgggaactgctcccttgccccgagaaacttagaataacactgtactcagaaggttcacattataattatggctgagaaaggagaagcatacaaaagggtctctttttgaataatgactccagaagctcaattaataaaatcttgtcaataaacacatatgcgttctagtatcttcacttcaatccataattaattatcttttccaggtctcatctactggaagcataagtgaaagcataacactttaatccggatgagtagcggcataatattagggaaatttcaaacaattaggcaattaaaactacatgaatgtactaactagtaggataaatccctatactctgaatttctaagattaaaaaggtgatactaaaaataaggtatcttcacatttatacttcatatttttagaaagaaaaattaactttatttgatgcatagtttgagagaattttttaaaaagaactttctaaaacaaactttcagattgcttccgtaaatttaatgctaaaacaattccaaactaaattccaaatacaactgacagaactaagctgactacataggaattagcaaagcaacactgcagtactatgcagaaaaaacaatttgttaaaaagactgtgcacagaaaacatcccatgctggtagctactctaaagtgaagtaaaaagaactgcatcatacaaaaatacaaaaaaaaaagaataaaagactctttctatatcaacagcagttaatgcttcaactactactaacagctggagaaatagctccacctctatatgagatggagttgggagagatgaggaggtgaggaagactatcatccactgaaaaccaactctctaagtaaatttaagttaaacaatgtgtttcctctatgtaaatgccaatgcatattataaatactgatgatattacaattttaataatttgtaaagatgttaagataccatccacttgctggatttttagtatgttaaattcatattacaaatatgaaaatcacataagcttgcaaatctcaaaatatgcaatgttcatttagaatgaccagtaatcaggaagccagtaagaggcatacatttgataaaactgaatcctaccagatgcacagagtgaaagccttagtttcagagtgcaactatttttaaagccgcaattgttacaagcttgcatcaactttgctagtctctagttgaaactgtcatctgttataatctaaatagttcattaagaaaataaaaattatttgaaaatctatagattgtattcacaaaacgctccaatatattgtactaaagccagtaatttcaaatgttacagaactagaccccgctaactggcaccatatacccatagactgaactgcataagtatttattctccaacggtatcgcggacttcgaaaacttgaggtgtaaagatgttttccaaatttttaaaactactttaaaaatccaaaaatcttaagagacttcatactcccataattttcaaagtagttcgaattacctgaaagccccatagtataaccaaataccttaagactacccttcacaaacaacatcttaccaacataattcaagtattatcaactctaaataattttcaaaccacataaattgcgttagcctattacagagagataatgccgccaaacagactctcttctttctattccactttcccccgtttctgacagttgccaaaactacctacctaaggcttgtgaagataaagtagcactcaattcccaggacctaaatcgttatcactgctgagggaaaaaaaaaaaaacaagaccaatcacaagtaagatgtttttctctaacagatctggaatgagtatagaggaagattctaaatttaagcccaaattgctgcacccttccatcgcacacaaatacgaacaccatacaagggttcccgtgcttacatcaaatggtaacgaggggtacagcctattgtctgagtctacttatcgcccttagacaaatgccagaatcataatcagagtgagaaattacgcctgagcacagggggctattgcagagttaagggtgggatgctcaaggaaagctcaaaatcccagtgactcaagcaaagacgggggggggtaacccgggcctccgcattacgggtccgctcaatgccttccccagatacccacaccaattcacagaacgcttacttcctccccaagctcccttcgcaagtgcagtccggaggcaccaccgccgccgccgctccgaggagcgggggaggcgactctgtccccgcgcctggacccaggaggacgacgacgaggagaaagcgatgcgcgcgcggctcccgggaaccggctcttggctagcgaggagcccccgggatggctgagaagcagaaccaacccgcccgccgcctctccagggtcaagcgaaactgggtcgcaggaagaaaaataacgaagagattgtagattaagaaaaggcaacaaaaacactaccaggccgctaggaggaccgcctcaaaatgccgccggaagtcagaggtttgccctgttcctctgtagacccaggcagcttccggccgtcagattagtcgtcagtgcgcagacaccacccttcgtggacacgccctctaggcgtaaggttccatgcgagcggtaagagtgcggcgggacttggaaatcgaatctgtgctctgtgagagatcctaggaaaggaaactgggagcccgggagaactaaaattcccaattaaaagtgaatttaagtgagttttctctttttattacataattccttaccataaacagctgttgtaaatgcgcaaaatgcggcatttgttgacagtacctagagccactcattcattcgttcaacagtgtttattgagcagctgagctggaatgagaggctatgtttgtcgtttttgacacccctcccctttctgggccatcgcctaattaccgtggagcaaacggaatgcatggttgtatttctaaaggcacaagcagaaatttattgaaaatttggagcagaaatctttaatgtacttctgaccacccttccttttgttgagtaggatccaatgatcagcgtgagatgatcattgattaaacttgcttgagatggctagtcaaacgtcgaaacttgcttgagatggctagtcaaacgtcgaaaatcaaagaaaaagtaggtaactagacttttacaattttttttaaagggtaaaaagacatgaaccctagtctgccttaatggcaaagtagcacttattaggttctctgacagaaccaaggaataggaaaatcttttatcaaaactacggataaaacttaaaaataatttgatacaatgatttggtcttgctggaatcagtaaattaaaatacggaagcagaatgataaaatcaggggcattaaacattcctaatgacatgccaagctattttagagacagcggcaaaagcttctctacaggtgggtttgatgtaacgctccggcagcaagaatccgtatgtgcccgtatctcgaagttcaattgtaaacgaatatttgatgcccaaatcatagatccaatcgtccccacctccaggagctaggtctaaaagaagaagaaagaaattgttgaaatacagacgtttcaaattaatttacaaactgggaattgtttgatttaaatgtttatttgtttgtatacctttagatttttttcagtttttaactaatataaacaactttacaatgagtacccttgtttatacataattgcttctttgtctctttagaatattcttccctagaatagatttgctagtctaaggctctgtactttttgcaattacggcatgttcccaaatggacgtcaaaagaactgaattcatttatacttccacaagcagggtatgaatttgcccatttccccttcccataccatcaataggaattatgaattctgataattttatgggcgaaaaataatatccaactgtcttaatttatgttttttgattatcagtgagttgcacatttgtttggcatatttattggctatctttatatttcctatcaattgtccttcctcatttgtctacttggttcattttatcaattgcttataaaaacgacattagtgttattagctttgtttggcatgtagacctttttttctcctttcattcatttctcctttcacaagaattttttctccttactgagatttcaacttggtttatgcagggttttcatatgaaaatatatgctgtacctggaatttactttggtgaaagacatgttaataatccaattaatttttttctaggtaacttgttaggttttccaaccgcattaattgaataatctgactttttttgggggggtgctaaattgagtccaggtttatggcaaagtctgacccaaaattttaatttataattttagcatctatctaatacagtttgggaagcatctcatgaaagctacaattgccagaagacttgttacagtttaatgcatgttaactaaaatgtgtacatattttagtgttcatgataaatacagtttcgaccttttttgagatggagtctcactctgtcacccaggctagagtgcagttgcacaatctcagctcattgccacccccacctcccaggttcaagtaattcttatgcattagccaaccaagtagctggcattacaggcgcctgccaccatgcccagctaatttttgtatttttagtagagacagggtttcaccatgttggccagtctggtctcgaactcctgacctcaagtgatcctcctgcctcagcctcccaaagtgctggtattacaggcatgagccacagcacctggcctctttttgtttttttctaatcattaaaaaaaaaaaaaaaaggaaaaacctggatttggccttcaggctgtagttttctgatgcctggttacaggtttattttatgctcctcttttcccatctcccttcaaacttcaaaagggcaaaatcagtctgtcctcccactgtgtgtagataggagttactcactaaatatctttcagcaaaaattaatcaaaactttttgttaagagtttgtcacaagttttgtgtgtgtaatatatattaaagacaatcaactgtaatgtgttatgagctatactcttgggaacaggctaacactaaaaaacacttgatgcaaatggcatgccctagattagtgtagtgtacaacctgcacaaccttccatggtggccctgggaatcatgcaaaagttttatgaacttttctgcttcactcaactagtatgatgccaattctgtaattcctacttgattgtgataaatatgatttcttaaataggattttggcttctttttagtaactcatttattaatatagctttgttcagcattgtcatagctattatgcttctgttcctaattattacaattcagttgtattacatgtgaccctatttaattcagaaaaattaaatacacaaagaaaaacagatcacacagatttctttagtagctcaaagttctctaagatcataagaagaaatacttacataaggtttctgagccatggccatgtgtatacctggtatttttactaattttctcaatagcacgaactgcttcactggctactagagactggaagcaacaagatatagaatttcagttaatgtgcagctttgaaacatgacaagtagaagtttctaaaaaataatcatacattaattgaatcaaagtatacaggtagaaaatctagattcatctaaaaggcaaataaataaggtaaacaaattaatttaaaatatgtgcactttatggcaatcacaattgggtggctttaaacataaactatttcaatatattgaaataatttatataaataaatatattaatttgcagaaaaaaattatcacatgcctttttgggaactcatttattatggaaaatgaagtataactacatctcaaaggcttagaggtactccatttctgaacaaaattatcaccaaactttaaatccaacctttctaaacacatacaaacacctaatgcatgcatgactcacttcttatccttctcacaacttctattttcttcttgtgtaaaatgtctaatgacttccatagattcatcaaatcaaaaaagattatgcctctggtatggagcaggataataactaagacccccatttgacttcattttgtctgttgatattcattttgtcaaatctattctgaagttctcacttatctggaacttttcggaaattggaactagcatcatggtatacactgtcaccttcttgaaaaactcaagagatttatcagcggatattattttatgccatctcattgttcaaaaaataagttttaatgtaaccccattgtctacataatgaaatacaaatttatctgacagtcacaccccttcagaagccaacctaatctactttctgatgctatcaccctccacttttgcatcctcttatggtgaacaccaacttctttgcttggaaggtccttccttccctgtctgcctatagaaatcctctttcaatgcctgtctaaaatgtagctgatctttgacatcaacagcactttattatttgtagtttttcccccccttaatagattgtaaattcctcaaggacagtaactactttatctcctcacttatctcagcatttccctctgaatgcattagtgaagccatcccttgatattctagttagaagtgagttgtactgtctgtgccacgtatttagtagttactctatgtcgccttagagtacaactatttgtaacatttgctaatggttgagctccctaaccataacacattctcttaaagggcaggattttacctaatgcttctttaaacatccattgacaaggtattttacacgtaatggctctcaacatatatgtgtgctggcagtgatgcaaaaaaaaaaaagcataattagactaattctacttcccaaatcatgataaatttccttttatttcttcaaagataatatttttgaaaggtgctttccttaacagttttcccttgagaagaaaaaagctcaagtatcaagtacatttatgttctaaatgggctattttcagagaatgcaaataatcttatatttgtcatcagcaattgctagctcctgtaatgtgactatattttattctgttaagagagccagaaaaaaaaatgagtcactaagaaacaagctactacctaaaaattagtcccttcccaagaatggggctgttgatgtaacacttccactgtctggagagcatctgggatgaggatttgtcgaagcctagctacaatccttcaagaatccttgcatcttttgccatgaacccaaacatacagtatcttggactaaaaagtgctaagggagtatcaaattgtgtgagtcctctttgaatttcctgtattgtctgttatgttccaaaaaacagactctctcctcaatgctaaaattggaggtactttaataggaccaaaaccctgagggttagggaagtcagggcaggaacaattcctgctgctaataccaaaacaatgagtgctgtgttgagacttaatctgtggtgtgctgttgtaggaagctagtgaccacaaagctgtcgcatgattccatactcatccttgcttataccgcttcacatgcagatcaggtcaagtgtagtagtagttccttcctaaccttcaaggaatttgtctgacattttcttaggaagcccacgtgctgaataaagtgtgtgttgttagggtaaggcacgttctttatattcccttagagaacactgacccagggtgactctcaacaggatcacaccatgatttaaaacatctatcatttgccttctagaggacaaaatttttcccagtttttgattcttcaactaagtattattttatttccaaaatgctaatgagaaaaataattaagtagcacttaccagttcctcatggtctttgcttttacttcgtgtataggaatatggaaacactatatgctgggagtatgaatgcatgctgatgtatgctttaatctggttgatatttcttctcaagaaactagccactgccttcacttctggttctgactcaggataaagtccacagtaggtttccgagcatgaggaactggatgcaccttcctctgtaacgaaattgttaaggtgaaattatgaggggatgcacatagtactgtaatttgtggtttcccagacaacgtattctcctacctatgttgcaacacttttagatgaatggattaggtagggctctgcaaagaacatagttccactaagtgttatgtttcttttgaagtcaaatacttatctgctcacatagctgaccttctaacagtcattcccagcacctgtctcccttgcaaccttgagaaagtggctaagagatcctcagagatgccagccctgtctccagacttatggttatgggagaaaaaataaaccccactttccttaatccactgtaaatttagtttttctgatatttgtagttttaaagctaccatcaatatagcccataaaagaaaagcctcacttcagagctcagaatatgtaaatctgccttcagtgctacttttaacttgctaaagtggtttagtaagtttagtaaataaaatgggatggtgatatttgttgccagaccaacgttcattcattcctttgatagattataatttgcatcacttgagatggtaggctgccttccaacacttctccccctgtccctaattcacaaggtgaagccccagcaagctgcatctgacacaagagattattccttcctgcaaacagttgagggctcaggattgggtctgactcttgtgcttgccaatctgaatcccttcaaagataacttgaaatcaatactaagagtctagtctcagtctagctgctctcttgaacagacagtaaaaatagtaatactaccagctgacacctgtggagcacatgctgtacgtcaggaactctgctaagatttttgccacatctcatgtaattcttacaccagccctatgaagtaaatactgtcattttaggagatgcaatctggatattcttggtggtaaccactcttcagaataagaggctatacagcatattgttaagcacccaattacttgattctaaatcttgactaccatttattagctatatggctttgggtaaatttttaaaaatctatctgtatctcaatttccttatctgcaaaattgaaaaattatacattaaatgctgattgaatgagaattaaatgagctagttcatacaaagtgctttgcacagtgcctggcatgtagtatgcatttcataactgttgctgtttatcatcatcatcatcatcatcatcatcatcatcatcatcatcatgtggactgagacctgaaagaagccagtgtgcatcacagagatgagaaggggagaggaaggattcactgagcctctctagggctccaggcccagttcctttctgtttctgagtccagctgcatctctgcctcaggagtccatggctgaggctactcactatccttacagagcctgcttttcttaattaagctcattctgctttattcctgttattatacaaacacaacattaatgtttgttaaaaaattgtttccctgagaggaaatgtgaacatctaaggtcttcccaagtatttcatttttaaccaataaggtgattggataaaccatttttgatagttcggtcacctttgaatattcctgcccttttatgtgatatataattcttagagaatagagattatatattgggtatggaggtcggggaagacataaccactaaatagagaggtggtgccctaatatgaatcctcagaccagggttgtttaatagaaatataatgcaagtcacatatttactttaaattttcaagttaccactttaagaaaaataaaaagaaggccaggcacggtggctcacacctataatcccagcactttgggaggctgaggcaggcggatcacttgagatcaggagttcgacaccagcgaggccaacatggtgaaaccccgtctctaccaaaaatacaaaaatagccaggcatagtggtgcacgcctgtaatcccagctacttgggaggctgaggcacgaaacttgcttgaacccaggaggcagaggttgcagtgagctgagatcatgacactgcactccagcctggatgacagaacaagaccctgccacacacacacacacacaaaaagaaatatgtgagattaattcaatattgtaatttatttaaccaaatatgtacaaagtatcatttcaagtgtaaccaatataaaaattattcttgaaatattttatgttacttttttcatactaagccttcaaattctggtgtgtatttaacactcagtgtatgtctcaattcagacaagctacattttaagcactggatagccacatgtggttagtggctactatgctggacagtgagcctcagattctcattctatgattgtcattctagagatttcaagcattttagtggaaagagccctgaagaggcaggaaacttgaggtcgagactctgctttaccattaagcagtcatgttaatttgggcaactacttcatcgtctcagcctcaggggcctcatctgtaccaggaaggaacttgggccactggatccctccaagctcaagcattctttgatctatagacatggaaccaagcacactgtgaaatatctataataggcaaattcatagagacagaaagtagataagaaattaccaagggctggggagaaggtagggatgaggagatattgcctactggttacaataagtaaaaatctctctttgggacaattaaaaaattttagtaatagatagtagtaattgtgaatgtacttaatgccactgaactgtacaattaaaaattgttaaaatggcaaattttatattgcatgtattttatcataataaaaaataattttaaaaaacactatagtctcctagaaaaagaaataaagaattttccattcaagccagttgcaaaaactttgtagttgaactcagtgttttagaaaatgtgtggtgctatcttaggaagtttgagaccaaaggttctcataatgtactcctgttatgaactgaattgcatcctcccaaattcctatgttgaagccctaagccccaatgtgactgtatttaaagataaggcctttaaggagacaaagtgaaatgaagtcataggcatggggctctaatccaatgtgactggtgcccttataggaataaagagagacaccagggaggtttgtgcagaaagagaaggccatgtgagggcacagagagaaggcagccatctacaagccaatgagagaatcctcaggaagacctcactctgctggtaccttgattttggactcccaatcctcaactgtgagaaaataaatttctgttgtttaagccacccaacctatggtatttggttatagcagcctgagaagacaaagacacccctacaacctaccctccactctcatctccaacacacacacacacaaaattttaatacagaggagcataaaatgagtaagtaggtttgatatgtcacttcctgttaataagtgaggtgtttttggatcctttatataaagaatcataggggcacattctagttgtagggatgagaaaagattaaattcttctttctcactgtcttgcttacatagtacagaatagatactggaacagttggtaataaggacagttccttacaattactttttatttggtttttttttttttttttttagttaaaaacccatatgcttgctgcttctgtttctgtttttcactcttatgatacataacaatatagcaccatgcccaagaggggactgagacatttcttgatgacaataacagaatatattttgactacttggctatccaaattaaataacactgacttcaccaagaaaaatattaagtaaaatcaagcaccaaaagagcttgaagataaaataaaaacttccaaaagggaactgataacttgggtttatagcccagctctgccacgtacttgcacatacttgctacgtgcccttgaggaagggacttaactgttttcagcccgggtttctccatctatgattcatagataatgaaatctggaagatgaactatgtcaatggctcagcgctgagtaactgtcagctctatttacttagattctttttacatggctgctgttcctgtgagcccctggcatgttattagtgccacagcaaactttgggcctctgggaacacgagtggttttttagggagaaaccactaaatgattccctggaacctaagtcgggatgaactgcttcttcctctgagttcctaccatatctgtagctctcagagcaactaaattcattcatggactcatttagttaatattttatgaggaccctccttgtgccaggcactgcactagataatgggtattggtttctgtctgcatggagtttctaacc

SEQ ID NO: 1344 - DNA, 33055 bp, Homo sapiens
ccctcccggacggggcggctggccgggcggggggctgacctccccacctccctcccggacggggtggctggccgggcagaggggctcctcacttcccagtaggggcatccgggcagaggcgcccctcacctcccggacggggcggctggccgggcgggggctgacccccccacctcacctcctggacggggcggctggccaggcggggggctgacccccccacctccctcccggacgggcggctggccgggcggggggatgaccccccccacctccctcccggatgggacggctggccgggcggggggctgacccccacctccctcccagacggggtggctgccgggcggagacgctcctcacttcccagacggagtggctgccgggcggaggggctcctcacttctcagacggggcggttgccaggcagagggtctcctcacttctcagatggggcggccgggcagagacgctcctcacatcccacacggggcagcagggcagaggcgctccccacatctcagacgatgggcggcctggcagagacgctcctcacttcctagatgggatggcggccgggcagagacgctcctcactttccagactgggcagccaggcagagaggctcctcacatcccagacgatgggcggccaggcagagacgctcctcacttcccagacggggtggcggccgggcagaggctgcaatcttggcactttggggggccaaggcaggcagctgggaggtggaggttgtagcgagccgagatcacgccactgcactccagcctggtcaccattgagcactgagtgaacgcgactccgtctgccatcctggcaccttgggaggccgaggctggcggatcactcgcggtttggagctggagaccagcccggccaacacagcgaaaccctgtctccaccaaaaaaatacgaaaaccagtcaggtgtggcagtgcgcgcctgcaatcgcaggcactcggcaggctgaggcaggagagtcaggcagggaggttgcagtgagccgagatggcagcagtacagtccagctttggctcggcatcagagggagaccgtggaaagagagggagagggaggccgtggggagagggagaccgtggggagagggagagggagagagaattacagtttttaaaaagtagactgtagttctccttctaaagatattttacctccttgagtcaatccattcctaggtatattattttttgtttgtggctattttaaatagagctctgttcttgattttgttctctgcttaaatgttattcaagtgttgaatgttattcaaggtgtatagaaatgccagtcatttgtgtacattgatttggtatcctgacactttgctgaatcattttttaggcttgggagtctttgggagaaatctttaacgtttttcaagtagagaattatatcatcagtgaagataatttgacttcctcttttcttatttggatgcctttttcttttttcatcttgttggattgctctggctaggacttccagaactatgttgaataggaatatttagagtggacattgatcttatttttatttgtaagaatgcatcaagctttttcctgttcagtataatgttgcctgaggataatgttgcctgaggatggctcttattattgtgaggtatttttttcaatgccttgtatgtcgcatgttgagaatacttttatgaacattaaatttcctttaatgatttttccacatctagtgtaataattatatggtttaatcattttaattatctttatatggtgagtcacacttattgacttgcatatgataaaacatccttgcattcatgaaatgaaactcacatgattgtggcaaaataactttttgatttgtttatgaactcagcttactagtatttcatgaaagatttttgtttcaatgttcatcaggcatactgaactatagatttttttgttgtcttaactaaattttggtatccagatgatgctgatttcatataacaacttaggaaggattagcacaagctcaactttggatatgtggtagaatttagctgtgaattcatctgatccagggccttttatactatgtagggtatttttaattacaaatttaattttgttataaatttttcctctgttcaagacttctctttcttcttggttcagtctcgggagattgtgtatatgaagtttatctattttttaaaaaattttctagtttgcatgcatagagatatttatagtagtatctgaggatgttctgtatttatatggattagttgtgatttcacaaatctaacattcaaataaatacagaataaaagtttcaaaaaaattcaacattccctcacaataaatctctgaaaaaaataggtacaggacaaatgcatctcaagccaataaatgccatgtataataaaaaaatgcaaagctaacaacatactaaacaggaaagtgttgtaagcttttactctaagaactagaacaagacaaggatgcccacttccttcagacttactgaatgtagtactaaatattcaagacagagaaattagagaataaaataaaaggaatccagattgaaaaaaccaaaaagttaaattatccctctttgcacataacataatctacagtatagaaaagactaacacttcactaagaaccactagaataaacaaatttattaaacttgcagaatttaaaatcaacattaaatagtatcagctttatacattaaaaattaactacctcaaaatgaaatttaaaaacaatcccatctacaataactgtagtaactatactttgaaatcaatttaatcaaaatgttaaaacaccatatattataatctaaagaacattaaagtaaaaattaaataataaacaaatggaaaaatagtacttattcacaaatttgccttattaatacactaaatatctttattacacaaaatgatctacagatatagtgcaaactctatcaaaataccaatgacatacttaatagaaattttttaaaaatatctaaaatttggcagggcatggtggctcatgcctataatcccagcactttgggagactgaggtgggtggatcacctgaggttgggagttcgagaccagcctgaccaacatggagaaaccccatctctagtaaaaatacaaaattagccaggcatggtggcacatgcctgtaatcctggctactcgggagactgaggcaggagaactacttgaacctgggaggcagatgttgcggtgaggtgagatcatgacattgcactccagcctgggcaacaagagtgaaactgtctcaataaataaataaataaataaataaataaataaataaacaaacaaacaaacctaaaatttatatggtaccacaaaagaccctgaatagctaaagcaaccaaacagaaaaaaaataaaaaaataaaaataggctgaaggtatcactatacctgactttgaaatatactacaaagtatagtaaccaaaacagtatagtacttgaataaaaacagacacataggccaatggagcagaaaagagatcagaaatatatccacgtatttaagctaacttattttataatttcttttaaaaaggacagtctcttcaacaaatggggttgagaaaactttatatccacatgcagagaaataaaatgagatcctcttctcacaccacatataaaaatcaactaaaattagatacttaaatgtaaggcttaaaactcagaaattaccataaaaatatagattgaaagcccataacattgatctaggctgtgacttttattatttaacctcaaaatccaaggaaatcaaaagaaaaatagatacgttagattacttgaaattaaaaagctgcttcatggaatctgatacaatcaacaaaatgagacaactgaaaaaaatgggagaaaatatttgcaaatcatacgtgggacaaagggttaataacagaaacatataaacaacttaaatgactatacaacagaagacaaataactattaaaaatgagcaaaaggcttaaatatttttcaagaaaagacaaatggtcaagatatataaaaaatgctcaatatcaactataatcaggaaagcaaaaagaaaaaccaggagattatcaactcactcctgttagaattactcttactaaaaagaaaagaaagtgttagtcaaagtatgaagaaaaggaatgcttgcacactgttggtttgaatgtgaatgaggagagtcactatgaaaaacaaaaatttgtcaaaaaatttaaaattaaaccacaatacagcaattttactgtatatatccaaaacaagtgaaatcagaatgaagaaacatttatgcttctatgttgtttgcaacactcttcacaattaccaaaatacacaatcaacagttcaacatttatgagtaaataaagacaatgtggtacatatacacaatggaatactcttcgtctttaaaaaagaaatttctattattttcaatcacatgaattaacctggaggacatcatatttgtctacatgagccagacacaaagattatttttcatgattttacttacacagggattctaagaaacttaatcccattaaagtagagagtaaagtggtgaccaccagacaccaaggtatttagaaaaaaggggggttttggaagatgttggtcaaagaatacataattatagtttaataggaggaataagtttaagagatctttttgtacagcatagtgactacagatcataataatgtagttgtgtttttgaaaaacattgacaatgtcacatactctgaccacaaaaatgttaacgatgtgaggtaaagccttaattacctagaattaagcatttgacaacatatacttccaaacatcatgttttgcagaataaagtacacatttatttattacagatggtaatggcatgaaagacactaaaagggcagctgttgcttatggtctcatgactggccaccctgtgaacacaataaatgaatttgcataaaaataacagaaaatgtttaatcaaaaagctgccataatcttcaaaagttttctagagaaaatgaccaagaagctgactatagttaggtgacaaaaagcaataactgtacactcaccttcacccactaaaaaaataatgagtgaaaaattcctcggaattgtaatatcaatataaaaaagaaatatcattccaaatatcaaatccacagaagtcattttattattttgcaacctttaaatttcacatttaaaaataaaagattctgcatggaaatgtatgttatgctatatcatagaaaattaaatttaaaattcttcacttaccatttgctctcttataacttaatttctaagatgtattttctagcaaattttatatttgccacaatatatttgcactccagcctgggcaataagagtgaaactctgtttaataactccgtttaaaaatttaataagtttttccttttacaaacagaaaaaaataatgctaactgatttaatcctctcacctgtggacaatgtatgccttttatcttaattaactgatcagaaagttatattgataagtactctccaataaaaagcaatttttgagtgcattaaaaataccaactttctcatcaaaacctacaaagtactgtataaaatgacatggcatgaagacaacagtgagcaaagtgtagccatcacatagaaaaagaaggagaagggctgtgatgaatacacagaagtcacataataagacaaacaaaactaaaggtaattaggaaataaaagaaccaaaatttctttttaaattcagcaaaatttagctttgcagcatggaaaaaaaatgttatctgcacatgaagaatcaatgttatttcttcactattggtattttccatctctgacttgaagttacaaactaactccagcaggaatgtttacaggttattatggaacatctgttacacagcaagcactgtcatatttgtttgccacatatatatataaaaacatcctcatgacttatgaagcattcctagttcttacctgaacaaattggctcaataaataaataaatttacttatgtcaattataacaagagaaaagaataagaaatataggcttatataggattctccaattaaaagaacaaatggaatgttctaactaaatataattaatacacaattttggaaatacatctaaaacttatcttgtgtgcagtactgaattttataaaaatcattcttataatccatgaacagctcacataatacctcataaagtataaaagaaaaaaatggtaagaaacaagaaaattataggtctagcatgactaacaggcaagtaaaaacataatttgcatggagagattctgaatcataagtcagaagatttggcagtaatgaattcaatacaaagcagagtatacatttactttcagcatttttgaagttttcagttgtctagtacattactttattaaaatatttgttttgctccaatattgctcttttcttttgaaaataggtacaaactcacactcacacaaaaacagtccataactttcttgcacttaacatttatttttagagtaatatatgggtatagttaactctatgtaaaccaatactaaaattctgttatgtttgcaggcagagagacatgttcaaagaaaaatacataacaaaatttttaaaatgtttaagcaggactcagaattttaagactcaggattttatttatacttgtatataatttttattatacccatgaaaatgaccctatagtcaatagcaatttacttgtacattttaaagtaactaaaagtgtagaatcggtttgtaatacaaatgataaatgctggagttgatggatatttcatttgccctgatgtgattaatacctattcatatgcctgtatcaaaatatgccatatatggcataaatatatacacacactatgtacccacaaaagttaagaaaaatatgtttaaataagaaaaagaataaaaatttaacctatgggaacaatgttctttaattaagttctttagtttaaagtcactggcaagagaaattattagagatgttagtccactctgttattaaatagtacattgttactatcttttaccaacacccttgagtaaggtgggataggttgaagttagtggcatgataatacttcactgaatgcacaattggtcttaacatgttaaaaaaaaagtttaattaaaaaattaagttcacaataatctaaaattttttaaatgtgctgcattttattacataaaagtacagttagtaaaatgatatactactaattttaatttaattttaactaaaataaaagatattttcactagaatgcagaatattcctctgaacacttccctcatacatcattcaatattataaattaaacacaaagagcctctccacttagatttttatcatgcatcctacattgtaatgtctttactcttccatagaaaaggtaaaaaatattgcccacctaacaaaaaagaatgtctcatatctttgatgaagcagcaattgatcacatgctttcacatgtgaatacaatagaatgaaaagcatgaagtaatttgagttgaattacatcattcactttttaaaaattttgtaattttttcaaagaaaaaagtatactttaaatgtaattataactaaaaatatttctacctcttttaaagttatatataaataatttatctaccaactttaattttggattattttctgtactcagcacactgattagttcaatgtctaaaatgtcagtgccttagatatttctactgtgaattctctgatatttacacacacttaattttggattaaatttcttttatacttactgcatctgcaaaaatatattttagtataaatcccctggtgttttctaagcagtagtttttgaaaaatgtttttccaaatatattacatttgcagtttttctccaatataaactccctgatgttgatcaaagtttgagcactgcttcaggattttcctttagtacataatgtgtacaataaaatctgtgatacaaataaagacactacaaccctctttatgtacctaatgtttgtcttcaaaatgaaaaccttcttctctttaaaggcttatatttgtcaggcacagtgactcacacctataatcccagcactttgggaggcagaggcatgtggatcacttgaggtcaggagttcaagatcagcctggccaacatggtgatagccagtctctactaaaaataaaaaaattagccaaatgtggtggtgtgtgcctgtagtctcagctactctggaggctaaggcaggagaattgcttgaacctgggaggcagaggttgcagtgagccaagatcacaccactgcactccagcctgggtgacagagcaagactccatctaaaaaaaaaaaaaaaactttcattttctgattttacactaattgcttttataatgcttttattaagcactaactctctaatgttgagtaagatgtaagcagatattaatggcttttccacatttatatttgtacaatttttctgaagtgctttcctgtgctataaggtgtgaaaaattaaaagttttgccacattcttcacacttctgggagtttcctccagtataaattatcttacctacaatcaagtgtgacaaccatttaaaggctttgtaccattcttcatatttttaagatttctcaccagtatgatttattttatgtttagaaaagtttgaaggtgttgtcaaaatcattgtcacatctttcaggtttgtaaagtttccagtattaattttcttatgtttagtaaagtttgagatttagttacaagcattgccacattcttcacatttgcagggtttctctcaaatatgaattgtcttatgtggagtaagggttgatgataggttagctttgccacattcttcacatttgtagggtttctctccagtacgatttttcttatgtgcagtaaggtttgaggataagttaaaagctttgccacattcttcacatttgtagagtttctctccagtatgaattatattatgtatagcaaggtgtgagaactgtttaaaagctttaccacattctttacatttgtacagtttctctccagtatgaattaccttatgtttagtaagcgttgaggacaggttaaaggccttgtcacattcttcacatttgtaggatttctctcctgtatgaatttttttatggtctgtaaggtttgaagatcggttaaaaactttgccacattcttcacatttgtagcatttctctccagtgtgaattatcttatatgtagaaagggttgaagactggctaaaagctttagcacatttttcacatttgtaaggtttctctcctgtatgaattttcttatgtgtagtaagttttgagcatcgactgaaagttttgccacattcctcacatttgtaaggtttctctccagtatgaattcttttatgtatagtaagagttgacacttggttaaaagctttgccacattcttcacacttgtagggtttctctccagtatgaattcttttatgtatagtaagagttgacacttggctaaaagctttgccacattcttcacacttgtagggtttctctccagtatgaattttcttatgtgtagtaaggtttacgtataggttgaaagctttgccacattcttcacatttatatggtttctctccagtatgaattattttatgtgtagtaagagttgagaactggttaaaagcttttccacattcttcacatttgtagggtttctctccaatatgaattttcttatgtttaataaggtttgatgatcaattaaaagctctgccacattcttcacatttgtagggtttctctccagtatgaattcttttatgtgtagaaagggttgaagattggttaaaagctttgtcacattcatcacatttgtgtaacttctctccagtatgaatcatcttatgtttagtaagggttgagaaatggttagaagttttgccacattcttcacacttgtaaggtttctctccagtatgaattttcttgtgttcaatgagttttgaggatcaggtagaagctttgccacattcatcacatttgtactgtttctcttcagtatgaattatcttatgtgtagtaagtgttgaagattggttaaaagctttgccacattcttcacatttgtagggtttctctccagtatgaattctcttatgtccaataagggttgaagatcggttaaaggctttgccacattcttcacatttgtagagtttctctccagtatgaattttcttacatgtactaagttttgaggataggtggaaaactttgccagattctctacatttgtggggattctctccagtatggattatcttatgtgtattaagggctgaggactggttaaaggctttgccacattctccacatttgtagggtttctctccagtatgaattaccttatgtctagtaaggtttgagagttggttaaaagctttgccacattcctcacatttgtagggtttctctccagtatgaatttttttatggtcagtaagatttgaaaattgtttaaaagctttgccacattcttcacatttgtagggcttctctccactatgaattctcttatgtgtagtaagggttgaggactggttaaaggctttaccacattcttcacatttgtacagcttctctccagtatgaatgtacttatgttcagtaagttttgaggatcggttaaaagctttgccgcattcttcacattcataacgtttctctccggtatgaattaacttatgttcagtaagctttgaggcttggttaaaagctctaacacatttctcacatttgtagggaatttccccagtatgaattatattatgtgtagtaagggtcgatgactggttaaaggctttgccacattcttcacatttgtagggtttctcttcagtatgaattctcttatgtctaataaggtgtgaggtctggttaaaggctttgccacattctttacatttgtaaggtttttctccagtatgaattctcttatgtttattaagggttgaggaccagttaaaggctcttccatatgcttcacatttgtagaaattcactctagtttggattcttttatgttgagttaggtgtgaaagcatgcaaaatgttttgcgacattctttacatttaaaatgtttattttcagtatgtctcatcttgtgtctatttgaatttgaaattttatggaaaacttctacatatttattacattgaaatattttgctcaaggtagttttcaaacattggttaagtccactataatctcctttgtgctgtttacactcaaccacacttttacagccttttcttaactgtaaattctcatatccacattttctatatcttcttagggtcactttctggaaagaatctcttatgttctgctctggccaaaggtgttgggcaaaataataaaacataactgaaagaaataaaagtaacaaactacttcacttgctcgactcagatgaatatactttacaaatctaacccataaagttacagaaactacataagcaagatggcatagcaaaataccacaggttctaattccttcatagacatataaatgtaacaagagcatattgaccaaaatgcatttatagaaaatttataaatgagttacgtgtgtgcagtgttccaggttatcacaattccaaaagccacatggaaggaagagaaaagttggttacatttacccaacacagctctttctgctcctcagtataacatagtgtctttagaagtacattaccaacttttgctttctttttcaacagacaagaaaaataacacacccacatctttatttctggctttattaggtgctttggcggacactggtttctgtctccaatgacataaagtgctgaaattaacagtggtatactttggaatgacattttgagtctgctgagatcaaaggtaaatgttacagcaggaaagagactgtactacagacagggaacagttgtggcaagtgatgactattaagaagaaacatgaataaagtcttttaactaaaaaacaactagaacatttcagacaagacacatcctaagaacatgtttgaaagactctcaggatctctagctaagacaaatggtttcagactttgccaggacaaagctacattatagacactgtgacaggtagcttgtttttaatgttcaaatttcaattaaagattacaatgcatacaaaattttagggcaacatagctctatcagatattataaaattttcagaaagcaaccattaaaaaattaattttaaaaagttaacataaattgaataatactccatgaatgaaatagaaacacagacaactattaaaaatcataaaaattgggataacaaaaatattaaaaatatcaaaaaacagatattgtggaggtaaaaaatataaaaaaggaactgaaaaattataagaaaaactgatgtaaaaattaaaaaggttaacaaagaaactagaatacacacaaagatatttacaacaagaacatatataagcacaattttaaaagtcacagacaagagaatattgtgagttgcaagataaaagtgatatgttatttataagcatagtcttatgaggtaatgagtgaatttctcaagaaaatttgcaggccagaagggaactaactgtgtgacattgtccaagtcctgaagaaaatagctgtcaagtgagaataataccagcagcaaatctgtcctgccaaataaaaagaaaaagccaatccaaaatagccaaatcctgaaaaggtatattggcactgcatatgccttacatatgtaactatatttcaaagctatagtagtaaaaacagaatggaatatacagaaaaataaacaacaacaaaaaaaccaatggaacagaaatcactactcacacatttcagacttgatgcaaaaagagaatttaaaaaactgtttaacatagagtttctcaaaattatgcatatttgtgtgtcccccaaaacaacaacaaaaaaaaaccagtcagattgtgcagtcttttatatcccatgaagaggatgttggctttcactgtgaaattgaagacagatcactaaagggaaagaggaatccttagagaattgaaaaacaatacaaaatatgttctatgtgagagaaaaataaaaaaaaactcgggctttccagaaactatttcctttggaacacagcttaccaaatcacattttaagctgtggccttctccttggcctttgacctcttctctgtgccatctgtgtattcactctcacttacctaaatgtttagctaccatctcatgtctcttcatattccagggctcttttccttgctccagacaggtaatcaggtctggcttagagacagcaatacctgttttattgaaaataaataacataaatcttgcacatattctccaattaccaacttggtaatgtgctcagtaaagagaatgcaatagaatattctagtaaattaatccccaaatgctaatttataacaaaaatttctaaagatttagaaaatattttaaatttgtagtttcttaatttcactacctggtactactgaatcaaaacaattgttgttgggagttagattttaaggtgtgggcaacaatattttatgccaataaatttctaaaattaccactaatcaagactgaatgataaagatcatctcaggaatgtggaaagttatggtaaagatgaaacatcttgaataaactattttctacaatgacaaatctaaaagatttttttgaaaacagggatctgaaactcaatttatgcaaagcataaatcaccaaaaacattctacaaaaaagagaattaaaacctttagggtatattagaaaatgtgtattgaagttaccttcacccaagaaaaccaggtttctgtagttctctcacatcacatgcctatataaattctgctgtgcagtgtccaggcattgccactcctccaaagagaattctatggccacatccataaatgtcaatggtccctgaaaaacacaaaaacacacacatacacaaaatcacatacatttaccaagtggccatgggcataattttaaatttcaaggtaaaataaaacagtaaagaaaactggttctgacttataggagtgaatgaaactatccataaaagaatttttaacacagaaatattttctaatgtattatctaaccctgagaaaagaaagtggtataagaagatccacaacatctgtgtatatatggtacttttctggataataaagtataaattagggcataaacgccaacatgtctatttttaaatgctatatctgcatcatacagaatgagttgtgtgtatttttgagatgaaaaagacatgttgagttaaaaggtacctcgcaagttttaatgtgtatgataaacttcagatctcgttaatgcagattattttttcagaagatctggaacagtctgatattctaaatttctaaaaagctcaccaataatgtcaatgtttttggcccaagaagagtattttgtcaaacatctagtaggtgggtgagcctgtgtttttcccagtttttctggcctgtaaaaagggatgacagctttcattttcctaaggcagatatacgcacagaaaacctaagaaagaaaggcagctgccagattaaatgtgatggtttacatgcacatcagcagcataaagatacttaataatgaagagaaaaataattatagtaaagaaatctgtccaagagctctttaaccaattgaatcattaacatcaactgcactaggacaaatttttgtaatgtgctgatgcacacagaaaaatgcagcttcactgctgcgatattgatctcaaaagtaaattagagtttgaatttaaccataaaaaatcagttttatggaaacttcaagatacagataattcatatgttctgtaatttttaatagtgattttaagtagtttttcttcagcaccctaaagagcaggtatctatctcctaataatttgtttcagaactttctgggtaataaatgccattctgtttgaaaaagcattttattaatcgtgttctgcatagagctaatggagaacagagatggtacctcaacgttacatgttctccttctttactaaagaccctagcttttccccaataggaatcttgagtagtcacaccttcccatgttcaacagccacagagggaacatttttcatgttgcagattataaattcataatgagatttctacgtggcatataaagagccgtgatgtagagatgtagagaagcctctggtatgtaggaaaaaatatttttcagagacccttgactatcataagaattttaaaaagtagttgaaacaaactcattagggagaaacaacacaattagagaagtaaaggtttgcaagaactaaatgcatggcattccaggaggcagagtggacacagctctctatctgagacatattaagcttaaaaaaaggtcatgtcttcctctttctcctgtttctctgggattccttttaagatgagattctatggacaaattacacctgcatgctgagaatatgcttttaaaagtgtcagcaccacctgtttacctgctaccaccacacccacagagatagacagagatagctctaagagctctgtgacagcccacctcattcacagacaccatgggatagtaatggggcctctaaaacagaaaccaaaagcattcaagagaaaaacagctctcactctgagaaaaattgtattgagagaaaaacagttaaaagcatcttttaaaaacacaagctagatataagtttgatcaagtcagccagaaaatattctgctaatcaatttttctaaacacccaaattgcacagctactctcagcatgagaaacgtgagcattatgaagaaaggggtcatattctcagcagaattttataaggattctcttccatctctgctgctctctcttctcctagccattaaatgagagatctataatggaatatatttgacaatttccaaagaacactttttttttttgagacggagtcttgctctgtcatccaggctggagtgtagtggtacaatctcagctcactgcagcctccacctccagggttcaagggattctcatgcctcagcgtccagagtagctgggattacaggcatgtgccatcacgcccaactaatttttgtatttttagtagagacagggtttcaccatgttggccaggttggtcttgaactcctgacctcaagtgacccgcctgcctggacctcccaccaccataactttccgatgaagaattagaatattactttattcatatagtggaatacatttgagtttgcatcatggtgaactgtagagctattatggtttttgggtggccaaatcattcttgtttacttttcccgtaatagcaccattccaatttagtgaaatgatagacactaaaatcatgcttacctataattaactctactggataaattagtaagcatgtcatactaatattactgtaatagtttggtagtaaatttcctttgaatattagatataaatatctaagtataaataatgtactagtcataatgtacataggatttttaaaaattgtctacaaccataattcaattaaaacagtttatatttcaaaagtatgaatataacattattttttgtttgtttttttgttttgaaacagtctcgctctattgcccaggctggagtgcagtggtgcaatctcagcccactgcaacctctgcctcccaggttcaagcgattcacatgcctcagcctcctgagtagctgggattacaggcacgcgccaccacgcccggctaatttttgtattttttagtagagatggagttttgccatgtcggcaaggctggtcttgaactcctgacctcaggtgatccacccaccttggcatcccaaagtgcagggattacaggcatgagccaccacgcccggccgaatataacattattaaaatgactaagggattcaaagtaaatattgtagtgttatattcacactagtatataaaatactgtttatatgaatgcagtttgtctacaaacactacatataactatgctaattgtactcaagtaataaatataaaccaaagcacaactacagactccactgttcagttcatacactgaaccatgcttttgcaataaaagtacttcggcctgcaaatattacctgattaccttggataatctgtattctatcaaaggaacttagtatcttttagtctttagcattttttattgctaaatttaatcctatcttcatgctcaacttttgtgtgctcttaaaacaaactttaatctaaacaaatctgtgtctaccttaaaagacaacaaatggagaaaataaatctttgccaaagcaatgaacctgaggtcctagacaaagacaatcccaagtcaaaaacagtgacaaaaggtttaactgttaatatgatttacatatctttcaaacaacagagaaaaaatatacataaaatttaaatgctttaaggaaaaataaattaagaaaatatactcctggcagggtgcagtggctcacacctgtaatcccagcactttgggaggctgaggctggtgaatcatgaggtcaggagtttgaggccagcctagccaacatggtgaaacctcatctctactgaagatacaaaaaattagccaggtgtggtggtgtgtgcctgtaaccccagctactcgggaggctgagtacacttgaacccaggaggtggaggttgcagtgagccagatcatgccattgcactccagcctgggcaaccaggtgagactccatctcaaaaaaaaaaaaaaaaaaaagaaagaaagaaaatatcctcccttttttcatgtggagaataaggcttcttatttctaatttgtattttccactataacagccaggtctctggacatgtttttgaactactggacatcttaattttgcatgccatgtgcacttgagaaatgtttatgggaaaaaagcagaagaaagaaaggtgttataaaaaaaaaatccatgggtgtatcaatcaagaaaaatgacaagaaaagtctcaatcattttaggagatttatttcccaaagttaagaatgcacagctaggaaaaaggcctatgtctttctcccaagaaaattttgggggctccaaatttaaaggagaaagaatgagatactgagaagtacaaaactgttatgtaagagggaggtagggaaaaacagtcattcatgtcattgtctgtcagtgaatctgcattttttttaacataagatgatgcagacaaatggcacagacaaaaaatgcaggtaatctgcatttttacataagataacatagacaaaaaggggcaggggaacaatcagatatgcatttatgtctggtggaacgtgtaaagataagccatcaatttatatttccatggtataattttaacagaaacaccttagggtaaagatcttgcagctcactagaaattttcttgtgggcaaaatatgagggagtcatgtaacttttcatcttgtagccatcttatttaagaaccaaaaggataggtgggtttgtgtgacccagttcccagcctaacttttctttttggtttaatgagtttgggctctgaagatttcatttcctttcacaggtacacatgaataagaccagttctaagagatttatatttagattctgacagaataattttgggagactacaacaccccacagacactattagacacatttttgaggcagaaaattaacaaagatattaggacctaaactcaatacttgaccaaataatcataatagacatctacaaaagtctccatctaaaagcaatataatatacattcttctcatcaccaagtggcccatactctaaaattgaccacacaatcagaaataaaacaatcctcaccaaattcaaacatccccaaattataccaaccacacactctgaccacaacttgatacaaatataaatcaaaacaaagaaaaccacttgaaaccatacaattatgtggaaattaaacaacctgcatctgaataacttttgggtaaataataaaattaaggcagaaataaaaaagttctttgaaacaaatgagaacaaagtacaacataccagaatctctgcaacacagctaaggcagtgttaaaagaagaatttatagcactaaatgctcacataaaaaagttaaaaagatctcaatttaacaatgtaatatcataaataaaatgagagatgcaagacaaaaccaatccctaactagcagagggcaaaaagtaactaatctgatctgtactgaaggagatttagatgtgaaaaactatacaaaagatcaagaaatccaggagttaaatctttggaaaaaattaataagctaaataaaccacgagccagattcataaagaaagaagattcaaataaagagaattagaaatgacaaaaggaacattaaccctgaccccacaagaatacaaataactgttgaagtctactataaacacttctatgaacacaaactaaaaaatctgaaagaaatagtaaattcagctgggtgcggtggctcacatctgtagtcccagctctcagggaggcaaaaggtgggaggatagcttgagcccaggagtttgagacctgcctgggcaatatagtgagaccccgttctccacaaaaaggaaaaaaaaaaaaaaaagaccaaaaaaatagaaatagtaaagtcgtggacaaatatatcctcccaagactgaacaaaaaagaaatcgaatctctgagtagaccaataacaaactccaaaactgaattagtaatgaatagcctagcaaccaaaaaaagcccaggacgagagagattcacaactgaattctaccagatgtacaaagaagagctggtaccattccttctaaaactattccaaaaaattgagaaaaaaacactccccttcaactcattatataagaatgtcatcattctgacaccaaaacctgacataggtataacaaaaaaagaaaactttaggccaatatccttgatgaccattgatgcaaaaatcttcaacaaaatattggcaaattaaattcaacagcacatcaaaaagcaaatccattatgatcaagtaggctttatccctgggatatgaggctggttcaacatacacaaattaatatatgtgattcattacaaaaacaaaaataaggataaaaaccaccagattatctcaatagatgcagaaaaagctttcaagaaaatttaacatctttcacgttaaaaacctgcaacaaactaggcatagaagatacatacttcaaaataatgaattctgtatgacaaacccacaacaaacatactgagtggacaaaagctggaagcatttctccatgaaaactggcacaagacaaggatgttttctctcaccactcctattcaacatagaattggcagccctcaccagagcaatcagacaagagacaaaataaaaggcatccaaataggaagaaaggaagtcaaacttcccattttttgcagatgtaattctatatatagaaaaccctatagtctccacagaaaagctccttaaactgaaaaactgaaccaaacttcacaatacaaagcaaatgtacaaaaattagtagcatccctgtacattaataacatccaagccgaaagccaaatcaaaaacacaatccccttcacaactgccacaaaaagaataaaacatctagagatacagctaaccagggaggtgaaagacctctacaacaagaattacaaaacactgcttaaataaatcatatatgacacaaataaatggagatttattttatgctcatggataaaaaagatcaatatcattaaaatggccatactgccaaaagaaatttacagatctaatgtaattcctatcaaactaccaaaaacattcttaacagaactaaaaacaactattttaaaattcatatagaactaacaaagagcccgaatacccaaggcaatgtatacacacacacacacacatatatacacatatacacacacacacacatatatataaacgactcatagaacaagaaacagaatagatagccaataaataatgccacaatgccacacacctgcaaccatctgatcttcaacaaagcttacaagagcaatgcaggaagaattccctatttaataaatgaggttggaataactagctagcactatgcagaagattgaaactggatgcctttcttacatgatatataaaaatcaattcaagatgaattaaagacttaaatgtagaacttaaaattatatatatatatatatatatatatatatatatatatatatatatatatatatataaaacctgaaaataatctagaaaataacctagaaaattctaagacataaaaactggcaaagattttatgatgaagataccaaaagcaattgcaacagaagcaaaaattgacaaatgggacctaattaaactaaagagctattttgcagcaatggaaacaatcaactgaataaacagacaacctacagactagaagaaaatatttgcaaactatgcttctgacaaaggtctaaaatctagcatccataagaaacttaaacaaatttattttaaaaaaaaagaagaagaagaataagccaggatctgtggctcatgcttgtaatcccagcactttgggaagctgaggcagatggatcatgaggtcaagagatccagaccatcctggccaacatggtgaaaccccatctctaataaaaatacaaaaattagctgggttttgtgtcacgcacctgtgatcccagctactcaggagactgaagcagaagaatcatctgaacctgggaggtggaggttgcagtgagtcgagatcatgccactgcactccatcctggtgacacagcaagactccatctcagaaaacaacaacaacaacaaaaagaaaaccaaaaacctaattaaaaagtaagcaaaaacatgaacagatacttttcaaaagaagacatacatgtggctgacaagcatatgaaaacaaaattcacgttgttaattattagaaaaatgcagagaaaaaccacagtgagataccatctcatccagtcagaatgcctattgttaaaaagtcaatgacagatgcgggctaggttgcagagaaaaaggaatgcttatatgttgtgggaatcaggaggccggagagatcactgggtgcaacaggaaggttttatttaggtggccactggcccagcggattaacatccaaaggctgagccctgaacaaagacagggcttgacttttatacatgcatcaggcaggggcaagtcgggtttttggcgcaaaacctgcgaggtgagaaagcagtcttacagaagcagaacaaaggcagttaatcataccgtgacaggttttacaacaggatttgcaacatgagcctaccttacttaaacatgtcttgtgaccttgccatgctacagaaagaaaaacaagaacttacaaaatctttacagacttgcagaaatagttacaaaaatagttgtgagagcagaacaaagaataatgttatggggagagaatttcaaacagggaaactgataaggagaacttgtttttctcatccctgctcctggagcccactccttcggagcccctgcctggccttgcagataattatcatagctccagcaggactttggagtgagtcagactggtcaggaaaggacttgttttccctttacttgtttttccttttatatttcctgcttcattcccccctttgatgctttttataagtaaagtttaagagaaagcatcactatcttcatttacttcaagaggaagtagctcttttcttggcaggggttaatacttagttagggccattagtcgtgtggtagtccgtctgtccacaagagcctctatggctgtttggatatttttgacaatgaggggtaagagacaagggagtataaggcaaactcccaatatggctaggactatttgtactaaggttttaaatcctccaagggatgagaaccaacctctgaaaagggaatctggagactatcctttccaagtctgaactgggatgtgagctaacttttggattttagcagttatttctttgatgacctttccttcgtcatcaagttccaggcagcagttagtaaggttgaactttccgcatactccctcttcctgggctaggaggtagtctaaggccagtctattttgataaatgacatttctcatttttgtggcttgctgggcaagcagattcaaggcccctgcagtttcattggtaatgatttctagtactgcctgcaatcttataatgcggttaagcatgtaaactggggtgcggtatccccacattccatcttctgcccaggtggctgggccataatattgaattattctttcaggaggccattcattgtccttccaatctcctatagttatgcctcttttgcttttccttttagtttcatcatagatggggtatcctaaggcttctccctgttttaggggcattaggaagaaggacggcctaattgtccccagtacacaggcccctgaccatttagctggcagttgtcgatatgcttgtggcccacagatccagtagaggccagagggtgcctgccaggtatttggagcttcaagttggtaccaagaatggtttaaagatgggaaacgagagaatgggcttgggtgtggtgattcagaattattgcttttgcccctccataaagtctttcctagtgtctcgttgtaatattgttgtcctaggcaagttaactctcctactgggtctgtaaaggcctttccccagcgagcaatacagaattttccaataatggaggtttttaagaaccagatgctctgacttgatggtgcaggttcgagggaagaggcggttagtgtgaaattatcttggggcattagttcccttgcttcccatggccattggtctcccatgttcattcccccacagacataacatgaagcaacgtgcaggctgctggctatgttttcagccagttgggcgaataaattactggccaagggagggggctcaggcaatttctggttaacatgctcatagaatgactcaaaaactcggaactgttgggttgagcgggtccgagttttctttatgatatatagatagacataggctcctgggccaatttcttcaccgctgactcgtgcccctagcggtgcttttaaacctgttgtccatatgggctgatctggctctaagatggtaagatttacagaattgcaagtgcttgttttacaatctggttctaatggtattttggtaagcataattggccctagtgattgttggttagtggaccacgttgtgcagtcccagcaagttgttactggggaatcggtggaacaagcagggtgtgcatacctatttttatggcagctactatagtactccatggaactgaagattacgggaaagagtgagcccatggatactatctggcaaacatcaaagtataaggatacgacatccttgccagagggaaataccttggtttggtttagaagatccccttcctttgacccgacatgaatttcaaaccaggtcccaggtgaagacttagggtcataacacacataaggctggccccttcctgggtcacagactgagtaggttgtctggttgtgagtacaagttcctaggcaggtcccagcacactcataataagtgtgatacaacagggttttagtcatgatgttccccgaccacgtagtgtgggtgcagtggaggcatccctcccagggttctccttttaacatggataaggggagtagcaagaacaaagtgatgagtagcatgttcatacccagcatggacagaaaaggctttttcctggggggagaaggctaagcaaagtgacagcttaatagcaaagtaattaatatgacaaggaaaattactggacttcagatttctaaccacatttacttccctgatgatgactcaagcttcggccgtgcatagactagtcagcttctggggtgactagagcagggctgttgtctcctcaagcttcagccgtgtgtggactggtcagcttccggagtgaccagagcagggctgttgtcatctcactggcaccttggttccatcgtaggatcagctgggttgcatggtctaggtcctgttggctggtccacttgtcctgggctgctggtttcagctgactggatggatggatccaaggcacaattcctgcaactttaacaacagtgggaatagacaagattacagtatggagcccatcccatatgggtcccagagtggttgggttttattttttgacccaaagagagtccctgggtttaaaggggtgtattggatctatcaggcttatgggcattctttcctgtacccagccatggacacttcacatggctatccctaaagcctgcatttgcctccttaaagttaattcccctagttcacggagattacccttaatttgacttatgattggggatggcttgccgaacagtatttcatagggcgaatacccagtttgtttggtgggggtgcacctaacttgaaggaggaccatgggcaggacttgatcccatctcagaggggtttcttggcaatatttcttcagtagctgtttgagtgtccagttcatgcactctacttttcctaagctctgcagccggtaggctgtgtgtaatttccattttatttttaacactcgtgttagttcctgaattatttcagctagaaatgccagcctgttgtctgaccctagagtcacagacagtccaaatctggggataatgtttcttaatagtattttagtcacttctcatgagttcttgcttctggtagggaaagccttggcccatcctgaaaaggtgtagacaagtactaacatgtaccgatagctccctgcctgaggcaactctgtaagtccataagcaggttttcacagggcatggttcctatttcctgaattcctgggggccgagtgggccattgtcatgggttgttctgggcacaggttaaatattgttcacaaacagcttgggtgatggcagtgagtcgcggcacatagaaatggcgtcctagtagcgtttctagtgctgtttttcccacgagttccatgatgcaattacttcacaaatttgggggccaccattttgggaatggccgacctcccatcagaaaatttccaccatcctccttcaatatattttccagttttttgggcaaaacaggccttctcattcggagagtaacttgagacctcctggaggggaggctctgggaggaggggcatagctaaggcttcctttttaaaatgaggtgtaaccattgctgcccattttgcctccctgtctgcctttctgtttccttttgcctctgacgtccctgccctctggtgtcccctgcagtgcatagctgctactttctctgggatccatacagcatctaagagctgtagaattcattctttccattttatttctttgcctgtggcagttaagagtcctctttctttatatatagctccatgaacatgcagtgtggcaaaagcatatttggaatccgtgtaaacactgatctttttgtcttctgccagctggagaaccctcgttagggctgctagctctgccttctgggctgatgttccagcaggctgaggctacgcctccaccactgagtctaaggtcaccactgcctacccagcccagcagaccccttccagcacaaaactgcttccatctatgaagtattctacatctgggtccttgaaaggctggtctgtaaggtctcctcgactggagaatacctcgtccactgttgccacagtcacggaaggtgattcccggtttgactgggagcagggtagctgggttaagggtgttcactgtttctaaagttatgcgtggattttcacataggagcccttggtatcaagtcatcgttgggtttgataaccaatgctgctctctctgatccattaaagttataaccgcatgtggtacctggatggtcaattgttgccccagggtcagtttgtcagcttcttgtgtcaatagggtggtagtggctagtgctttacagcaaggaggccaccctagcaccacagagtcaactgtttggataagtacaccactgggcgatgccatgatcctatgatttgagtcaggacccctatagccattccctttaattcatggacatatagaaagaaaggcttagtagtatctggcagtcctaaggctggagcctgagttagggcttctttgatttgtttaaacaccttcttctggtcagcctttcagaggaggggttccttttcaccctcccttgtggcttcatataagggcctggctataagtgagaaatttgggatccagatatggcagaaccctgctgcccctaagaattcccctatttggcgccaggtggttggagttggaagtgcacaaatggcttgctttcatccatggccaagccagcgttccccttggcttactatgaagcctaaatatttaaccttttcatggcaaatttgggccttctttttggatactctataccctgctttccataagagatggaggaggtcctgggttccccagtaacagtcctcttgggttggggctgccaaaagaaggttgtctatgtactgcaacaaggcgcagttgtcatttggtggggtgtatgccttgaggtctgaggccagtgcttccccaaagattgtgggagaattcttgaacccttgtgggagactagtccaggcgagctgtccccctgtgcctgtgactgaattgtcccattaaaatgcaaagatgggctgactaactggtgccaggtagagacagaagaaagcatcctttaagtccaggactgtaaaccaggtggcacttgctagaataagtcccattaaagtatacaggtttggtactactggatgtatggtcaccgtggcttggtttacagcatgcaagccctgcaccggtatatactcatcagatcctggtccaggcaatggtttttgtaccagcaaaagtggagtgttccagggtgactggcattggattatgatcccatggtcacagagccactttaaatgcttataaatgccccaaatatcctcttgggaaagtgggtactgacaaacctgaactggagttgctcctggttttaattctactaccagtgcctgatttacagccagcccaggtggcttgtcttcagcccatactccaggaattttatcaattggcctaaataataatttctcttcctcctgcgtacaaggctgcattggtgcctgtacttcatgtatagtctccattcctcagcctgcgggatggtgagggttaacaccatggcctttggttgagttaggcttaaagtaatatctccttgtgacccaaaggtaatctgtgcatgcaatttttggagtaggtctcttcctagtagaggcactggataattggggagatacaggaatttatgttggacctctcatcctccaaagacacacctccttggctgacaaaatggcctcttctctgggacccctgtagccccaacaatagttgtatgatctttggatgatggccctatgggctgggtcactaccaagtgttcagccccagtgtctaccataaagttcattagctggcctcctacttctaatgtgaccatgggctcctggggggctaaagagaaggagcccagtctggcctaatcttcatattctccagttcctgccagcctgatcaagtaggtatctgactcccttgggacacaatagcccttggctggcagttttccagttttatagtctctgtcattttcttcattgccctctggacattcacctttccagtgtcccctctttttgcattgcgcacattgattcctacatagtcttggttgactttcaggtctctgcctggcctgaacccctccatgtccatggctatgtccacacccactcgcgatgctagtttcccttcctgtgaggactgccactagcagatcggcctttttcttaagtctgatcagcctctctttgtctcctggttacggttaacatacaccttggtggccacttctaaaagctgagtggcattcatgcccgtgaaacactctagcttttgcagctttcgcctgatgtctccctgggcctgtcctacaaactctgcgttcaccatgcactggttctcagtagcctcagtgtcaaacggggtgtaaagctagaatgctttacagagtctctcataaaactgaccaggactttaattagtctcctgcagcacttccaagattttccccgtgttgactgcctttttcccaccttcctttagcccttgcaggagtgcctcccagtacctctgtaggtactgtaattgggctgcatcatttgggtcccagtgtaggctggcttctgggaattggccctgagcatatatgcctggacattaagtgtgccttctggtgcattgtgttccagccagtggagggctgcctgggtcacccttcggcattcctcggtgttaaacagtgtcaggaggagctgtttgcaatctggccacgttggattttgtgtctgaaaaatggactgcatcagatctgtgagggcttggggcttctctgtgtaggagggagtagggagtatggtgtttccagtttaggagatcagtggttgaaaaaggctggtaaataaaagtcggttgcccccccttgaacctgcccctgttcatcataatagataggtccccgtgtttcacggaggggcatctgccacactctggtgtggccaggtcgaaggcggcctgcttgatcatcctgactttccttcttgacctcctgaggtgggggctcagatttccccctttgaggtgtagcctggagtgtgtcaccatctgagtctggctgctcaggggccgtccttggtaaagggggatagattggcacatagggaggaggggtttctatctcctctgctggttcctgcaaaactggtttttcttgtggctttccttttgtctctgtagctgacagtgaagctgatttttcttttactttaggcttggctcgagctatgagcgttttgcaataagaagccaggcaaggctgcagccatgcaggttgagtttgaactatatttagccatgagtcaatataaggaaattggtctggatgccctggctgtcctccgaccccagtcaccaccttaaatacacggccaattttttccctatctatagttccttcggccagccatccaacattgaaagagggccattctatttcacagagagttctcaacctctggggggtcaacttgatctcataatcccctgtataatcttacttaaagttccttaacatacattctaatgggatgggttttgatgacttccctcccatttcctcccagttatggcagaacccactcactcttcctttcatttcagactgattagaccgtgtcccttgcaggagtatttcagacacttcttagatttaatggagggttcatatgagtcctgaacccggaccaccacaatctataagttgtggggcacctccctaagccatatgccgtagccccaaaggatgtttgccactagtctcggtcggttccacacttcactcagatggtacagtctatgctaagagacctgtggctccacacacgtcactcagcatgttggttccttttggaaccatctctttcacatttattcacacacctccccacttccagtttcctttcttaaccaacttagtgagccactctcacgtcctgggtcagttggggtgtaggtttcttccaactttgcgagcccctctcatgtcctgagtcggattactaggtacaccccaggaggtgatcaggctccccttccatccttatgggacgggtcctgccttgggcccaaaccttactgcagtcctgtagcgtgaagtcctggaatcgtcctgtagccccttaggttccaatgcactgtcagggaggggcgccgggtcatgggagagccaatctcccctccgggttgaaggtctcccaatggtgccttgggtcacgggtctcccccagcccggggctccagtcccacagccaaaggagacagtaaacctgtagtctcccctcctggctggctcgccaaaatgttgtgggaatcaggaggctggagagaccacttggtggaacaggaggattttatttaggtgaccaccagcccagccgatgaacatccaaaggctgagccctgaacaatgacagggcttgacttttatacatgcaaccaacaggggcgggtcaggtttttggcatgaaacctgtgagacaggaaagcagtcttacagaagcagaacaaagacagttaatcataccgtgacaggttttacaacaggatttgcaacatgaccctatcttacttaagcatgtcttgtgaccttgccgtgctacagaaagaaaaacaggaacttatgaaatctttgcaaacttgcagaaatagttacaaaaatagttgtgagagcagaacaaagaataatggtatggggaaagaatttcaaggcggaaactgataaggagaacttgtttttctcatctctgctcctggagcccattcttttggggtccctgcctggccttgcagataatgttatcatagctccagcaggactttggagtgagtcagactgatcagggaaggacttgttttccctttacttgtttttccttttatatttcctgcctcatatacactgcctgtaggagtataacttaattcaaccattgtgaaaagaattgtggcaatgacagaactaaaaacagaattaccatttgacccaggcacctcataattgggtttataccccaaaaaatataaattattctatcataaagatacaaagacatgcatgttcactgcagcactactcacaatagaaaagacatggaatcaccataaacacctatcaatggcagactggataaagaaagtatggtatggcacggtggctcatgcctgtaatcaaagcactttcttttttgtttttttttgagatggagtctcacgctgttgcccagggtggagtgcagtggctcaatctctgctcactgcaagctccgcctcctgggttcacgccattctcctgcctcagcctcccaagtagctgggactacaggtgcccaccaccacgcctggctaattttttgtatttttagtagagacgggggtgtcatcgtgttagccaggatggtcttgatctcctgaccttgtgatctgcccacctcggcctcccaaagtgctgtgattacaggcatgagccactgcatctggccaatcacagcactttcataggccaaggcatgtagattgcctgaggtcataagtttgaaaccagcctgggcaacgtggcaaaaccacatctctacaaaaagtacaaaaagaaaaattagccaggcataatggtatgcacctgcagtcccagcaacttggggggctgaggtagaaggattgtttgcaccagggagattgaggctgcagtgagccaagatcacatcactgtacttcagcctgggtgacacagtgagaccctgtctccaaaactgaataaaataaaataaaatatttaataaaaacaaaatatggtacataaatacaatgaataccgtgtggccataaaaaagaagattgtgtcctttgcagaaacatggacagagttggagaccattatccttagaaaactaatgcagaaacagaagaccaaatgcatgttctcatttctaagtaagagctaaataataagaacacatggacacaaagagagaaacaacggtcactgaggcctagttt
